United States Patent 12,569,549 (FLAVIVIRUS VACCINE) - sequence listing, part 39

SEQ ID NO: 14752 - RNA, 9876 nt, synthetic construct
  misc_feature 1..9876: note = derived and/or modified CDS sequence (opt3) from DENV-2__FJ850105__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgcagcctgagaacctcgaatacaccatagtcatcactccacacagcggtgaggagcatgctgttggcaatgacacggggaagcacggaaaagaaattaagatcacaccgcagtcctcaataaccgaggccgaactgactggctatggtaccgtgacaatggagtgtagtcccaggaccgggcttgatttcaacgaaatggtactgttgcaaatggaggacaaagcatggctcgtgcaccggcagtggtttctggatttacctctgccatggctccccggcgctgacactcagggaagcaattggattcagaaggagacacttgtcacgttcaagaaccctcatgccaaaaagcaagacgtggttgtgctgggctctcaggaaggggcgatgcacaccgccttgactggagcaacagagatccagatgtcctcaggtaatctactgtttaccggccatctcaaatgccgtctgcgcatggataagcttcaactgaaagggatgagctacagtatgtgtacaggaaagttcaagatcgtcaaagaaattgctgagactcagcacggcaccatcgtgattagaatacagtatgagggtgacgggtctccatgcaagatccccttcgaaattacggatttggagaaaaggcatgtactcggccggctgatcaccgttaacccgatcgtgattgaaaaggactcccctgtcaacatagaggccgaacccccatttggagatagctacatcattatcggcgctgagcctgggcagttaaaactgaattggttcaagaagggatcgtctattggtcaaatgtttgagacaactatgcgaggcgccaaacgcatggcaatcctaggggacaccgcctgggatttcggatccctcggcggtgtgtttacatcaatagggaaggctctgcaccaggtcttcggcgcgatctacggagcagcctttagtggcgtgagctggactatgaaaattcttatcggggttgtgattacctggatcggaatgaactccagatctacgagcttgtcagtaagtctggtcctcgtgggcgttgtgacactgtatcttggtgctatggtccaggccgactccgggtgtgtggtaagctggaagaataaagaactgaagtgcggatctggcatattcattaccgataacgtgcacacttggacagagcagtacaagtttcaacccgaatcaccaagtaaattggcaagcgccatccagaaggctcatgaggaaggtatttgtggcatcaggtccgttacccggctcgagaatctgatgtggaaacagataactcccgagttaaaccacatcctgtctgaaaatgaggtcaagctaaccattatgacaggggacacgaaaggaatcatgcaggccggcaagcgctcgctcagacctcaaccaaccgaactgaaatatagctggaagacttgggggaaggcaaaaatgctttccacagagtcacataaccagaccttcttgattgatggaccggaaacagcggagtgccccaatactaacagggcttggaatagtctggaggtggaagactacggctttggtgtgttcaccacgaacatctggctcaagctgcgtgagaaacaggacgtcttttgtgattctaagttaatgagcgccgcaataaaagacaatcgggccgttcacgctgatatggggtattggattgaatccgccctgaacgacacatggaagatggagaaggcatcattcatcgaggtgaaaagctgccactggcctaagtctcataccctttggtccaatggagtgttggaaagtgagatgatcattccaaaaaacttcgctggccccgtaagccagcacaactaccgacctggttatcatactcaaaccgccggcccatggcacctcgggaagctggaaatggattttgacttctgtgagggaacaactgtcgtggttaccgaagattgcggcaatagagggccctctctaaggacaacgaccgcgtccggaaaactgatcactgagtggtgctgtcgctcatgcacactcccgcctctgcggtacagaggcgaggacggttgttggtacgggatggaaattaggccacttaaggagaaggaagagaacttggtgaatagtctggtcaccgccggacatggccagatagataactttagcttaggtgtgctcggcatggctctgttccttgaagagatgctgcgcactcgagttgggacaaaacacgcaatcttgctcgtggccgtatcgtttgtcaccctgattacgggaaatatgtccttccgggacctaggccgtgtgatggtgatggtcggggctactatgaccgatgacatcggaatgggcgttacatatctggccctcctggcagcgtttaaggtgagacccaccttcgccgctggtcttttgctgaggaaattaacttctaaggagctcatgatggccacaattgggatcaccctgcttagccagtcaacaatacctgaaactatcctggagctaaccgatgcactcgctctgggaatgatggtattgaaaattgtgcgcaacatggaaaagtaccaactggccgtcacgatcatggcaattagttgcgtgcccaatgccgttatcttacggaacgcttggaaggtgtcctgtacaatactcgcggccgtctctgtgagcccactgcttctgacctcctcacagcagaaagcagactggattcctttggctctcactatcaagggcctgaatcccaccgccatctttctaacaactctgagcagaaccagtaaaaagaggtcttggccacttaacgaggccattatggctgttggcatggtgtccatactcgcaagctcgctgttgaaaaatgacatcccgatgacggggcctctggtcgccggaggtttactcacagtatgctatgtgctgaccggccgatcagcggatcttgaactggagcgcgctgccgacgttaagtgggaggatcaggcagaaatttctgggagttcccccatcttgagcattactatctctgaggacggaagcatgtccataaaaaacgaagaggaggaacaaacactcaccatcctgattcggactggcctactggtgatctcaggtgtcttcccagtgagtattcccatcacagccgctgcatggtacctttgggaggtaaagaagcagagagccggggtgctctgggatgtccctagcccaccccctgttggaaaagcggaactggaggacggcgcttataggataaagcagcgtggcattttggggtactctcagatcggagccggtgtgtataaagaaggcacctttcacacgatgtggcatgtgactcgcggggcagtcttaatgcaccggggaaagagaatcgagccgtcctgggccgatgtgaaaaaggacctgatttcatacggcggtgggtggaagctcgagggagaatggaaagagggcgaagaggttcaagtactggctcttgaaccaggcaagaatcccagggccgtgcagaccaaacctgggatcttcaagacaaacaccggaacaataggtgcagtcagtctggattttagcccaggcacttccgggtctcccattgtggaccgaaaaggaaaggttgtgggcttgtacggtaatggggtcgtgacccggtcgggagcttatgtaagcgccatcgcgcagacggagaagtcaattgaggataaccctgaaatcgaggacgatatattccgcaaaaagagactaacaattatggacctgcatccgggcgccggcaaaactaagaggtacctccccgcaatcgtccgggaagctatcaaacgagggctgagaacccttattttagccccaacacgcgtggttgctgcagagatggaagaggccctgaggggactccctatccgttatcagacccccgccattaaggctgagcacactggtcgggaaatagtggacttgatgtgtcatgcgaccttcacaatgagactgctctccccagtcagggtgcctaactacaatctgatcattatggatgaggcacactttacggaccccgccagtatcgctgcccgcggctatatctctactcgagttgaaatgggggaggcagccggaattttcatgaccgctacaccaccgggcagcagagatccttttccccaatccaacgcgccaataatggacgaggaacgggagatccccgaaaggtcatggaattctggtcacgagtgggtgaccgatttcaaggggaaaactgtctggtttgtgcctagcattaaggccggaaacgacatcgcagcttgccttcgcaaaaatggcaagaaagtaattcagctgagtcgtaagacattcgattccgaatacgtgaagaccagagccaacgactgggattttgttgtcacgactgacatcagcgagatgggcgcaaatttcaaagccgagcgggtgatagatccaaggcgctgtatgaagcccgtgatcttgacagacggggaagagcgagtcattctagctggacctatgccggtaacccattcttcagccgcgcagagacggggtaggatcggccgcaacccaaaaaatgaaaacgaccaatatatttacatgggggagcccctggaaaatgatgaggactgcgcacactggaaggaggccaaaatgctcttagataacatcaatacccctgaaggaataattccctccatgtttgagccagaaagagagaaggtggacgctatcgatggcgaatacaggctgcggggtgaggcccgtaaaactttcgttgaccttatgcgccgaggggatctgcctgtgtggctcgcttataaggtcgcagccgagggcattaactacgctgacagaaagtggtgttttgatggaatcaaaaataaccagatattggaagagaacgtggaagttgagatctggacaaaggagggcgaaaggaaaaagctgaaaccccggtggctcgacgcccgcatttatagtgatccactggcacttaaggagttcaaggaattcgcggccgggagaaaaagcctaaccctgaatttgatcacagagatgggaaggttacctacttttatgacgcagaaggctcggaacgccctggacaatctcgcagtgctgcataccgctgaagccggtggccgagcatacaaccacgccctttcggagctgccggagacactcgaaactttgctgctactgaccctccttgctacagtcaccgggggaattttcctgtttttaatgtctggcaaaggtatcgggaagatgactttgggcatgtgctgcataattacggcgtccgtgctgctctggtatgcccagatccaaccccactggatcgcagctagcattatcctggagttctttcttatagtactgctcattccagaacctgagaaacagagaaccccccaggataatcagttgacatacgtggttatcgccattctgactgtcgtggccgcaaccatggctaacgaaatgggattcttagagaagacaaagaaagacctaggcctggggtcaatcaccactcaagagagtgaatctaatatactcgacatcgatcttcgcccagcctccgcgtggacactgtatgctgtggccacgacctttgtcactcctatgttgaggcatagcattgagaactcaagtgttaatgtgagcctgacagcaatcgccaaccaggctaccgtactcatgggactgggtaagggctggcccctttccaaaatggacattggggtgccgctcctggcaatcggatgttactctcaggtcaatccaattaccttgacagccgcgctgttactactggtggctcactacgccatcataggccctggtctccaggcaaaggccactcgggaagctcaaaaacgtgccgcagctgggattatgaagaaccccacggttgatggcatcaccgtgatcgaccttgagccaattccctatgatcctaagttcgaaaaacagctgggacaggtcatgttgctgatactctgcgtaacacaggtgctgatgatgagaactacctgggccctttgtgaggcgttaacactggccaccggcccgatcagcactctctgggaggggaatcccggaaggttttggaacacgacaattgcagtttccatggctaatatcttccgcggctcatacttggccggtgcagggctgctattttctattatgaagaacaccactaatacccggcgaggaacaggcaacatcggtgaaactctgggcgagaaatggaagagtagactcaacgctcttgggaaatcggaattccaaatatataagaaaagcggaatccaggaggtggacaggaccctggccaaggagggcattaagcgcggggaaacagatcatcacgccgtctcccggggatctgcgaaattgagatggtttgtggagcgtaatatggtcacgccagaaggcaaggtggttgacctgggttgcgggaggggaggctggtcatactattgtggtggcctcaaaaacgtgcgggaggtaaaggggctgaccaaaggaggccctgggcatgaagagcccatccctatgagcacttacggatggaatttagtgcgccttcagtccggcgtcgatgttttcttcacaccacccgagaagtgcgacaccctgctctgtgatattggtgaaagttctcctaacccaactatcgaggctgggcgaacactaagagtgctgaatttggtcgaaaactggctgaataacaatacccaattttgcataaaggtgctcaacccctatatgccgagcgtaattgagaaaatggaaacgcttcagaggaagtacggaggcgcactggtgcggaatcctttgtcacgcaactccacccacgagatgtactgggttagtaatgccacaggcaacatcgtgagctctgtcaatatgatctccagaatgctgattaacaggttcactatgaaacacaagaaagctacctatgagccagacgtggatctcgggtcaggaacacgaaacataggtatcgaaagcgagattcccaatttagacatcattggcaagcggatcgaaaagataaaacaggagcatgaaacttcgtggcactacgaccaggatcatccttataagacctgggcctaccacgggtcttatgagacaaaacaaaccggaagtgcatccagcatggtcaacggcgtggttcgtctgcttactaagccatgggacgtagtgcccatggtcacgcagatggccatgacagataccactccgtttggtcagcagagagtgttcaaagagaaggttgacacccgcacacaagaacctaaggaggggacgaaaaagctgatgaggatcaccgctgaatggctatggaaagagctcggaaagaaaaagactccccggatgtgtacaagagaggaatttacccgcaaagtgaggtcaaatgcggccctgggcgcaattttcactgatgagaacaagtggaagtccgctcgagaagccgtcgaggacggccggttttgggaattggtggataaagagagaaatctgcacctcgaggggaagtgcgaaacatgtgtatacaacatgatgggaaaaagggagaagaaacttggtgaattcggcaaggcaaaggggtctcgcgccatctggtatatgtggctgggagctcgttttttagagttcgaagccctgggctttttgaatgaggaccattggttcagccggggtaacagtctctccggggtggagggagaaggcctgcacagactaggctacattcttagggatgttgggaaaaaggagggaggtgcgatgtacgcagacgataccgccggctgggacacacgcatcactctggaagacctcaaaaatgaggaaatggtcaccaaccatatgaagggggagcacaaaaagctggctgaggccatttttaagttgacgtatcagaataaagtggtgcgagtccagcggccaacccctagaggaacagttatggatataatcagcaggcgcgaccagagaggctctggtcaagtggggacttacggactgaacaccttcacaaatatggaagcacagctcattcggcagatggagggcgaaggcatcttcaagtcaatccaacatcttactgctaccgaggagattgccgtacagaactggctggctagggtggggcgtgaacgattaagtcgcatggccatatccggagatgactgcgtcgtgaaacccatcgatgacagatttgcaagcgcgctgacggccttgaatgatatgggtaaggttcggaaagacattcagcagtgggagccatctaggggctggaacgattggacacaagtgcccttctgctcgcaccactttcatgaactcgtcatgaaggacgggcgcgtgctggtagttccttgtagaaaccaggatgagctaatcggacgggctaggatttcacagggcgccggttggagccttaaggaaaccgcatgcctggggaaatcctatgctcagatgtggactctcatgtacttccaccgacgtgacctgagattggccgcaaatgccatctgtagtgcggtgccatctcattgggtcccgacaagccgcaccacttggtccatacacgctaagcacgagtggatgaccacagaggatatgttagccgtgtggaaccgggtgtggatccaagaaaatccctggatggaggacaaaacgcctgtcgaatcatgggaggaagttccatatctgggaaagagggaggaccagtggtgcggcagtctcattggccttacctctagagcaacttgggccaaaaacatccagacagctattaatcaggtgcgcagcctgatcgggaacgaggaatacaccgattatatgccctccatgaagcggtttaggcgagaggaagaggaagccggagtactatggtga

SEQ ID NO: 14753 - RNA, 9876 nt, synthetic construct
  misc_feature 1..9876: note = derived and/or modified CDS sequence (opt3) from DENV-2__FJ850106__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgcagcctgagaacctcgaatacaccatagtcatcactccacacagcggtgaggagcatgctgttggcaatgacacggggaagcacggaaaagaaattaagatcacaccgcagtcctcaataaccgaggccgaactgactggctatggtaccgtgacaatggagtgtagtcccaggaccgggcttgatttcaacgaaatggtactgttgcaaatggaggacaaagcatggctcgtgcaccggcagtggtttctggatttacctctgccatggctccccggcgctgacactcagggaagcaattggattcagaaggagacacttgtcacgttcaagaaccctcatgccaaaaagcaagacgtggttgtgctgggctctcaggaaggggcgatgcacaccgccttgactggagcaacagagatccagatgtcctcaggtaatctactgtttaccggccatctcaaatgccgtctgcgcatggataagcttcaactgaaagggatgagctacagtatgtgtacaggaaagttcaagatcgtcaaagaaattgctgagactcagcacggcaccatcgtgattagaatacagtatgagggtgacgggtctccatgcaagatccccttcgaaattacggatttggagaaaaggcatgtactcggccggctgatcaccgttaacccgatcgtgattgaaaaggactcccctgtcaacatagaggccgaacccccatttggagatagctacatcattatcggcgtggagcctgggcagttaaaactgaattggttcaagaagggatcgtctattggtcaaatgtttgagacaactatgcgaggcgctaaacgcatggccatcctaggggacaccgcatgggatttcggatccctcggcggtgtctttacatcaatagggaaggccctgcaccaggtgttcggcgctatctacggagcggcatttagtggcgttagctggactatgaaaattcttatcggggtggtaattacctggatcggaatgaactccagatctacgagcttgtcagtcagtctggtgctcgttggcgtggtcacactgtatcttggtgccatggtgcaggctgactccgggtgtgtagtgagctggaagaataaagaactgaagtgcggatctggcatattcattaccgataacgttcacacttggacagagcagtacaagtttcaacccgaatcaccaagtaaattggccagcgcaatccagaaggcccatgaggaaggtatttgtggcatcaggtccgtcacccggctcgagaatctgatgtggaaacagataactcccgagttaaaccacatcctgtctgaaaatgaggtgaagctaaccattatgacaggggacacgaaaggaatcatgcaggctggcaagcgctcgctcagacctcaaccaaccgaactgaaatatagctggaagacttgggggaaggccaaaatgctttccacagagtcacataaccagaccttcttgattgatggaccggaaacagcagagtgccccaatactaacagggcgtggaatagtctggaggtggaagactacggctttggtgtcttcaccacgaacatctggctcaagctgcgtgagaaacaggacgttttttgtgattctaagttaatgagcgctgccataaaagacaatcgggcagtgcacgccgatatggggtattggattgaatccgctctgaacgacacatggaagatggagaaggcctcattcatcgaggtgaaaagctgccactggcctaagtctcataccctttggtccaatggagtattggaaagtgagatgatcattccaaaaaacttcgcaggccccgtcagccagcacaactaccgacctggttatcatactcaaaccgctggcccatggcacctcgggaagctggaaatggattttgacttctgtgagggaacaactgtggttgtgaccgaagattgcggcaatagagggccctctctaaggacaacgaccgcctccggaaaactgatcactgagtggtgctgtcgctcatgcacactcccgcctctgcggtacagaggcgaggacggttgttggtacgggatggaaattaggccacttaaggagaaggaagagaacttggtcaatagtctggtgaccgcgggacatggccagatagataactttagcttaggtgttctcggcatggccctgttccttgaagagatgctgcgcactcgagtggggacaaaacacgctaccttgctcgtagcagcctcgtttgtcacgctgatcactggaaatatgtccttccgggacctaggccgtgtgatggtgatggtcggggctaccatgacagatgacattggaatgggcgttacctatctggccctcctggcagcgtttaaggtgagacccactttcgccgctggtcttttgctgaggaaattaacatctaaggagctcatgatggccaccatcgggattacactgcttagccagtcaactatccctgaaaccatactggagctaacggatgcactcgctctgggaatgatggtattgaaaatcgtgcgcaacatggaaaagtaccaactggccgtcacaattatggcaatcagttgcgtgcccaatgccgttattttacggaacgcttggaaggtgtcctgtaccatcctcgcggccgtctctgtgagcccactgcttctgacttcctcacagcagaaagcagactggatacctttggctctcaccattaagggcctgaatcccacagccatctttctaactaccctgagcagaacgagtaaaaagaggtcttggccacttaacgaggccatcatggctgttggcatggtgtccattctcgcaagctcgctgttgaaaaatgacataccgatgacagggcctctggtcgccggaggtttactcaccgtatgctatgtgctgactggccgatcagcggatcttgaactggagcgcgctgccgacgttaagtgggaggatcaggcagaaatctctgggagttcccccattttgagcatcacaatttctgaggacggaagcatgtccatcaaaaacgaagaggaggaacaaaccctcactatactgatccggacaggcctactggtgatttcaggtgtcttcccagtgagtatccccattaccgccgctgcatggtacctttgggaggtaaagaagcagagagccggggtgctctgggatgtccctagcccaccccctgttggaaaagcggaactggaggacggcgcttataggatcaagcagcgtggcatattggggtactctcagattggagccggtgtgtataaagaaggcacgtttcacactatgtggcatgtgacccgcggggcagtcttaatgcaccggggaaagagaatcgagccgtcctgggccgatgtgaaaaaggacctgatctcatacggcggtgggtggaagctcgagggagaatggaaagagggcgaagaggttcaagtactggctcttgaaccaggcaagaatcccagggccgtgcagacaaaacctgggattttcaagaccaacacaggaactatcggtgcagtcagtctggattttagcccaggcacctccgggtctcccatagtggaccgaaaaggaaaggttgtgggcttgtacggtaatggggtcgtgacgcggtcgggagcttatgtaagcgccattgcgcagacagagaagtcaatcgaggataaccctgaaattgaggacgatatcttccgcaaaaagagactaactataatggacctgcatccgggcgccggcaaaaccaagaggtacctccccgcaattgtccgggaagctatcaaacgagggctgagaacacttatcttagccccaacccgcgtggttgctgcagagatggaagaggccctgaggggactccctattcgttatcagactcccgccatcaaggctgagcacaccggtcgggaaattgtggacttgatgtgtcatgcgacattcacgatgagactgctctccccagtcagggtgcctaactacaatctgataatcatggatgaggcacactttactgaccccgccagtattgctgcccgcggctatatctctacccgagttgaaatgggggaggcagccggaatcttcatgacagctaccccaccgggcagcagagatccttttccccaatccaacgcgccaattatggacgaggaacgggagatacccgaaaggtcatggaattctggtcacgagtgggtgactgatttcaaggggaaaacagtctggtttgtgcctagcatcaaggccggaaacgacattgcagcttgccttcgcaaaaatggcaagaaagtaatccagctgagtcgtaagaccttcgattccgaatacgtgaagacgagagccaacgactgggattttgttgtcactacagacattagcgagatgggcgcaaatttcaaagccgagcgggtgatcgatccaaggcgctgtatgaagcccgtgatattgaccgacggggaagagcgagtcatcctagctggacctatgccggtaacccattcttcagccgcgcagagacggggtaggattggccgcaacccaaaaaatgaaaacgaccaatatatctacatgggggagcccctggaaaatgatgaggactgcgcacactggaaggaggccaaaatgctcttagataacattaatactcctgaaggaatcataccctccatgtttgagccagaaagagagaaggtggacgctattgatggcgaatacaggctgcggggtgaggcccgtaaaacattcgttgaccttatgcgccgaggggatctgcctgtgtggctcgcttataaggtcgcagccgagggcatcaactacgctgacagaaagtggtgttttgatggaattaaaaataaccagatcttggaagagaacgtggaagttgagatatggaccaaggagggcgaaaggaaaaagctgaaaccccggtggctcgacgcccgcatctatagtgatccactggcacttaaggagttcaaggaattcgcggccgggagaaaaagcctaacactgaatttgattactgagatgggaaggttacctacgtttatgacccagaaggctcggaacgccctggacaatctcgcagtgctgcatacagctgaagccggtggccgagcatacaaccacgccctttcggagctgccggagactctcgaaaccttgctgctactgacactccttgctaccgtcactgggggaatcttcctgtttttaatgtctggcaaaggtattgggaagatgacgttgggcatgtgctgcatcataaccgcgtccgtgctgctctggtatgcccagattcaaccccactggatcgcagctagcatcattctggagttctttcttatcgtactgctcataccagaacctgagaaacagagaacaccccaggataatcagttgacttacgtggttattgccatcctgaccgtcgtggccgcaacaatggctaacgaaatgggattcttagagaagaccaagaaagacctaggcctggggtcaattactacacaagagagtgaatctaatatcctcgacatagatcttcgcccagcctccgcgtggacgctgtatgctgtggccaccacttttgtcacacctatgttgaggcatagcatcgagaactcaagtgttaatgtgagcctgaccgcaattgccaaccaggctaccgtactcatgggactgggtaagggctggcccctttccaaaatggacatcggggtgccgctcctggcaattggatgttactctcaggtcaatccaatcacattgactgccgcgctgttactactggtggctcactacgccattatcggccctggtctccaggcaaaggccacgcgggaagctcaaaaacgtgccgcagctgggataatgaagaaccccaccgttgatggcattacagtgatcgaccttgagccaatcccctatgatcctaagttcgaaaaacagctgggacaggtcatgttgctgattctctgcgtaactcaggtgctgatgatgagaaccacatgggccctttgtgaggcgttaaccctggccactggcccgataagcacgctctgggaggggaatcccggaaggttttggaacacaaccatcgcagtttccatggctaatattttccgcggctcatacttggccggtgcagggctgctattttctatcatgaagaacactaccaatacacggcgaggaactggcaacattggtgaaaccctgggcgagaaatggaagagtagactcaacgctcttgggaaatcggaattccaaatctataagaaaagcggaatacaggaggtggacaggacactggccaaggagggcatcaagcgcggggaaacggatcatcacgccgtctcccggggatctgcgaaattgagatggtttgtggagcgtaatatggtcaccccagaaggcaaggtggttgacctgggttgcgggaggggaggctggtcatactattgtggtggcctcaaaaacgtgcgggaggtaaaggggctgactaaaggaggccctgggcatgaagagcccattcctatgagcacatacggatggaatttagtgcgccttcagtccggcgtcgatgttttcttcaccccacccgagaagtgcgacactctgctctgtgatatcggtgaaagttctcctaacccaacaattgaggctgggcgaaccctaagagtgctgaatttggtcgaaaactggctgaataacaatacgcaattttgcatcaaggtgctcaacccctatatgccgagcgtaatagagaaaatggaaacccttcagaggaagtacggaggcgcactggtgcggaatcctttgtcacgcaactccacacacgagatgtactgggttagtaatgccactggcaacattgtgagctctgtcaatatgatctccagaatgctgatcaacaggttcaccatgaaacacaagaaagctacatatgagccagacgtggatctcgggtcaggaactcgaaacattggtatagaaagcgagatccccaatttagacattatcggcaagcggattgaaaagatcaaacaggagcatgaaacctcgtggcactacgaccaggatcatccttataagacatgggcctaccacgggtcttatgagaccaaacaaactggaagtgcatccagcatggtcaacggcgtggttcgtctgcttacgaagccatgggacgtagtgcccatggtcacacagatggccatgaccgatactaccccgtttggtcagcagagagtgttcaaagagaaggttgacacacgcacgcaagaacctaaggaggggaccaaaaagctgatgaggataactgctgaatggctatggaaagagctcggaaagaaaaagacaccccggatgtgtaccagagaggaatttactcgcaaagtgaggtcaaatgcggccctgggcgcaatcttcacagatgagaacaagtggaagtccgctcgagaagccgtcgaggacggccggttttgggaattggtggataaagagagaaatctgcacctcgaggggaagtgcgaaacctgtgtatacaacatgatgggaaaaagggagaagaaacttggtgaattcggcaaggcaaaggggtctcgcgccatttggtatatgtggctgggagctcgttttttagagttcgaagccctgggctttttgaatgaggaccattggttcagccggggtaacagtctctccggggtggagggagaaggcctgcacagactaggctacatccttagggatgttgggaaaaaggagggaggtgcgatgtacgcagacgatacagccggctgggacactcgcattaccctggaagacctcaaaaatgaggaaatggtcacgaaccatatgaagggggagcacaaaaagctggctgaggccatctttaagttgacctatcagaataaagtggtgcgagtccagcggccaacacctagaggaactgttatggatattataagcaggcgcgaccagagaggctctggtcaagtggggacctacggactgaacacattcactaatatggaagcacagctcatccggcagatggagggcgaaggcattttcaagtcaatccaacatcttaccgctacggaggagatcgccgtacagaactggctggctagggtggggcgtgaacgattaagtcgcatggccatttccggagatgactgcgtcgtgaaacccatagatgacagatttgcaagcgcgctgacagccttgaatgatatgggtaaggttcggaaagacatccagcagtgggagccatctaggggctggaacgattggacccaagtgcccttctgctcgcaccactttcatgaactcgtcatgaaggacgggcgcgtgctggtagttccttgtagaaaccaggatgagctaattggacgggctaggatctcacagggcgccggttggagccttaaggaaactgcatgcctggggaaatcctatgctcagatgtggacactcatgtacttccaccgacgtgacctgagattggccgcaaatgccatttgtagtgcggtgccatctcattgggtcccgaccagccgcactacctggtccatccacgctaagcacgagtggatgacaacggaggatatgttagccgtgtggaaccgggtgtggatacaagaaaatccctggatggaggacaaaacccctgtcgaatcatgggaggaagttccatatctgggaaagagggaggaccagtggtgcggcagtctcatcggccttacttctagagcaacatgggccaaaaacattcagaccgctatcaatcaggtgcgcagcctgattgggaacgaggaatacactgattatatgccctccatgaagcggtttaggcgagaggaagaggaagccggagtactatggtga

SEQ ID NO: 14754 - RNA, 9876 nt, synthetic construct
  misc_feature 1..9876: note = derived and/or modified CDS sequence (opt3) from DENV-2__FJ850107__SS-prME
  source 1..9876: mol_type = other RNA
accgcaggcgtgataattatgctgatacccacagctatggcattccacctcactacgaggaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagttgcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttatctgcaagcattctatggtggatagaggctggggtaacgggtgtggactattcggcaagggcgggattgtcacatgcgccatgtttacatgcaaaaagaatatggaaggaaaagtggtgcagcctgagaacctcgaatacaccatagtcatcactccacacagcggtgaggagcatgctgttggcaatgacacggggaagcacggaaaagaaattaagatcacaccgcagtcctcaataaccgaggccgaactgactggctatggtaccgtgacaatggagtgtagtcccaggaccgggcttgatttcaacgaaatggtactgttgcaaatggaggacaaagcatggctcgtgcaccggcagtggtttctggatttacctctgccatggctccccggcgctgacactcagggaagcaattggattcagaaggagacacttgtcacgttcaagaaccctcatgccaaaaagcaagacgtggttgtgctgggctctcaggaaggggcgatgcacaccgccttgactggagcaacagagatccagatgtcctcaggtaatctactgtttaccggccatctcaaatgccgtctgcgcatggataaacttcaactgaaagggatgagctacagtatgtgtacaggaaagttcaagatcgtcaaagaaattgctgagactcagcacggcaccatcgtgattagaatacagtatgagggtgacgggtctccatgcaagatccccttcgaaattacggatttggagaaaaggcatgtactcggccggctgatcaccgttaacccgatcgtgattgaaaaggactcccctgtcaacatagaggccgaacccccatttggagatagctacatcattatcggcgtggagcctgggcagttaaaactgaattggttcaagaagggatcgtctattggtcaaatgtttgagacaactatgcgaggcgctaaacgcatggccatcctaggggacaccgcatgggatttcggatccctcggcggtgtctttacatcaatagggaaggccctgcaccaggtgttcggcgctatctacggagcggcatttagtggcgttagctggactatgaaaattcttatcggggtggtaattacctggatcggaatgaactccagatctacgagcttgtcagtcagtctggtgctcgttggcgtggtcacactgtatcttggtgccatggtgcaggctgactccgggtgtgtagtgagctggaagaataaagaactgaagtgcggatctggcatattcattaccgataacgttcacacttggacagagcagtacaagtttcaacccgaatcaccaagtaaattggccagcgcaatccagaaggcccatgaggaaggtatttgtggcatcaggtccgtcacccggctcgagaatctgatgtggaaacagataactcccgagttaaaccacatcctgtctgaaaatgaggtgaagctaaccattatgacaggggacacgaaaggaatcatgcaggctggcaagcgctcgctcagacctcaaccaaccgaactgaaatatagctggaagacttgggggaaggccaaaatgctttccacagagtcacataaccagaccttcttgattgatggaccggaaacagcagagtgccccaatactaacagggcgtggaatagtctggaggtggaagactacggctttggtgtcttcaccacgaacatctggctcaagctgcgtgagaaacaggacgtattttgtgattctaagttaatgagcgctgccataaaagacaatcgggcagtgcacgccgatatggggtattggattgaatccgctctgaacgacacatggaagatggagaaggcctcattcatcgaggtgaaaagctgccactggcctaagtctcataccctttggtccaatggagtattggaaagtgagatgatcattcccaagaatttcgcaggccccgtcagccagcacaactaccgacctggttatcatactcaaaccgctggcccatggcacctcgggaagctggaaatggattttgacttctgtgagggaacaactgtggttgtgaccgaagattgcggcaatagagggccctctctaaggacaacgaccgcctccggaaaactgatcactgagtggtgctgtcgctcatgcacactcccgcctctgcggtacagaggcgaggacggttgttggtacgggatggaaattaggccacttaaggagaaggaagagaacttggtcaatagtctggtgaccgcgggacatggccagatagataactttagcttaggtgttctcggcatggccctgttccttgaagagatgctgcgcactcgagtggggacaaaacacgctatcttgctcgtagcagtctcgtttgtgaccctgattacgggaaatatgtccttccgggacctaggccgtgtgatggtcatggttggggccactatgaccgatgacatcggaatgggcgtgacatatctggctctcctggccgcatttaaggtaagacccaccttcgcggccggtcttttgctgaggaaattaacttctaaggagctcatgatggctacaattgggatcaccctgcttagccagtcaacaatacctgaaactatcctggagctaaccgatgccctcgcactgggaatgatggtgttgaaaattgtccgcaacatggaaaagtaccaactggctgtgacgatcatggccattagttgcgttcccaatgcagtgatcttacggaacgcctggaaggtctcctgtacaatactcgctgcggtgtctgtttttccactgcttctgaccagctcccagcagaaagccgactggattcctttggcactcactatcaagggcctgaatcccaccgctatcttcctaacaactctgtcaagaaccagcaaaaagaggagttggccacttaacgaggccattatggccgtgggcatggtctctatactcgcttccagcctgttgaaaaatgacatcccgatgacggggcctctggtagcaggaggtttactcacagtgtgctatgttctgaccggccgatcggccgatcttgaactggagcgcgcggctgacgtgaagtgggaggatcaggccgaaatttcagggtctagtcccatcttgtccattactatcagcgaggacggatctatgagcatcaaaaacgaagaggaggaacaaacactcaccatcctgattcggactggcctactggtcatctccggtgtgtttccagtatcaattcccatcacagcagccgcttggtacctttgggaggtgaagaagcagagagcaggggtcctctgggatgttcctagtccaccccctgtgggaaaagccgaactggaggacggcgcgtataggataaagcagcgtggcattttggggtacagccagatcggagctggtgtgtataaagaaggcaccttccacacgatgtggcatgtcactcgcggggccgtgttaatgcaccggggaaagagaatcgagccgtcttgggcagatgttaaaaaggacctgatttcctacggcggtgggtggaagctcgagggagaatggaaagagggcgaagaggtacaagtgctggcccttgaaccaggcaagaatcccagggctgtccagaccaaacctgggatctttaagacaaacaccggaacaataggtgccgtgtcactggatttcagtccaggcactagcgggtcccccattgttgaccgaaaaggaaaggtggtcggcttgtacggtaatggggtggtaacccggtctggagcatatgtctcggctatcgcccagacggaaaagagcattgaggataaccctgaaatcgaggacgatatattccgcaaaaagagactaacaattatggacctgcatccgggcgcgggcaaaactaagaggtacctccccgccatcgtgcgggaagcaatcaaacgagggctgagaacccttattttagctccaacacgcgttgtggccgctgagatggaagaggcactgaggggactccctatccgttatcagacccccgccattaaggccgagcacactggtcgggaaatagtcgacttgatgtgtcatgctacctttacaatgagactgctctcaccagtgagggttcctaactacaatctgatcattatggatgaggcgcacttcacggaccccgcatccatcgccgctcgcggctatatcagtactcgagtggaaatgggggaggccgcaggaatttttatgaccgccacaccaccgggctctagagatcctttcccccaaagcaacgctccaataatggacgaggaacgggagatccccgaaaggtcctggaactcaggtcacgagtgggtcaccgattttaaggggaaaactgtgtggttcgtaccttctattaaggcgggaaacgacatcgccgcatgccttcgcaaaaatggcaagaaagtgattcagctgagccgtaagacatttgatagtgaatacgttaagaccagagctaacgactgggatttcgtcgtgacgactgacatctccgagatgggcgccaattttaaagcagagcgggtgatagatccaaggcgctgtatgaagcccgtcatcttgacagacggggaggaacgagtaattctagccggacctatgccggtgacccatagctctgctgcccagagacggggtaggatcggccgcaaccccaaaaatgaaaacgaccaatatatttacatgggggagcccctggaaaatgatgaggactgcgcgcactggaaggaggcaaaaatgctcttagataacatcaatacccctgaaggaataattccctcaatgttcgagccagaaagagagaaggttgacgccatcgatggcgaatacaggctgcggggtgaggctcgtaaaacttttgtggaccttatgcgccgaggggatctgcctgtctggctcgcctataaggtggctgcagagggcattaactacgccgacagaaagtggtgtttcgatggaatcaaaaataaccagatattggaagagaacgttgaagtggagatctggacaaaggagggcgaaaggaaaaagctgaaaccccggtggctcgacgctcgcatttattccgatccactggcccttaaggagttcaaggaatttgcagcggggagaaaaagtctaaccctgaatttgatcacagagatgggaaagttacctactttcatgacgcagaaagccaggaacgctctggacaatctcgccgtcctgcataccgcagaagctggtggccgggcctacaaccacgcacttagcgagctgccggagacactcgaaactttgctgctactgaccctccttgccacagtgaccgggggaatttttctgttcttaatgtcgggcaagggtatcgggaaaatgactttgggcatgtgctgcataattacggcttctgtactgctctggtatgcgcagatccaaccccactggatcgccgcatccattatcctggagtttttccttatagtgctgctcattccagaacctgagaagcagcgaaccccacaggataatcagttgacatacgttgtcatcgctattctgactgtggtggccgccaccatggcaaacgaaatgggatttttagagaagaccaaaaaggacctaggcctggggagcatcaccactcaagagtcagaaagtaatatactcgacatcgatcttagaccagcttctgcctggacactgtatgcggtcgctacgaccttcgttactcctatgttgcgccattccattgagaacagctcagtgaatgtaagtctgacagccatcgcaaaccaggccaccgtgctcatgggactgggtaaaggctggccccttagcaagatggacattggggtcccgctcctggctatcggatgttactcccaggtgaatccaattaccttgacagcagccctgttactactggttgcgcactacgctatcataggccctggtctccaggccaaagcaactagggaagcccaaaagcgggctgccgcagggattatgaagaaccccacggtggatggcatcaccgtcatcgaccttgagccaattccctatgatcctaaatttgaaaagcagctgggacaggtaatgttgctgatactctgcgtgacacaggttctgatgatgcgtactacctgggctctttgtgaggccttaacactggcgaccggcccgatctctactctctgggaggggaatcccggaagattctggaacacgacaattgccgtgagcatggcaaatatctttaggggctcctacttggctggtgccgggctgctattctcaattatgaaaaacaccactaatacccgccggggaacaggcaacatcggtgaaactctgggcgagaagtggaaatctcgactcaacgcacttgggaagagtgaatttcaaatatataaaaagtcgggaatccaggaggtcgacagaaccctggctaaggagggcattaaaagaggggaaacagatcatcacgccgtgagccgcggatccgccaagttgcggtggttcgtcgagagaaatatggtgacgccagaaggcaaagttgtggacctgggttgcgggcgtggaggctggtcttactattgtggtggcctcaagaacgtaagggaggtgaaagggctgaccaagggaggccctgggcatgaggaaccaatccctatgtcaacttacggatggaatttagtccggcttcagagcggcgttgatgtgttctttacaccacccgagaagtgcgacaccctgctctgtgatattggtgaatccagtcctaacccaactatcgaggcggggcgcacactacgagtcctgaatttggtggaaaactggctgaataacaatacccaattctgcataaaagtactcaacccctatatgccgtctgtgattgagaagatggaaacgcttcagagaaaatacggaggcgctctggttaggaatcctttgagccggaactcaacccacgagatgtactgggtgtccaatgcaacaggcaacatcgtcagtagcgtgaatatgatctctcgcatgctgattaacagatttactatgaagcacaaaaaggccacctatgagccagacgtcgatctcgggtccggaacaaggaacataggtatcgaatcagagattcccaatttagacatcattggcaagcgaatcgagaaaatacggcaggagcatgaaactagctggcactacgaccaggatcatccttataagacctgggcttaccacgggtcgtatgagacaaaacaaaccggatctgccagttccatggtgaacggcgttgtacgtctgcttactaagccatgggacgtggtccccatggtgacgcagatggcaatgacagataccactccgttcggtcagcagagagtttttaaagagaaggtggacacccgcacacaagaacctaaggaggggacgaaaaagctgatgaggatcaccgccgaatggctatggaaagagctcggaaagaaaaagactccccggatgtgtacaagagaggagttcacccgcaaagtcaggagcaatgctgcgctgggcgccatttttactgatgagaacaagtggaagtcagcacgagaagctgtggaggacggccggttctgggaattggtagataaagagagaaatctgcacctcgaggggaagtgcgaaacatgtgtgtacaacatgatgggaaaaagggagaagaaacttggtgaatttggcaaggccaaggggtcccgcgcaatctggtatatgtggctgggagcccgtttcttagagtttgaagctctgggcttcttgaatgaggaccattggttttctcggggtaacagcctcagtggggttgagggagaaggcctgcacagactaggctacattcttagggatgtcgggaaaaaggagggaggtgccatgtacgcggacgataccgcaggctgggacacacgcatcactctggaagacctcaaaaatgaggaaatggtgaccaaccatatgaagggggagcacaaaaagctggccgaggctattttcaagttgacgtatcagaataaagtggtccgagttcagcggccaacccctagaggaacagtgatggatataatctccaggcgcgaccagagaggcagcggtcaagtagggacttacggactgaacaccttcacaaatatggaagcccagctcattcggcagatggagggcgaaggcatctttaagtctatccaacatcttactgcaaccgaggagattgctgtgcagaactggctggccagggtcgggcgtgaacgattatcacgcatggctataagtggagatgactgcgtggttaaacccatcgatgacagattcgcctccgcactgacggcgttgaatgatatgggtaaggtgcggaaagacattcagcagtgggagccaagcaggggctggaacgattggacacaagtccccttttgctctcaccacttccatgaactcgtgatgaaggacgggcgcgtactggttgtgccttgtagaaaccaggatgagctaatcggacgggccaggatttcgcagggcgctggttggtcacttaaggaaaccgcctgcctggggaaaagctatgcacagatgtggactctcatgtactttcaccgacgtgacctgagattggctgccaatgcaatctgttccgccgtcccaagtcattgggtgccgacatctcgcaccacttggagcatacacgcgaagcacgagtggatgaccacagaggatatgttagctgtgtggaaccgggtctggatccaagaaaatccctggatggaggacaaaacgcctgttgaatcctgggaggaagtgccatatctgggaaagagggaggaccagtggtgcggctcactcattggccttaccagtagagccacttgggccaaaaacatccagacagccattaatcaggtacgctctctgatcgggaacgaggaatacaccgattatatgcccagcatgaagcggttcaggcgagaggaagaggaagctggagtgctatggtga

SEQ ID NO: 14755 - RNA, 9876 nt, synthetic construct
  misc_feature 1..9876: note = derived and/or modified CDS sequence (opt3) from DENV-2__FJ850108__SS-prME
  source 1..9876: mol_type = other RNA
accgcaggcgtgatcgtcatgctgattccaactgctatggcattccacctcactacgagaaacggggagcctcatatgatagttgggaggcaggaaaagggtaaaagccttctgtttaagaccgaggacggcgtgaatatgtgcacattgatggcaatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccacatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgatcgaaaaggactcccctgtcaacatcgaggccgaacccccatttggagatagctacattataatcggcgtggagcctgggcagttaaaactgaattggttcaagaagggatcgtctattggtcaaatgtttgagacaactatgcgaggcgctaaacgcatggccatcctaggggacaccgcatgggatttcggatccctcggcggtgtttttacatcaattgggaaggccctgcaccaggtgttcggcgctatctacggagcggcatttagtggcgtaagctggactatgaaaatacttatcggggtcgtgattacctggatcggaatgaactccagatctacgagcttgtcagttagtctggtgctcgtcggcgtggtaacactgtatcttggtgccatggtgcaggctgactccgggtgtgttgtcagctggaagaataaagaactgaagtgcggatctggcattttcatcaccgataacgtgcacacttggacagagcagtacaagtttcaacccgaatcaccaagtaaattggccagcgcaatacagaaggcccatgaggaaggtatttgtggcatcaggtccgtgacccggctcgagaatctgatgtggaaacagattactcccgagttaaaccacatcctgtctgaaaatgaggtcaagctaaccataatgacaggggacacgaaaggaatcatgcaggctggcaagcgctcgctcagacctcaaccaaccgaactgaaatatagctggaagacttgggggaaggccaaaatgctttccacagagtcacataaccagaccttcttgattgatggaccggaaacagcagagtgccccaatactaacagggcgtggaatagtctggaggttgaagactacggctttggtgtgttcaccacgaacatctggctcaagctgcgtgagaaacaggacgtgttttgtgattctaagttaatgagcgctgccattaaagacaatcgggcagtacacgccgatatggggtattggatcgaatccgctctgaacgacacatggaagatggagaaggcctcattcatagaggtcaaaagctgccactggcctaagtctcataccctttggtccaatggagtgttggaaagtgagatgattatccccaagaatttcgcaggccccgttagccagcacaactaccgacctggttatcatactcaaatcgctggcccatggcacctcgggaagctggaaatggattttgacttctgtgagggaaccacagtggtcgtgactgaagattgcggcaatagagggccctctctaaggaccacaacggcctccggaaaactgattaccgagtggtgctgtcgctcatgcactctcccgcctctgcggtacagaggcgaggacggttgttggtacgggatggaaatcaggccacttaaggagaaggaagagaacttggttaatagtctggtgacagcgggacatggccagattgataactttagcttaggtgtactcggcatggccctgttccttgaagagatgctgcgcacccgagtcgggactaaacacgctatattgctcgtggcagtgtcgtttgtcacactgatcaccggaaatatgtccttccgggacctaggccgtatgatggttatggtgggggccacgatgactgatgacattggaatgggcgtaacctatctggctctcctggccgcatttaaggtgagacccacattcgtcgcgggtcttttgctgaggaaattaacctctaaggagctcatgatggccactatcgggattacactgcttagccagtcaaccatccctgaaacaatactggagctaactgatgctctcgccctgggaatgatggtgttgaaaatcgttcgcaacatggaaaagtaccaactggcagtgaccattatggctatcagttgcgtccccaatgccgtgattttacggaacgcatggaaggtttcctgtacgatcctcgccgctgtgtctgtcagcccactgcttctgacatcctcacagcagaaagcggactggatacctttggccctcaccattaagggcctgaatcccactgcaatctttctaaccacactgagcagaacaagtaaaaagaggtcttggccacttaacgaggctatcatggccgtaggcatggtgtccattctcgccagctcgctgttgaaaaatgacataccgatgaccgggcctctggttgctggaggtttactcacggtgtgctatgtcctgacaggccgatcagcagatcttgaactggagcgcgccgcggacgtgaagtgggaggatcaggctgaaatctctgggagttcccccattttgagcatcaccatttctgaggacggaagcatgtccatcaaaaacgaagaggaggaacaaactctcacaatactgatccggaccggcctactggtaatttcaggtgtgttcccagtcagtatccccattactgccgcagcctggtacctttgggaggttaagaagcagagagctggggtgctctgggatgtgcctagcccaccccctgtcggaaaagcagaactggaggacggcgcctataggatcaagcagcgtggcatattggggtactctcagattggagcgggtgtgtataaagaaggcacatttcacaccatgtggcatgttacgcgcggggctgtattaatgcaccggggaaagagaatcgagccgtcctgggccgatgtgaaaaaggacctgatctcatacggcggtgggtggaagctcgagggagaatggaaagagggcgaagaggtccaagtgctggcacttgaaccaggcaagaatcccagggccgttcagactaaacctgggattttcaagaccaacacaggaaccatcggtgctgtgagtctggattttagcccaggcacatccgggtctcccatagtcgaccgaaaaggaaaggtggtaggcttgtacggtaatggggtcgtgactcggtcgggagcctatgttagcgcaattgctcagaccgagaagtcaatcgaggataaccctgaaattgaggacgatatcttccgcaaaaagagactaacgataatggacctgcatccgggcgccggcaaaacaaagaggtacctccccgcgattgtgcgggaagccatcaaacgagggctgagaactcttatcttagcaccaacccgcgtcgtggctgccgagatggaagaggctctgaggggactccctattcgttatcagacacccgcaatcaaggccgagcacaccggtcgggaaattgttgacttgatgtgtcatgccactttcaccatgagactgctctccccagtgagggtccctaactacaatctgataatcatggatgaggctcactttacagaccccgcgagtattgcagcccgcggctatatctctacgcgagtggaaatgggggaggctgccggaatcttcatgactgcaaccccaccgggcagcagagatccttttccccaatccaacgccccaattatggacgaggaacgggagatacccgaaaggtcatggaactctggtcacgagtgggtaacagatttcaaggggaaaaccgtgtggtttgttcctagcatcaaggctggaaacgacattgcggcctgccttcgcaaaaatggcaagaaagtcatccagctgagtcgtaagactttcgattccgaatacgtgaagacaagagcaaacgactgggattttgtggtcaccacggacattagcgagatgggcgctaatttcaaagccgagcgggtaatcgatccaaggcgctgtatgaagcccgtgatattgactgacggggaagaacgagttatcctagcaggacctatgccggtgacacattcttcagccgctcagagacggggtaggattggccgcaaccccaagaatgaaaacgaccaatatatctacatgggggagcccctggaaaatgatgaggactgcgcccactggaaggaggcgaaaatgctcttagataacattaatacccctgaaggaatcataccctccatgtttgagccagaaagagagaaggtcgacgcaattgatggcgaatacaggctgcggggtgaggcccgtaaaaccttcgtggaccttatgcgccgaggggatctgcctgtttggctcgcttataaggtggccgctgagggcatcaactacgcagacagaaagtggtgttttgatggaattaaaaataaccagatcttggaagagaacgtcgaagtggagatatggactaaggagggcgaaaggaaaaagctgaaaccccggtggctcgacgcccgcatctatagtgatccactggctcttaaggagttcaaggagttcgccgcagggagaaaaagcctaacactgaatttgattaccgagatgggaaggttacctacatttatgactcagaaggcgcggaacgccctggacaatctcgctgtactgcatacggccgaagccggtggccgagcttacaaccacgccctttcggagctgccggagaccctcgaaacattgctgctactgactctccttgcaaccgtgacagggggaatcttcctgtttttaatgtctggcaaaggtattgggaagatgaccttgggcatgtgctgcatcataactgcctccgttctgctctggtatgctcagattcaaccccactggatcgcggccagcatcattctggagttctttcttatcgtcctgctcataccagaacctgagaaacagagaacgccccaggataatcagttgacctacgtggtgattgcaatcctgacagtcgttgctgccactatggccaacgaaatgggattcttagagaagaccaagaaagacctaggcctggggtcaattacaacccaagagccagaaagtaatatcctcgacatagatcttcgccctgcatctgcttggactctgtatgccgtggcgacaacgtttgtaacccccatgttgaggcattccatcgagaacagctcagtgaatgtcagtctgactgctattgccaaccaggcaacagtgctcatgggactgggtaagggctggccgcttagcaaaatggacatcggggttccactcctggccattggatgttactcccaggtgaatcctatcaccttgaccgctgcactgttactactggtcgcccactacgcgattatcggccccggtctccaggctaaggccacacgggaagcacaaaaacgtgccgctgccgggataatgaagaacccaactgtagatggcattacggtgatcgaccttgagcccatcccttatgatccgaagttcgaaaaacagctgggacaggttatgttgctgattctctgcgtgacccaggtcctgatgatgagaacaacttgggcactttgtgaggctttaaccctggccacaggccccatatctaccctctgggaggggaatccaggaaggttttggaacactacgatcgcggtgagcatggccaatattttccgcggctcctacttggccggtgctgggctgctattttcaatcatgaagaacacaaccaatactcggcgaggaaccggcaacattggtgaaacactgggcgagaaatggaagtctagactcaacgcccttgggaaaagtgagttccaaatctataagaaatcgggaatacaggaggtcgacaggactctggcaaaggagggcatcaagcgcggggaaaccgatcatcacgctgtgagccggggatccgccaaattgagatggtttgttgagcgtaatatggtgacacctgaaggcaaggtagtggacctgggttgcgggaggggaggctggtcttactattgtggtggcctcaaaaacgtccgggaggttaaggggctgacgaaaggaggccccgggcatgaagaacctattccaatgtcaacctacggatggaatttagtgcgccttcagagcggcgtcgatgtgttcttcactccccctgagaagtgcgacacactgctctgtgatatcggtgaatccagtccaaaccccaccattgaggccgggcgaactctaagagtactgaatttggtggaaaactggctgaataacaatacacaattttgcatcaaggttctcaacccgtatatgccttctgtgatagagaaaatggaaacccttcagaggaagtacggaggcgcgctggtccggaatccattgagccgcaactcaacgcacgagatgtactgggtgtccaatgctaccggcaacattgtcagtagcgtgaatatgatctctagaatgctgatcaacaggttcacaatgaaacacaagaaagcaacttatgagcccgacgttgatctcgggtccggaacccgaaacattggtatagaatcagagatccctaatttagacattatcggcaagcggattgaaaagatcaaacaggagcatgaaacaagctggcactacgaccaggatcatccatataagacttgggcctaccacgggtcgtatgagaccaaacaaacaggatctgctagttccatggtaaacggcgtggtccgtctgcttaccaagccctgggacgtggttccgatggtgactcagatggccatgacggatacaaccccttttggtcagcagagagtcttcaaagagaaggtggacactcgcacccaagaacccaaggaggggacgaaaaagctgatgaggataacagcagaatggctatggaaagagctcggaaagaaaaagaccccacggatgtgtactagagaggaatttacacgcaaagtaaggagcaatgccgctctgggcgcgatcttcaccgatgagaacaagtggaagtcagcccgagaagcagtggaggacggccggttttgggaattggttgatagagagaggaatctgcacctcgaggggaaatgcgaaacttgtgtctacaacatgatgggaaagcgcgagaagaaacttggtgagttcggcaaagctaaagggtcccgtgccatttggtatatgtggctgggagcacggtttttagagttcgaagccctgggctttttgaatgaggaccattggttctctagaggtaacagcctcagtggggtggagggagaaggcctgcacaggctaggctacatccttcgcgatgtggggaagaaagagggaggtgctatgtacgccgacgatacagcgggctgggacacccgaattacactggaagacctcaagaatgaggaaatggtcactaaccatatgaaaggggagcacaagaaactggcagaggccatctttaagttgacctatcagaataaggttgtgcgggtacagagacctacgcccaggggaaccgtgatggatattatatcccgcagagaccagcggggcagcggtcaagtcgggacatacggactgaacactttcaccaatatggaagctcagctcatcaggcagatggagggcgaaggcattttcaaatctatccaacatcttacagtgactgaggagatcgccgttcagaactggctggcacgtgtggggcgagaacgcttatcaagaatggctattagtggagatgactgcgtcgtgaagccaatagatgaccggtttgcctccgctctgaccgccttgaatgatatgggtaaagtaaggaaggacatccagcagtgggagcccagccgcggctggaacgattggacgcaagttcctttctgctctcaccactttcatgaactcgtgatgaaagacgggagagtcctggtggtgccatgtcggaaccaggatgagctaattggaagggcacgaatctcgcagggcgcgggttggtcacttaaggaaacagcctgcctgggaaagagctatgctcagatgtggaccctcatgtacttccaccgtagagacctgcgcttggccgcaaatgctatttgttccgccgtcccgagtcattgggttcccacttctcggacaacctggagcatccacgcaaaacacgagtggatgactaccgaggatatgttagccgtgtggaacagggtatggatacaagaaaatccttggatggaggacaagacaccagtggaatcctgggaggaagtcccctatctgggaaaaagagaggaccagtggtgcggctcactcatcggccttacgagtcgcgcgacctgggctaagaacattcagactgccatcaatcaggtgcggtctctgattgggaacgaggaatacacagattatatgcctagcatgaaaaggtttcgaagagaggaagaggaagcaggagttctatggtga

SEQ ID NO: 14756 - RNA, 9876 nt, synthetic construct
  misc_feature 1..9876: note = derived and/or modified CDS sequence (opt3) from DENV-2__JN819407__SS-prME
  source 1..9876: mol_type = other RNA
accgccggcgtgatcgtcatgctgattccaactgctatggcattccacctcactacgagaaatggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccacatgtgggtatggggcttgagaccagaacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtccctaggtaatctgctctttaccggccatctgaaatgccgtcttcgcatggataagctgcaattgaaagggatgtcatacagcatgtgtacaggaaagttcaagatcgtgaaagaaatcgctgagactcagcacggcaccattgtaatcagagttcagtatgagggtgacgggagtccatgcaagattcccttcgaaataacggatctcgagaaaaggcatgtgctgggccggttaatcaccgtcaacccgattgtgatcgaaaaggactctcctgtcaacatcgaggccgaacccccatttggagattcctacattataatcggcgtggagcctgggcagctgaaactaaattggttcaagaagggaagctcgattggtcaaatgtttgagacaactatgcgaggcgctaaacgcatggccatcctcggggacaccgcatgggatttcggatctctgggcggtgtttttacatccattgggaaggcccttcaccaggtgttcggcgctatctacggagcggcattttcaggcgtaagttggactatgaaaatattgatcggggtcgtgattacctggatcggaatgaacagcagatccacgtctctgagcgtttcactcgtgctggtcggcgtggtaacactttatctgggtgccatggtgcaggctgacagtgggtgtgttgtctcctggaagaataaagaattgaagtgcggaagcggcattttcatcaccgataacgtgcacacttggacagagcagtacaagtttcaacccgaatctccatcaaaactcgccagtgcaatacagaaggcccatgaggaaggtatttgtggcatcaggagcgtgacccggctggagaatttaatgtggaaacagattactcccgagctgaaccacatcctatccgaaaatgaggtcaagctcaccataatgacaggggacacgaaaggaatcatgcaggctggcaagcgctctctgagacctcaaccaaccgaacttaaatattcgtggaagacttgggggaaggccaaaatgttgttcacagagagccataaccagacctttctgattgatggaccggaaacagcagagtgccccaatactaacagggcgtggaactccctcgaggttgaagactacggcttcggtgtgttttcaaccaacatctggctgaagttacgtgagaaacaggacgtgttctgtgatagtaagctgatgtctgctgccattaaagacaatcgggcagtacacgccgatatggggtattggatcgaaagcgctcttaacgacacgtggaagatggagaaggcctccttcatagaggtcaaatcatgccactggcctaagagccatacattgtggtctaatggagtgctcgaatccgagatgattatccccaagaattttgcaggccccgttagtcagcacaactaccgacctggttatcatacccaaactgctggcccatggcacctggggaagctagaaatggatttcgacttttgtgagggaaccacagtggtcgtgactgaagattgcggcaatagagggcccagcctgaggaccacaacggcctctggaaaactcatcaccgagtggtgctgtcgctcctgcactctgccgcctcttcggtacagaggcgaggacggttgttggtacgggatggaaattaggccattgaaggagaaggaagagaacctggttaattcattagtgacagcgggacatggccagatcgataacttcagtctcggtgtactgggcatggccctttttctggaagagatgttgcgcacccgagtcgggactaaacacgctattctcctggtggcagtgagcttcgtcacactaataaccggaaatatgtcgtttcgggacctgggccgtgttatggtgatggtaggggccacgatgactgatgacatcggaatgggcgtgacctatctcgctctgcttgccgcattcaaggtcagacccacatttgcggccggtttgctgttaaggaaactcacctccaaggagctgatgatggctactattgggatcacacttctgtctcagagcaccattcctgaaacaatcctagagctcactgatgccctggcattgggaatgatggtgctgaaaatagttcgcaacatggaaaagtaccaattagctgtgaccatcatggccatttcatgcgtccccaatgcagtgatcctccggaacgcctggaaggttagttgtacgattctggctgcggtgtccgtctctccacttctgttgacaagctcccagcagaaagccgactggatccctctcgcactgaccataaagggcctaaatcccactgctattttcctgaccacactttcaagaactagcaaaaagaggagttggccactcaacgaggccatcatggccgtaggcatggtgtctatcctggcttccagcttgctgaaaaatgacattccgatgaccgggcctttagttgcaggaggtctcctgacggtgtgctatgtccttacaggccgatcggccgatctggaattggagcgcgcggctgacgtgaagtgggaggatcaggccgaaatatcagggtctagtcccatcctctccattaccatcagcgaggacggatctatgagcattaaaaacgaagaggaggaacaaactctgacaatcctaatacggaccggcctgcttgtaatctccggtgtgtttccagtctcaattcccatcactgcagccgcttggtacctctgggaggttaagaagcagagagcaggggtgctgtgggatgtgcctagtccaccccctgtcggaaaagccgaattggaggacggcgcgtataggattaagcagcgtggcatcttagggtacagccagataggagctggtgtgtataaagaaggcacattccacaccatgtggcatgttacgcgcggggccgtactgatgcaccggggaaagagaattgagccgtcttgggcagatgtgaaaaaggacctcatctcctacggcggtgggtggaagctggagggagaatggaaagagggcgaagaggtccaagtgcttgccctggaaccaggcaagaatcccagggctgttcagactaaacctgggatctttaagaccaacacaggaaccattggtgccgtgtcattggatttcagtccaggcacaagcgggtcccccatcgtcgaccgaaaaggaaaggtggtaggcctatacggtaatggggtcgtgactcggtctggagcatatgtttcggctatagcccagaccgaaaagagcattgaggataaccctgaaatcgaggacgatattttccgcaaaaagagactgacgatcatggacctccatccgggcgcgggcaaaacaaagaggtacctgcccgccatagtgcgggaagcaattaaacgagggcttagaactttaatcctggctccaacccgcgtcgtggccgctgagatggaagaggcactcaggggattgcctatccgttatcagacacccgccattaaggccgagcacaccggtcgggaaatcgttgacctgatgtgtcatgctacttttaccatgagactcctgtcaccagtgagggtccctaactacaatcttattataatggatgaggcgcacttcacagaccccgcatccatcgccgctcgcggctatattagtacgcgagtggaaatgggggaggccgcaggaatctttatgactgccaccccaccgggctctagagatcctttcccccaaagcaacgctccaatcatggacgaggaacgggagattcccgaaaggtcctggaactcaggtcacgagtgggtaacagattttaaggggaaaaccgtgtggttcgttccttctataaaggcgggaaacgacatcgccgcatgcctgcgcaaaaatggcaagaaagtcattcagttgagccgtaagacttttgatagtgaatacgtgaagacaagagctaacgactgggatttcgtggtcaccacggacatctccgagatgggcgccaattttaaagcagagcgggtaattgatccaaggcgctgtatgaagcccgtgatcctaactgacggggaggaacgagttatactggccggacctatgccggtgacacatagctctgctgcccagagacggggtaggatcggccgcaaccccaaaaatgaaaacgaccaatatatttacatgggggagcccctcgaaaatgatgaggactgcgcgcactggaaggaggcaaaaatgttactggataacatcaatacccctgaaggaattatcccctcaatgttcgagccagaaagagagaaggtcgacgccatagatggcgaatacaggcttcggggtgaggctcgtaaaacctttgtggacctgatgcgccgaggggatctccctgtttggttggcctataaggtggctgcagagggcattaactacgccgacagaaagtggtgtttcgatggaatcaaaaataaccagattctggaagagaacgtcgaagtggagatctggactaaggagggcgaaaggaaaaagctcaaaccccggtggctggacgctcgcatatattccgatccacttgccctaaaggagttcaaggaatttgcagcggggagaaaaagtctgacattgaatttaatcaccgagatgggaaggctgcctacattcatgactcagaaggcccggaacgctctcgacaatctggccgtacttcatacggcagaagctggtggccgagcctacaaccacgcactgagcgagctcccggagaccttggaaacactgctactgctcactcttctggccaccgtgacagggggaatatttttattcttgatgtcgggcaaaggtatcgggaagatgaccctgggcatgtgctgcattatcactgcttctgttctcctgtggtatgcgcagatacaaccccactggattgccgcatccatcatccttgagtttttcctgattgtcctcttgatcccagaacctgagaaacagagaacgccccaggataatcagctgacctacgtggtgatagctattttaacagtcgttgccgccactatggcaaacgaaatgggatttctagagaagaccaagaaagacctgggcctcgggagcatcacaacccaagagccagaatcaaatattcttgacatcgatctgcgccctgctagtgcctggactttgtatgcggtggctacaacgttcgtaacccccatgctgaggcattctatagagaactccagcgtgaatgtctcactcactgccatcgcaaaccaggccacagtgctgatgggacttggtaagggctggccgctcagtaaaatggacattggggttccactgttggctatcggatgttacagccaggtgaatcctattaccctgaccgcagccttactactgctcgtcgcgcactacgctatcattggccccggtcttcaggccaaggcaacacgggaagcccaaaaacgtgctgccgcagggatcatgaagaacccaactgtagatggcataacggtgattgacctggagcccatcccttatgatccgaagtttgaaaaacagttgggacaggttatgctgctcatcctgtgcgtgacccaggtccttatgatgagaacaacttgggctttatgtgaggccctgaccctcgcgacaggccccatttccaccttgtgggaggggaatccaggaaggttctggaacactacgatagccgtgtctatggcaaatatctttcgcggcagctacctggctggtgccgggctactgttctccattatgaagaacacaaccaatactcggcgaggaaccggcaacatcggtgaaacactcggcgagaaatggaagtcaagacttaacgcactggggaaatctgaatttcaaatttataagaaaagtggaatccaggaggtcgacaggactttggctaaggagggcataaagcgcggggaaaccgatcatcacgccgtgtcgcggggaagcgccaaactgagatggttcgttgagcgtaatatggtgacacctgaaggcaaggtagtggacctcggttgcgggaggggaggctggtcctactattgtggtggcctgaaaaacgtccgggaggttaaggggttaacgaaaggaggccccgggcatgaggaacctatcccaatgtctacctacggatggaatcttgtgcgcctgcagtcaggcgtcgatgtgttctttactccccctgagaagtgcgacacactcctatgtgatattggtgaaagctccccaaaccccaccatcgaggcggggcgaactctgagagtattgaatctggtggaaaactggctcaataacaatacacaattctgcattaaggttcttaacccgtatatgcctagtgtgatcgagaaaatggaaaccctgcagaggaagtacggaggcgctttggtccggaatccactgtctcgcaacagcacgcacgagatgtactgggtgtcaaatgcaaccggcaacatagtctccagtgtgaatatgattagcagaatgctcatcaacaggtttacaatgaaacacaagaaagccacttatgagcccgacgttgatttagggtctggaacccgaaacatcggtattgaatccgagatacctaatctggacatcattggcaagcggatcgaaaagattaaacaggagcatgaaacatcatggcactacgaccaggatcatccatataagacttgggcttaccacgggagctatgagaccaaacaaacaggatcggcctctagtatggtaaacggcgtggtccgtcttctgaccaagccctgggacgtggttccgatggtgactcagatggcaatgacggatacaacccctttcggtcagcagagagtctttaaagagaaggtggacactcgcacccaagaacccaaggaggggacgaaaaagctaatgaggatcacagccgaatggctctggaaagagctgggaaagaaaaagaccccacggatgtgtactagagaggagttcacacgcaaagtaaggtccaatgctgcgttgggcgccatatttaccgatgagaacaagtggaaaagcgcacgagaagctgtggaggacggccggttctgggaactggttgatagagagaggaatctccaccttgaggggaaatgcgaaacttgtgtctacaacatgatgggaaagcgcgagaaaaagctgggtgaatttggcaaagccaaggggtcacgtgcaatctggtatatgtggttaggagcccggttcctggagtttgaggctttgggcttcctcaatgaggaccattggttttccagaggtaactctctgagcggggtggagggagaaggcctacacaggcttggctacattctgcgcgatgtggggaagaaagagggaggtgccatgtacgcggacgatacagcaggctgggacacccgaatcacactcgaagacctgaagaatgaggaaatggtcactaaccatatgaaaggggagcacaagaaattggccgaggctattttcaagctgacctatcagaataaggttgtgcgggtacagagacctacgcccaggggaaccgtgatggatatcattagtcgcagagaccagcggggctccggtcaagtcgggacatacggactcaacactttcaccaatatggaagcccagcttataaggcagatggagggcgaaggcatctttaaaagcattcaacatctgacagtgactgaggagatcgcagttcagaactggttagctcgtgtggggcgagaacgcctgtctagaatggccatctcaggagatgactgcgtcgtgaagccaattgatgaccggttcgctagtgccttgaccgcactcaatgatatgggtaaagtaaggaaggacatacagcagtgggagccctcccgcggctggaacgattggacgcaagttcctttttgcagccaccacttccatgaactggtgatgaaagacgggagagtcctagtggtgccatgtcggaaccaggatgagcttatcggaagggcgcgaatttctcagggcgccggttggtcgctgaaggaaacagcttgcctcgggaagtcatatgcccagatgtggaccctgatgtactttcaccgtagagacttgcgcttagcagctaatgccatctgtagcgcagtcccgtcccattgggttcccacaagtcggacaacctggtctattcacgccaaacacgagtggatgactaccgaggatatgctggcggtgtggaacagggtatggatccaagaaaatccttggatggaggacaagacaccagtggaaagctgggaggaagtcccctatctcggaaaaagagaggaccagtggtgcggctcccttataggcctgacgtcacgcgctacctgggccaagaacatccagactgcaattaatcaggtgcggagtctaatcgggaacgaggaatacacagattatatgccttctatgaaaaggttccgaagagaggaagaggaagccggagttctgtggtga

SEQ ID NO: 14757 - RNA, 9876 nt, synthetic construct
  misc_feature 1..9876: note = derived and/or modified CDS sequence (opt3) from DENV-2__FJ898465__SS-prME
  source 1..9876: mol_type = other RNA
accgcaggcgtgatcattatgctgatacccaccgctatggcattccacctcactacgcgaaacggggaacctcatatgatcgtcggaaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagttgcgctggtgccccatgtcggtatggggcttgagaccaggacagaaacttggatgagtagcgagggagcttggaaacacgtgcagaggatcgagacctggatactgcggcatcctggcttcgccatcatggcagccattttggcttacacaatcggcaccacgcactttcagaaggcactcattttcatcctgctgactgccgttgctccatccatgacaatgcgctgcatagggatttctaaccgagattttgtggaaggagtctcgggtggctcatgggtggacatcgtactcgagcacgggagctgtgttaccactatggccaagaataaacccacattagatttcgaactgattaagaccgaggcgaaacagcctgcaacgcttaggaagtattgcatcgaagccaaattgaccaacacaactaccgagagtcggtgtccaacacaaggagagccctccctgaatgaagaacaggacaagcgctttatctgcaagcattctatggtggatcgaggctggggtaacgggtgtggactattcggcaaaggcgggattgtcacttgcgctatgtttacctgcaagaaaaatatggaaggaaaggtggtgctccctgagaacctggaatacacaatagtcatcaccccacacagcggtgaggagcatgccgttggcaatgacactgggaaacacggaaaggaaattaaaatcacgccgcagtcctcaataacagaggcagaacttaccggctatggtactgtgaccatggagtgtagtcccagaacagggctggatttcaacgaaatggtattgctccagatggaggagaaggcttggctggtgcacaggcaatggtttttagacctgcctctcccatggcttcccggcgccgatacccagggaagcaattggattcagaaggaaactctggtcacattcaaaaaccctcatgcgaagaaacaggacgtggttgtgttgggctctcaagagggggccatgcacacggcactaaccggagctactgaaatccagatgtcctcaggtaatctgctctttacaggccatctgaagtgccggcttcgtatggacaaactgcagttgaaggggatgagctacagtatgtgtaccggaaagttcaaaatcgtcaaggagattgccgagacacaacacggcactatcgtgattcgcgtacagtatgaaggtgatgggtctccatgcaaaatacccttcgagatcatggacctcgaaaagagacatgttctgggcaggttaattaccgtgaacccgatcgtcacggagaaagattcccctgtgaacatcgaagctgagcccccatttggagacagctacattataatcggcgtcgagcctgggcagctgaagctaaattggttcaagaaaggatcgtctattggtcagatgtttgaaaccacaatgcggggcgccaagcgaatggcaatcctcggggatactgcctgggacttcggatccctgggcggtgtgtttacctcaattgggaaagcacttcaccaagttttcggcgcgatctacggagcagcctttagtggcgtgagctggacaatgaagatattgatcggggtaattatcacttggattggaatgaactcccgctctaccagcctgtcagtcagtctcgtgctggttggcgtggtcacgctttatctgggtgctatggtgcaggccgattccgggtgtgtagtgagctggaaaaataaggagttgaagtgcggatctggcatcttcataacagacaacgttcacacctggactgaacagtacaaatttcagcccgagtcaccaagtaagctcgcaagcgccattcaaaaagctcatgaagagggtatctgtggcattagatccgtcacaaggctggagaatttaatgtggaagcagatcacccccgaactgaaccacatactatctgagaatgaagtgaaactcactatcatgaccggggatattaagggaatcatgcaggccggcaaacggtcgctgcgccctcagccaacagagcttaagtatagctggaagacgtgggggaaagcaaagatgttgtccaccgaatcacataaccaaactttcctgattgacggaccggagacagcggagtgccccaataccaacagagcttggaatagtctcgaagtggaggattacggctttggtgtcttctctacaaacatctggctgaaattaagggaaaagcaggacgtattttgtgacagcaaactgatgtccgccgcaataaaggataatcgtgccgtgcacgctgacatggggtattggattgagtcagcccttaacgatacttggaagatggagaaagcatcattcatcgaagtgaagtcttgccactggcctaaatcccataccttgtggagtaatggagtactcgagagcgaaatgatcattccaaagaacttcgctggccccgtctctcagcacaactaccggcctggttatcatacgcagacagccggcccatggcacctggggaaactagagatggactttgatttctgtgaaggaaccactgtggttgtgaccgaggactgcggcaatcgagggccctccctgagaacaactaccgcgtcaggaaagctcatcacagagtggtgctgtaggagttgcacgctgccgcctcttcgctaccggggcgaagatggttgttggtacgggatggagattagaccattgaaggaaaaagaggaaaacctggtcaatagcttagtgaccgccggacatggccaaatagacaacttttcgctcggtgttctgggcatggctcttttcctggaggagatgttgaggactcgcgtggggacaaagcacgcaatgctcctggtagccgtctcctttgtgaccctaatcactggaaatatgtctttccgagatctgggccgggtgatggtcatggttggggctacaatgaccgacgatattggaatgggcgtgacgtatctcgccctgcttgcagcgtttaaagtacgtcccactttcgccgctggtttgctgttaagaaagctcaccagcaaagaactgatgatggccacaatcgggattgcacttctgtcacagagtaccatccctgagactatactagaactcacagacgctctggccttgggaatgatggtgctgaagatcgtcaggaacatggagaattaccagttagcagtgaccattatggccatctcctgcgttcccaacgctgtgattctcctgaatgcgtggaaggtctcttgtacaatccttgccgcagtgagcgtttccccactgttgctcacttcaagccaacagaaagctgattggatacctctggccctaaccattaagggcctgaaccccacggccatctttcttacaaccctcagtcgcacttctaaaaagcggtcctggccactgaatgaagctgtgatggcagtcggcatggtaagcatcttggcctcgtcactgctaaagaacgacattccgatgaccgggcctctcgtggcgggaggtctgcttacagtttgctatgtgctgactggcagatctgctgacttggagctcgagagggccgcagatgtcaagtgggaagaccacgccgagataagtgggtccagccccatcctgtctattaccatcagcgaagatggatccatgtcaattaaaaatgaggaggaagaacagacgctaacaatcctgatacgaaccggccttctcgtgatcagtggtgtattcccagtgagcattcccatcactgctgcagcctggtacctgtgggaagtcaagaagcagcgcgcgggggttttgtgggacgtgccttctccaccccctgtgggaaaagctgagttagaagatggcgcctatcggattaagcaaagaggcatcctggggtactcccagataggagctggtgtatataaagagggcacatttcataccatgtggcacgtgactagaggggcagttctcatgcatcgtggaaagcgcattgagccgtcatgggctgacgtcaagaaggatctgatcagttacggcggtgggtggaaacttgaaggagagtggaaagaaggcgaggaagtgcaggtcctggccttggagccaggcaagaacccccgggcagtgcagacaaaacctgggctattcaagaccaatacgggaactatcggtgctgttagcctggacttttccccaggcacctctgggtcgcccattgtggatagaaaaggaaaggtcgtgggcctctacggtaacggggtagtcacaaggagcggagcctatgtgtcagcgatcgcccaaaccgagaagtccatagaagacaaccctgagattgaagatgacatcttcagaaagaagcggctgacaattatggatcttcacccgggcgcaggcaaaactaagcgctacttacccgctatcgttagagaggccataaaaagggggctgcggaccctcattttggctccaacgcgagtggtcgcagccgaaatggaggaggccctgagaggactccctatccgctatcagacacccgctatcagggcggaacatactggtcgtgagattgtggacctgatgtgtcacgcaaccttcacaatgcggcttctgagtccagttagagtgcctaattacaacttgatcattatggacgaagcccactttaccgatcccgcttctatagccgcaaggggctatatcagcactcgcgtcgagatgggggaggccgctggaattttcatgaccgcgacaccaccgggctcccgagacccttttccccagtcaaatgccccaatcatggatgaagagagagaaatccccgagcggtcttggaacagcggtcatgaatgggtgacggacttcaaggggaagactgtatggtttgtgcctagtattaaagcaggaaatgatatagctgcctgcctaaggaagaacggcaaaaaggttatccagctgtcccgcaaaaccttcgacagcgagtacgtcaagacacgtgcaaatgattgggactttgtggtgaccactgatatttctgagatgggcgccaacttcagagctgaacgggtcatcgacccaaggcgctgtatgaagcccgtaattctcacagatggggaggaacgagtgatcttagccggacctatgccggttacccactcatccgcggcacaaagacggggtaggataggccgcaatcccaaaaacgagaatgaccagtatatctacatgggggaaccactggagaacgacgaggattgcgcccattggaaggaagctaaaatgcttctggacaatattaacacgcctgagggaatcattcccagtatgtttgaaccagagagagaaaaggtggatgccatcgacggcgagtacaggctccggggtgaggctcgtaaaactttcgtcgatttgatgcgccgaggggacctgcctgtgtggctcgcatatagagttgccgctgaaggcataaattacgccgataggcggtggtgttttgacggaattaagaacaaccagatcctggaggaaaatgtggaggtcgagatttggacaaaagaaggcgagcgcaagaaacttaaacccagatggctagatgcaaggatctatagcgacccactggcgttgaaggagttcaaagagttcgccgctgggcggaagtcgttaaccctgaacctcataaccgaaatgggacgactgcctacttttatgacacaaaaagccagagatgcacttgacaatctggctgtgctccacaccgccgaggccggtggccgcgcctacaaccacgctttgtctgagctgccggaaacactagagactctgctccttctgacgttattggcgaccgtaacagggggaatcttcctgtttctcatgtccggcaagggtattgggaagatgactctgggcatgtgctgcatcattaccgccagcatccttctgtggtatgcacagatacagccccattggattgctgcctcaatcatcctcgagttctttttgattgtgctgttaatcccagagcctgaaaaacagaggacaccccaagataatcagctaacctacgttgtcatagccattctgactgtggtggcagctacgatggccaacgagatgggattcctcgagaagaccaaaaaggaccttggcctggggagtatcacaactcaggaatctgagtccaatattttggacatcgatctgcggccagcgagcgcttggaccctctatgccgtcgcaacaacctttgttactcctatgctgcgtcactcaatagaaaacagtagcgtgaatgtatcccttacagccatcgctaaccaggcaacggtgctcatgggactgggtaaaggctggcccttgtctaagatggacattggggtcccgctgttagccatcggatgttacagccaagtgaatccaattaccctaactgcggctctgctccttctggttgcccattacgcaatcattggccctggtttgcaggccaaggctacaagagaggcccagaaaagggcagctgccgggatcatgaagaaccccaccgtggatggcataaccgtcattgacctggaaccaatcccctatgatcctaaattcgagaagcagctcggacaagtaatgctgcttatcttatgcgtgacacaggttctgatgatgcgcactacgtgggcgctctgtgaggccttgaccctggcaacaggcccgatttccactctatgggaagggaatcccggacggttttggaacaccacaatagctgtgtcaatggccaatatcttccgaggctcttacctggccggtgctgggctcctttttagtattatgaaaaacaccactaatacgagaaggggaacaggcaacatcggtgagaccctgggcgaaaagtggaagtcgcgcttgaacgccctggggaaaagcgagttccagatttataagaaatccggaatccaggaggtcgaccggactctcgccaaggaaggcataaaaagaggggagaccgatcaccatgcggtgtctcgtggatcagctaagctgaggtggtttgtcgaacggaatatggtgacaccagagggcaaagttgtggacttaggttgcgggcgcggaggctggagctactattgtggtggccttaagaacgtacgagaagtgaaggggctgactaaaggaggccctgggcacgaggagcccatccctatgtccacctacggatggaatctcgtcagactacaaagtggcgttgatgtgttcttcacaccacccgaaaagtgcgacacgctgttgtgtgatattggtgagtctagccctaacccaaccatcgaagcagggaggactctgcgggtcctcaatcttgtggagaactggctgaataacaatacacagttttgcattaaagtattgaacccctatatgccgtcagtgatcgaaaagatggagaccctgcagcgcaaatacggaggcgccctcgttagaaatcctttatccaggaacagtactcacgagatgtactgggtgagcaatgctacaggcaacatagtctcttccgtgaatatgatttcacgaatgctgatcaaccggttcaccatgaagcataagaaagccacgtatgaaccagacgtcgatcttgggagcggaacccgtaacatcggtattgagtcggaaatacccaatctggacatcattggcaagagaatcgagaaaattaagcaagaacacgagacatcttggcattacgaccaggatcacccttataaaacttgggcataccacgggagttatgagaccaagcagacaggatccgccagctcaatggtgaacggcgttgtacgcctactcactaagccatgggacgtggtccccatggtgacccagatggctatgacagataccactccgtttggtcaacagagggttttcaaagaaaaggtggacacgcggacacaggagcctaaagaagggaccaagaaactgatgagaatcactgcggagtggttgtggaaggagctgggaaagaaaaagacaccccgcatgtgtacaagggaagagtttacgcgaaaagtccggtccaatgccgcactcggcgctatattcaccgatgaaaacaagtggaaatctgccagagaggcagtggaagacagcaggttttgggagcttgtagatcgcgagcgtaatctgcatttagaaggcaagtgcgagacttgtgtgtacaacatgatggggaaacgggaaaagaagctgggagagttcggtaaagccaagggcagtagagctatctggtatatgtggttgggggccaggtttctcgagttcgaggcgctgggatttctaaatgaggaccactggttctcccgcggcaacagcctttctggtgttgaaggggagggactgcatcgactcggctacattctgcgggatgtcagcaaaaaggaaggcggggcaatgtacgccgacgatacagctggatgggacaccagaatcactttggaggacctgaaaaatgaagagatggtgacaaaccacatgaagggtgagcataagaaactcgccgaagcaatttttaaacttacctatcagaataaagtggtcagggttcaacgcccaacacctagaggcactgtgatggatatcattagtcggagggaccagcgtgggtccggacaggtaggcacctacggtctgaacacgttcaccaatatggaggctcagttaatacgacaaatggaaggggagggaatcttcaagagcattcagcacctgacagtgactgaggaaatcgccgtccagaactggttggctcgcgtgggcagagagcggctctctaggatggccatctcgggcgatgactgcgttgtgaaacccctggatgaccgctttgcatcagcgctaaccgcccttaatgatatggggaaggtcagaaaggacattcaacagtgggaaccaagccggggatggaacgattggacacaggtgcccttctgctcccaccattttcacgagctggtaatgaaagacggtagggttctcgtggtcccttgtcgaaaccaggatgaactgataggccgtgctagaatcagtcaaggggccggatggtctttgaaggagactgcatgcttaggcaaaagctatgctcagatgtggaccctgatgtacttccatcgccgggacctcaggcttgccgcaaatgccatttgttccgcggtgccatcacactgggtgccgacgagtagaacaacctggtctatccacgctaagcatgagtggatgactacagaagatatgctggccgtctggaaccgcgtttggattcaggagaatccctggatggaagacaaaacccctgtggagagctgggaagaggtaccatatctaggtaagcgggaggaccagtggtgcgggtccctgatcggactcacttcaagggcaacctgggccaagaacatacaaacagctatcaatcaggtgcggagcttgattggcaacgaagagtacacggattatatgccctctatgaaaagatttagaagggaagaggaagaggccggcgtcctgtggtga

SEQ ID NO: 14758 - RNA, 9876 nt, synthetic construct
  misc_feature 1..9876: note = derived and/or modified CDS sequence (opt3) from DENV-2__FJ898466__SS-prME
  source 1..9876: mol_type = other RNA
acagcaggcgtgatcgtaatgctgattcccacagctatggcattccacctcactacgcggaatggggaacctcatatgattgttggaaggcaggaaaagggtaaaagccttctgtttaagaccgaagacggcgtgaatatgtgcacattgatggccatcgatttaggggaactgtgtgaggacactattacctacaaatgcccactactccggcaaaacgaaccggaggatatcgactgttggtgcaattccacatctacctgggtgacttatggaacatgtaccacgactggcgagcaccgccgagaaaagcgttcagtggcgctggtcccccatgtgggtatggggcttgagaccaggacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctaccagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagagggcccatgaggaaggtatttgtggcatccggtccgtgactcgcctcgagaatctgatgtggaagcagattacccccgagttaaaccacatcctgtctgaaaatgaggtgaaactaacaataatgacgggggacaccaagggaatcatgcaggctggcaaaagatcgctcaggcctcaaccaactgaactgaagtatagctggaaaacatgggggaaggccaagatgctttccaccgagtcacataaccagacattcttgattgatggaccggaaactgcagagtgccccaataccaaccgtgcgtggaatagtctggaggtcgaagactacggctttggtgttttcacgacaaacatctggctcaaactgcgggagaagcaggacatattttgtgattctaaattaatgagcgctgccatcaaggacaatcgagcagtgcacgccgatatggggtattggatagaatccgctctgaacgacacctggaaaatggagaaggcctcattcattgaggtaaagagctgccactggcctaaatctcatactctttggtccaatggagtattggaaagtgagatgatcatcccaaagaacttcgcaggccccgtcagccagcacaactacagacctggttatcatacccaaacagctggcccatggcacctcgggaaactggaaatggattttgacttctgtgagggaactaccgtggttgtgacagaagattgcggcaatagggggccctctctacgcacgaccactgcctccggaaagctgattacagagtggtgctgtcggtcatgcaccctcccgcctctgagatacaggggcgaggacggttgttggtacgggatggaaatccgcccacttaaagagaaggaagagaacttggtcaatagtctggtgactgcgggacatggccagattgataactttagcttaggtgttctcggcatggccctgttccttgaagagatgctgcgaacacgggtggggaccaagcacgctatattgctcgtagcagtctcgtttgtgacgctgatcactggaaatatgtccttccgtgacctaggcagagtgatggtcatggttggggccaccatgacagatgacattggaatgggcgtgacctatctggctctcctggccgcatttaaagtaaggcccactttcgcggccggtcttttgctgcgcaagttaacatctaaagagctcatgatggctaccatcgggattgccctgcttagccagtcaacaatccctgaaactatactggagctaaccgatgcactcgctctgggaatgatggccttgaagatcgtgcggaacatggaaaaataccaactggcagtcacgattatggccatcagttgcgtgcccaatgctgttattttacagaacgcgtggaaggtgtcctgtacaatcctcgccgcagtctctgtgagcccactgcttctgacctcctcacagcagaaggctgactggatacctttggccctcactattaaaggcctgaatcccaccgccatctttctaacaactctgagcagaaccagtaagaaaaggtcttggccacttaacgaggctatcatggcagttggcatggtgtccattctcgccagctcgctgttgaagaatgacataccgatgacggggcctctggtcgcgggaggtttactcacagtatgctatgtgctgaccggccgatcagctgatcttgaactggagcgcgccgcagacgttaaatgggaggatcaagccgaaatctctgggagttcccccattttgagcatcactatttctgaggacggaagcatgtccatcaagaacgaagaggaggaacagacactcaccatactgatccggactggcctactggtgatttcaggtgtcttcccagtgagtatccccattacagctgcagcctggtacctttgggaggtcaagaagcagagagcgggggtgctctgggatgtccctagcccaccccctgttggaaaggctgaactggaggacggcgcctataggatcaaacagcgtggcatattggggtactctcaaattggagcaggagtgtataaggaaggcacctttcacacgatgtggcatgtgactcgcggggccgtcttaatgcaccggggaaaaagaatcgagccgtcctgggctgatgtgaagaaagacctgatctcatacggcggtgggtggaagctcgagggagaatggaaggagggcgaagaggttcaggtactggcccttgaaccaggcaaaaatcccagggcagtgcagaccaagcctgggattttccgaacaaacaccggaacaatcggtgctgtcagtctggattttagcccaggcacttccgggtctcccatagtggaccggaaaggaaaggttgtgggcttgtacggtaatggggtcgtgacccgctcgggagcctatgtaagcgcgattgcccagacggagaaatcaatcgaggataaccctgaaattgaggacgatatcttcagaaagaagaggctaacaataatggacctgcatccgggcgcaggcaaaactaagcggtacctccccgctattgtccgagaagccatcaaaagagggctgcgcacccttatcttagctccaacaagggtggttgcagccgagatggaagaggccctgcgtggactccctattcggtatcaaacccccgctatcaaggcggagcacactggtagagaaattgtggacttgatgtgtcatgcaaccttcacaatgaggctgctctccccagtccgcgtgcctaactacaatctgataatcatggatgaggcccactttacggaccccgctagtattgccgcacgaggctatatctctactagagttgaaatgggggaggccgctggaatcttcatgaccgcgacaccaccgggcagccgggatccttttccccagtccaacgccccaattatggacgaggaaagggagatacccgaacgctcatggaactctggtcacgagtgggtgaccgatttcaaagggaagactgtctggtttgtgcctagcatcaaggcaggaaacgacattgctgcctgccttcgtaaaaatggcaagaaagtaatccagctgagtagaaagacattcgattccgaatacgtgaaaacccgggcaaacgactgggattttgttgtcacgactgacattagcgagatgggcgccaatttcaaggctgagagggtgatcgatccacgccgatgtatgaagcccgtgatattgacagacggggaagagagagtcatcctagccggacctatgccggtaacccattcttcagcggcacaacggaggggtcgcattggcagaaaccccaaaaatgaaaacgaccagtatatctacatgggggagcccctggaaaatgatgaggactgcgcccactggaaggaggctaaaatgctcttagataacattaatacccctgaaggaatcataccctccatgtttgagccagaaagggagaaggtggacgccattgatggcgaataccggctgcgtggtgaggctcgcaaaactttcgttgaccttatgcgaagaggggatctgcctgtgtggctcgcatataaggtcgccgctgagggcatcaactacgccgacaggaaatggtgttttgatggaattaagaataaccagatcttggaagagaacgtggaagttgagatatggacaaaggagggcgaacggaaaaagctgaaaccccgctggctcgacgcaagaatctatagtgatccactggcgcttaaggagttcaaagagttcgccgctgggagaaagagcctaaccctgaatttgattacagagatgggacggttacctacttttatgacgcagaaggcccgaaacgcactggacaatctcgctgtgctgcataccgccgaagccggtggtagagcatacaaccacgctctttcggagctgccggagacactcgaaactttgctgctactgaccctccttgcgacagtcaccgggggaatcttcctgtttttaatgtctggcaaaggtattgggaagatgactttgggcatgtgctgcatcataacggcctccattctgctctggtatgcacaaatccagccccactggatcgctgccagcattatcctggagttctttcttatagtgctgctcattccagaacctgagaaacagcgcacaccacaggataatcaattgacatacgtagtgatcgccattctgactgttgtcgcagctaccatggccaacgaaatgggattcttagagaagaccaaaaaggacctaggcctggggtcaatcaccactcaggagagtgaatctaatatactcgacatcgatcttaggccagcgtccgcttggacactgtatgccgtggcaacgacctttattactcctatgttgcggcatagcatcgagaactcaagtgtgaatgtcagcctgacagccattgctaaccaggcaaccgttctcatgggactgggtaagggctggcccctttccaaaatggacatcggggtgccgctcctggccattggatgttactctcaggtaaatccaatcaccttgacagcggctctgttactactggtggcccactacgcaataattggccctggtctccaagccaaggctactcgtgaagcccagaaaagagcagctgccgggatcatgaagaaccccacggtcgatggcatcaccgtgattgaccttgagccaataccctatgatcctaaattcgaaaagcagctgggacaggttatgttgctgatcctctgcgtgacacaagtcctgatgatgaggactacctgggcgctttgtgaggccttaacactggcaaccggcccgattagcactctctgggaggggaatcccggacgcttttggaacacgacaatcgctgtatccatggccaatattttccggggctcatacttggccggtgctgggctgctattttctatcatgaagaacaccactaatacccgaagaggaacaggcaacataggtgaaactctgggcgagaaatggaagagtaggctcaacgcccttgggaaatcggagttccagatctataagaaaagcggcattcaggaggtggaccgcaccctggccaaggagggcatcaaaagaggggaaacagatcatcacgcggtttccagaggatctgctaagttgcgttggtttgtggagaggaatatggtcacgccagaaggcaaggtggtcgacctgggttgcgggcggggaggctggtcatactattgtggtggcctcaaaaacgtgcgcgaggttaaggggctgaccaaaggaggccctgggcatgaagaacccattcctatgagcacttacggatggaatttagtgcgacttcaatccggcgtagatgtgttcttcacaccacccgagaagtgcgacaccctgctctgtgatatcggtgaaagttctcctaacccaactatagaggcagggagaacactaagggtcctgaatttggttgaaaactggctgaataacaatacccagttttgcattaaagtgctcaacccctatatgccgagcgtcatcgagaagatggaaacgcttcagcggaagtacggaggcgccctggtgcgcaatcctttgtcaagaaactccacccacgagatgtactgggtaagtaatgctacaggcaacatcgtgagctctgttaatatgatttccaggatgctgataaaccgattcactatgaaacacaagaaagccacctatgagccagacgtggatctcgggtcaggaacacggaacatcggtattgaaagcgagatccccaatttagacattatcggcaagcgtatagagaaaatcaagcaggagcatgaaacttcgtggcactacgaccaagatcatccttataagacctgggcataccacgggtcttatgagacaaaacagaccggaagtgcctccagcatggtcaacggcgtggtcagactgcttactaagccatgggacgtggttcccatggtaacgcagatggctatgacagataccactccgtttggtcagcaacgcgtgttcaaagagaaggtcgacaccaggacacaggaacctaaagaggggacgaagaagctgatgaaaattaccgcggaatggctatggaaggagctcggaaaacggaagactcccagaatgtgtacacgcgaggaatttaccaaaaaggtgaggtcaaatgccgcactgggcgctatcttcactgatgagaacaaatggaagtccgcccgagaagcagttgaggacggccggttttgggaattggtggatagagagaggaatctgcacctcgaggggaagtgcgaaacatgtgtctacaacatgatgggaaaacgcgagaagaaacttggtgagttcggcaaggccaaagggtctcgtgctatttggtatatgtggctgggagcccggtttttagagttcgaagcgctgggctttttgaatgaggaccattggttcagcagaggtaacagtctctccggggtggagggagaaggcctgcacaggctaggctacatccttcgcgatgtagggaagaaggagggaggtgcaatgtacgccgacgataccgctggctgggacacacgaattactctggaagacctcaaaaatgaggaaatggtgaccaaccatatgaagggggagcacaaaaagctggccgaggcaatatttaaattgacgtatcagaataaggttgtccgggtgcagagaccaacccctaggggaacagtgatggatatcattagccgcagagaccaacggggctctggtcaggtcgggacttacggactgaacaccttcacaaatatggaagctcagctcatcaggcaaatggagggcgaaggcatcttcaagtcaattcagcatcttactgccaccgaggagatagctgttcagaactggctggcccgtgtggggcgagaacgcttaagtagaatggcaatctccggagatgactgcgtagtgaaacccattgatgaccggtttgcgagcgccctgacggctttgaatgatatgggtaaggtcaggaaagacatccagcaatgggagccatctcgcggctggaacgattggacacaggtgcccttctgctcgcaccactttcatgaactcgttatgaaggacgggagagtgctggtcgtgccttgtcggtcacaggatgagctaattggaagggcccgaatcagccagggcgcaggttggtcccttaaagaaaccgcttgcctggggaagagttatgcccaaatgtggactctcatgtacttccaccgtagagacctgcgcttggcagccaacgcgatatgttctgctgtaccaagccattgggttccgacatcccggaccacttggtcaatccacgccaagcacgagtggatgaccacagaggatatgttagcagtgtggaatagggtctggattcaggaaaacccctggatggaggacaaaacgcctgtggaaagttgggaggaagtgccatatctgggaaagagagaggaccagtggtgcggctctctcatcggccttaccagccgcgccacttgggctaaaaatattcagacagccatcaaccaagtccggtccctgatagggaatgaggaatacaccgattatatgccctcaatgaagaggtttcgaagagaggaagaggaagcaggagttctatggtga

SEQ ID NO: 14759 - RNA, 9876 nt, synthetic construct
  misc_feature 1..9876: note = derived and/or modified CDS sequence (opt3) from DENV-2__FJ898467__SS-prME
  source 1..9876: mol_type = other RNA
accgccggagtgataattatgctgatacccacagctatggcattccacctcactacgagaaacggggaacctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagttgcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttatctgcaagcattctatggtggatagaggctggggtaacgggtgtggactattcggcaagggcgggattgtcacatgcgccatgtttacatgcaaaaagaatatggaaggaaaagtggtgcagcctgagaacctcgaatacaccatagtcatcactccacacagcggtgaggagcatgctgttggcaatgacacggggaagcacggaaaagaaattaagatcacaccgcagtcctcaataaccgaggccgaactgactggctatggtaccgtgacaatggagtgtagtcccaggaccgggcttgatttcaacgaaatggtactgttgcaaatggaggacaaagcatggctcgtgcaccggcagtggtttctggatttacctctgccatggctccccggcgctgacactcagggaagcaattggattcagaaggagacacttgtcacgttcaagaaccctcatgccaaaaagcaagacgtggttgtgctgggctctcaggaaggggcgatgcacaccgccttgactggagcaacagagatccagatgtcctcaggtaatctactgtttaccggccatctcaaatgccgtctgcgcatggataaacttcaactgaaagggatgagctacagtatgtgtacaggaaagttcaagatcgtcaaagaaattgctgagactcagcacggcaccatcgtgattagaatacagtatgagggtgacgggtctccatgcaagatccccttcgaaattacggatttggagaaaaggcatgtactcggccggctgatcaccgttaacccgatcgtgattgaaaaggactcccctgtcaacatagaggccgaacccccatttggagatagctacatcattatcggcgtggagcctgggcagttaaaactgaattggttcaagaagggatcgtctattggtcaaatgtttgagacaactatgcgaggcgctaaacgcatggccatcctaggggacaccgcatgggatttcggatccctcggcggtgtctttacatcaatagggaaggccctgcaccaggtgttcggcgctatctacggagcggcatttagtggcgttagctggactatgaaaattcttatcggggtggtaattacctggatcggaatgaactccagatctacgagcttgtcagtcagtctggtgctcgttggcgtggtcacactgtatcttggtgccatggtgcaggctgactccgggtgtgtagtgagctggaagaataaagaactgaagtgcggatctggcatattcattaccgataacgttcacacttggacagagcagtacaagtttcaacccgaatcaccaagtaaattggccagcgcaatccagaaggcccatgaggaaggtatttgtggcatcaggtccgtcacccggctcgagaatctgatgtggaaacagataactcccgagttaaaccacatcctgtctgaaaatgaggtgaagctaaccattatgacaggggacacgaaaggaatcatgcaggctggcaagcgctcgctcagacctcaaccaaccgaactgaaatatagctggaagacttgggggaaggccaaaatgctttccacagagtcacataaccagaccttcttgattgatggaccggaaacagcagagtgccccaatactaacagggcgtggaatagtctggaggtggaagactacggctttggtgtcttcaccacgaacatctggctcaagctgcgtgagaaacaggacgtattttgtgattctaagttaatgagcgctgccataaaagacaatcgggcagtgcacgccgatatggggtattggattgaatccgctctgaacgacacatggaagatggagaaggcctcattcatcgaggtgaaaagctgccactggcctaagtctcataccctttggtccaatggagtattggaaagtgagatgatcattcccaagaatttcgcaggccccgtcagccagcacaactaccgacctggttatcatactcaaaccgctggcccatggcacctcgggaagctggaaatggattttgacttctgtgagggaacaactgtggttgtgaccgaagattgcggcaatagagggccctctctaaggacaacgaccgcctccggaaaactgatcactgagtggtgctgtcgctcatgcacactcccgcctctgcggtacagaggcgaggacggttgttggtacgggatggaaattaggccacttaaggagaaggaagagaacttggtcaatagtctggtgaccgcgggacatggccagatagataactttagcttaggtgttctcggcatggccctgttccttgaagagatgctgcgcactcgagtggggacaaaacacgctatcttgctcgtagcagtctcgtttgtgaccctgattacgggaaatatgtccttccgggacctaggccgtgtgatggtcatggttggggccactatgaccgatgacatcggaatgggcgtgacatatctggctctcctggccgcatttaaggtaagacccaccttcgcggccggtcttttgctgaggaaattaacttctaaggagctcatgatggctacaattgggatcaccctgcttagccagtcaacaatacctgaaactatcctggagctaaccgatgccctcgcactgggaatgatggtgttgaaaattgtccgcaacatggaaaagtaccaactggctgtgacgatcatggccattagttgcgttcccaatgcagtgatcttacggaacgcctggaaggtctcctgtacaatactcgctgcggtgtctgttagcccactgcttctgacctcctcacagcagaaagccgactggattcctttggcactcactatcaagggcctgaatcccaccgctatctttctaacaactctgagcagaaccagtaaaaagaggtcttggccacttaacgaggccattatggccgtgggcatggtctccatactcgctagctcgctgttgaaaaatgacatcccgatgacggggcctctggtagcaggaggtttactcacagtgtgctatgttctgaccggccgatcagccgatcttgaactggagcgcgcggctgacgtgaagtgggaggatcaggccgaaatttctgggagttcccccatcttgagcattactatctctgaggacggaagcatgtccatcaagaacgaagaggaggaacaaacactcaccatcctgattcggactggcctactggtcatctcaggtgtgttcccagtaagtattcccatcacagcagccgcttggtacctttgggaggtgaagaagcagagagcaggggtcctctgggatgttcctagcccaccccctgtgggaaaagccgaactggaggacggcgcgtataggataaagcagcgtggcattttggggtactctcagatcggagctggtgtgtataaagaaggcacctttcacacgatgtggcatgtcactcgcggggccgtgttaatgcaccggggaaagagaatcgagccgtcctgggcagatgttaaaaaggacctgatttcatacggcggtgggtggaagctcgagggagaatggaaagagggcgaagaggtacaagtgctggcccttgaaccaggcaagaatcccagggctgtccagaccaaacctgggatcttcaagacaaacaccggaacaataggtgccgtgagtctggattttagcccaggcacttccgggtctcccattgttgaccgaaaaggaaaggtggtcggcttgtacggtaatggggtggtaacccggtcgggagcatatgtcagcgctatcgcccagacggagaagtcaattgaggataaccctgaaatcgaggacgatatattccgcaaaaagagactaacaattatggacctgcatccgggcgcgggcaaaactaagaggtacctccccgccatcgtgcgggaagcaatcaaacgagggctgagaacccttattttagctccaacacgcgttgtggccgctgagatggaagaggcactgaggggactccctatccgttatcagacccccgccattaaggccgagcacactggtcgggaaatagtcgacttgatgtgtcatgctaccttcacaatgagactgctctccccagtgagggttcctaactacaatctgatcattatggatgaggcgcactttacggaccccgcaagtatcgccgctcgcggctatatctctactcgagtggaaatgggggaggccgcaggaattttcatgaccgccacaccaccgggcagcagagatccttttccccaatccaacgctccaataatggacgaggaacgggagatccccgaaaggtcatggaactctggtcacgagtgggtcaccgatttcaaggggaaaactgtgtggtttgtacctagcattaaggcgggaaacgacatcgccgcatgccttcgcaaaaatggcaagaaagtgattcagctgagtcgtaagacattcgattccgaatacgttaagaccagagctaacgactgggattttgtcgtgacgactgacatcagcgagatgggcgccaatttcaaagcagagcgggtgatagatccaaggcgctgtatgaagcccgtcatcttgacagacggggaagaacgagtaattctagccggacctatgccggtgacccattcttcagctgcccagagacggggtaggatcggccgcaaccccaaaaatgaaaacgaccaatatatttacatgggggagcccctggaaaatgatgaggactgcgcgcactggaaggaggcaaaaatgctcttagataacatcaatacccctgaaggaataattccctccatgtttgagccagaaagagagaaggttgacgccatcgatggcgaatacaggctgcggggtgaggctcgtaaaactttcgtggaccttatgcgccgaggggatctgcctgtctggctcgcctataaggtggctgcagagggcattaactacgccgacagaaagtggtgttttgatggaatcaaaaataaccagatattggaagagaacgttgaagtggagatctggacaaaggagggcgaaaggaaaaagctgaaaccccggtggctcgacgctcgcatttatagtgatccactggcccttaaggagttcaaggagttcgcagcggggagaaaaagcctaaccctgaatttgatcacagagatgggaaggttacctacttttatgacgcagaaggcccggaacgctctggacaatctcgccgtcctgcataccgcagaagctggtggcaaagcctacaaccacgcactttcggagctgccggagacactcgaaactttgctgctactgaccctccttgccacagtgaccgggggaattttcctgtttttaatgtctggcaagggtatcgggaaaatgactttgggcatgtgctgcataattacggcttccgtactgctctggtatgcgcagatccaaccccactggatcgccgcaagcattatcctggagttctttcttatagtgctgctcattccagaacctgagaagcagcgaaccccacaggataatcagttgacatacgttgtcatcgctattctgactgtggtggccgccaccatggcaaacgaaatgggattcttagagaagaccaaaaaggacctaggcctggggtcaatcaccactcaagagagtgaatctaatatactcgacatcgatcttagaccagcttccgcctggacactgtatgcggtcgctacgacctttgttactcctatgttgcgccatagcattgagaactcaagtgtgaatgtaagcctgacagccatcgcaaaccaggccaccgtgctcatgggactgggtaaaggctggcccctttccaagatggacattggggtcccgctcctggctatcggatgttactctcaggtgaatccaattaccttgacagcagccctgttactactggttgcgcactacgctatcataggccctggtctccaggccaaagcaactagggaagcccaaaagcgggctgccgcagggattatgaagaaccccacggtggatggcatcaccgtcatcgaccttgagccaattccctatgatcctaaattcgaaaagcagctgggacaggtaatgttgctgatactctgcgtgacacaggttctgatgatgcgtactacctgggctctttgtgaggccttaacactggcgaccggcccgatcagcactctctgggaggggaatcccggaagattttggaacacgacaattgccgtgtccatggcaaatatcttcaggggctcatacttggctggtgccgggctgctattttctattatgaaaaacaccactaatacccgccggggaacaggcaacatcggtgaaactctgggcgagaagtggaaaagtcgactcaacgcacttgggaagtcggagttccaaatatataaaaagagcggaatccaggaggtcgacagaaccctggctaaggagggcattaaaagaggggaaacagatcatcacgccgtgtcccgcggatctgccaagttgcggtggtttgtcgagagaaatatggtgacgccagaaggcaaagttgtggacctgggttgcgggcgtggaggctggtcatactattgtggtggcctcaagaacgtaagggaggtgaaagggctgaccaagggaggccctgggcatgaagaaccaatccctatgagcacttacggatggaatttagtccggcttcagtccggcgttgatgtgttcttcacaccacccgagaagtgcgacaccctgctctgtgatattggtgaaagttctcctaacccaactatcgaggcggggcgcacactacgagtcctgaatttggtggaaaactggctgaataacaatacccaattttgcataaaagtactcaacccctatatgccgagcgtgattgagaagatggaaacgcttcagagaaaatacggaggcgctctggttaggaatcctttgtcacggaactccacccacgagatgtactgggtgagtaatgcaacaggcaacatcgtcagctctgtgaatatgatctcccgcatgctgattaacagattcactatgaagcacaaaaaggccacctatgagccagacgtcgatctcgggtcaggaacaaggaacataggtatcgaaagcgagattcccaatttagacatcattggcaagcgaatcgagaaaataaagcaggagcatgaaacttcgtggcactacgaccaggatcatccttataaaacctgggcttaccacgggtcttatgagacaaagcaaaccggaagtgcctccagcatggtgaacggcgttgtacggctgcttactaaaccatgggacgtggtccccatggtgacgcagatggcaatgacagataccactccgtttggtcagcagcgtgttttcaaggagaaggtggacaccagaacacaagaacctaaagaggggacgaagaaactgatgcgcatcaccgccgaatggctatggaaggagctcggcaaaaagaaaactcccaggatgtgtacacgggaggaatttaccagaaaggtccgctcaaatgctgcgctgggcgccattttcactgatgagaacaagtggaaatccgcaagggaagctgtggaggacggccgattttgggaattggtagataaggagcggaatctgcacctcgaggggaaatgcgaaacatgtgtgtacaacatgatgggaaagagagagaagaaacttggtgagttcggcaaagccaaagggtctagggcaatctggtatatgtggctgggagcccgctttttagagttcgaagctctgggctttttgaatgaggaccattggttcagccgtggtaacagtctctccggggttgagggagaaggcctgcaccggctaggctacattcttagagatgtcgggaagaaagagggaggtgccatgtacgcggacgataccgcaggctgggacacaaggatcactctggaagacctcaagaatgaggaaatggtgaccaaccatatgaaaggggagcacaagaagctggccgaggctatttttaaattgacgtatcagaataaggtggtccgcgttcagcgaccaacccctcggggaacagtgatggatataatcagcagaagggaccagcgcggctctggtcaagtagggacttacggactgaacaccttcacaaatatggaagcccagctcattagacagatggagggcgaaggcatcttcaaatcaatccaacatcttactgcaaccgaggagattgctgtgcagaactggctggcccgggtcgggagggaacgtttaagtcgaatggctatatccggagatgactgcgtggttaagcccatcgatgaccgctttgccagcgcactgacggcgttgaatgatatgggtaaagtgagaaaggacattcagcagtgggagccatctcggggctggaacgattggacacaagtccccttctgctcgcaccactttcatgaactcgtgatgaaggacgggagggtactggttgtgccttgtcgcaaccaggatgagctaatcggaagggcccggatttcacagggcgctggttggagccttaaagaaaccgcctgcctggggaagtcctatgcacagatgtggactctcatgtacttccacaggcgagacctgcgtttggctgccaatgcaatctgtagtgccgtcccatctcattgggtgccgacaagcagaaccacttggtccatacacgcgaaacacgagtggatgaccacagaggatatgttagctgtgtggaaccgcgtctggatccaagaaaatccctggatggaggacaagacgcctgttgaatcatgggaggaagtgccatatctgggaaaacgggaggaccagtggtgcggcagtctcattggccttacctctagggccacttgggcaaagaacatccagacagccattaatcaggtaagaagcctgatcgggaacgaggaatacaccgattatatgccctccatgaagcgctttcggagggaggaagaggaagctggagtgctatggtga

SEQ ID NO: 14760 - RNA, 9876 nt, synthetic construct
  misc_feature 1..9876: note = derived and/or modified CDS sequence (opt3) from DENV-2__GQ868595__SS-prME
  source 1..9876: mol_type = other RNA
accgccggagtgatcattatgctgatacccacagctatggctttccacctcactacgagaaacggggaacctcatatgatcgtaagcaggcaggaaaagggaaaatcccttctgtttaagaccgaggacggtgttaatatgtgcacattgatggccattgatttaggcgaactgtgtgaggacactatcacctacaaatgcccattactccggcaaaacgaaccggaggatattgactgttggtgcaattctacatcaacctgggtgacttatgggacatgtaccacgactggagagcaccgccgagaaaagcgtagtgttgcgctggtgccccatgtcggcatgggtcttgagaccagaacagaaacttggatgagctccgagggggcttggaaacacgtgcagaggatcgagacctggatactgcggcatcctggattcgccatcatggcagccattttggcttacacaatcggcaccacgcactttcagcgcgcactcattttcatcctgctgactgccgttgctccatctatgacaatgagatgcataggcatttcgaacagggattttgtggaaggggtctcaggaggtagctgggtggacatcgtactcgagcacggcagttgtgttaccactatggccaagaataagcccacattagatttcgaactgattaaaaccgaggcgaagcagcctgcaacgcttcggaaatattgcatcgaagccaagttgaccaacacaactaccgagtcccgctgtccaacacaaggggagccctctctgaatgaagaacaggacaaacgatttatctgcaagcatagcatggtggatagaggatggggcaacggttgtgggctattcggaaagggcggcattgtcacttgcgctatgtttacctgcaaaaagaatatggaagggaaagtggtgctccctgagaacctggaatacacaatagtcatcaccccacactccggagaggagcatgccgttggtaatgacactggcaagcacgggaaagaaattaagatcacgccgcagtcaagtataacagaggcagaacttaccggatatggcactgtgaccatggagtgtagccccaggacaggtctggatttcaacgaaatggtattgctccagatggaggagaaggcttggctggtgcaccggcaatggtttttagacctgcctctcccatggcttcccggggccgatacccagggctctaattggattcagaaggaaactctggtcacattcaagaaccctcatgcgaaaaagcaggacgtggttgtgttgggatcccaagagggcgccatgcacacggcactaaccggggctactgaaatccagatgtcaagcggaaatctgctctttacaggtcatctgaaatgccgtcttcgcatggacaagctgcagttgaaaggcatgagttactctatgtgtaccgggaagttcaagatcgtcaaagagattgccgagacacaacacggaactatcgtgattagagtacagtatgaaggcgatggttccccatgcaagatacccttcgagatcatggacctcgagaagaggcatgttctggggcggttaattaccgtgaacccgatcgtcacggagaaggatagccctgtgaacatcgaagctgagcccccatttggcgactcgtacattataatcggagtcgagcctggccagctgaaactaaattggttcaagaaggggtcttccattggacagatgtttgaaaccacaatgcgaggtgccaaacgcatggcaatcctcggcgatactgcctgggacttcgggtcactgggaggcgtgtttaccagtattggtaaggcacttcaccaagttttcggggcgatctacggcgcagcctttagcggagtgtcctggacaatgaaaatattgatcggcgtaattatcacttggattgggatgaactctagaagcacctcactgagtgtctccctcgtgctggttggagtggtcacgctttatctgggcgctatggtgcaggccgatagcggttgtgtagtgtcttggaagaataaagagttgaagtgcgggtcaggaatcttcataacagacaacgttcacacctggactgaacagtacaagtttcagcccgagagtccaagcaaactcgcatccgccattcaaaaggctcatgaagagggcatctgtggtattaggtctgtcacacggctggagaatttaatgtggaaacagatcacccccgaactgaaccacatactatcggagaatgaagtgaagctcactatcatgaccggcgatattaaagggatcatgcaggccggaaagcgcagcctgagacctcagccaacagagcttaaatattcctggaagacgtggggcaaggcaaaaatgttgtcaaccgaaagtcataaccaaactttcctgattgacgggccggagacagcggagtgccccaataccaacagggcttggaactctctcgaagtggaggattacggatttggcgtcttcacaactaacatctggctgaagttacgtgaaaaacaggacgtattttgtgacagcaagctgatgtccgccgcaataaaagataatcgggccgtgcacgctgacatgggttattggattgagtcagcccttaacgatacctggaagatggagaaggcgtcattcatcgaagtgaaatcttgccactggcctaagtcccatacgttgtggagtaatggggtactcgagagcgaaatgatcattcccaagaatttcgctggacccgtctctcagcacaactaccgacctggctatcatacacagaccgccggtccatggcacctgggcaagctagagatggactttgatttctgtgaagggactaccgtggttgtgacagaggactgcggaaatagaggcccctccctgaggactaccacagcgtcagggaaactcatcacggagtggtgctgtcgcagttgcaccctgccgcctcttcggtacagaggagaagatggctgttggtacggtatggagattaggccattgaaggaaaaggaggaaaacctggtcaatagcttagtgactgccgggcatggacaaatagacaacttttcgctcggcgttctgggtatggctcttttcctggaggagatgttgcgcacacgagtgggcaccaaacacgcaatcctcctggtagccgtctcctttgtgactctaattacagggaatatgtctttccgggatctgggacgtgtgatggtcatggttggcgctaccatgacggacgatatcgggatgggagtgacttatctcgccctgcttgcagcgtttaaggtaagacccaccttcgccgctggcttgctgttaaggaaactcacaagcaaggaactgatgatggccaccattggtatcgcacttctgtcacagagtactatacctgagacaatcctagaactcaccgacgctctggccttggggatgatggtgctgaaaattgtccgcaacatggagaagtaccagttagcagtgacaatcatggccatttcctgcgttcccaatgctgtgatcctcctgaacgcgtggaaggtctcttgtactatacttgccgcagtgagcgtttccccactgttgctcacctcaagccaacagaaagctgattggattcctctggccctaacgatcaagggactgaatcccacagccatctttcttaccactctcagtcggacctctaaaaagagatcctggccactgaacgaagctgtgatggcagtcggcatggtaagcattttggcctcgtcactgctcaaaaatgacataccgatgacaggccctctagtggcagggggactgcttactgtttgctatgtgctgaccggtaggtctgctgacttggagctcgagcgagccgcagatgtcaagtgggaagaccaggccgagatcagtggctccagccccattctgtctatcacgattagcgaagatgggtccatgtcaatcaaaaacgaggaggaagaacagacactaaccatactgatccgcactggacttctcgtgattagtggcgtattcccagtgagcatccccattacagctgcagcctggtacctgtgggaagtcaagaagcaacgggcgggtgttttgtgggacgtgccttctccaccccctgtggggaaagctgagttagaagatggagcctatagaatcaagcagaggggcatactgggctactcccagattggggcaggagtctataaagagggtacctttcacactatgtggcatgtgacacgtggcgccgttctcatgcaccgcgggaagcggatcgagccgtcatgggctgacgtcaagaaagatctgatcagttacggaggcggttggaaacttgaaggggagtggaaagaaggagaggaagtgcaggtcctggccttggagccaggcaaaaatcccagagcagtgcaaaccaaacctggcctattcaagacgaacactgggaccattggagctgttagcctggacttttccccaggtacatctggctcgcccatcgtggataggaaagggaaggtcgtgggactctacggcaatggtgtagtcacccgaagcggggcctatgtgtcagcgatagcccagacagagaagtccattgaagacaaccctgagatcgaagatgacattttccggaaaaagcgcctgactatcatggatcttcatccgggagcaggcaaaaccaagagatacttacccgctatagttagggaggccattaaacggggcctgcgaacgctcatcttggctccaacaagagtggtcgcagccgaaatggaggaggccctgcgcgggctccctatcaggtatcagactcccgctattcgtgcggaacacaccggacgggagatcgtggacctgatgtgtcatgcaacattcaccatgagacttctgagtccagttagggtgcctaactacaatttgattataatggacgaagcccactttactgatcccgcttctatcgccgcacgcggttatattagcacccgagtcgagatgggcgaggccgctgggatcttcatgacagcgacgccaccgggatccagagacccttttccccagtcaaacgccccaatcatggatgaagaacgggaaattcccgagaggtcttggaatagcggccacgaatgggtgactgacttcaagggtaagaccgtatggtttgtgcctagtataaaagcagggaacgatatcgctgcctgcctacgcaagaatggcaaaaaggttattcaactgtcccgtaaaacattcgacagcgagtacgtcaagaccagagcaaacgattgggactttgtggtgactacagatatctctgagatgggcgccaatttccgggctgaaagggtcattgacccacgccgatgtatgaagcccgtaatcctcaccgatggcgaggaaagagtgatattagccgggcctatgccggttacgcattcatccgcggcacagcggaggggacgcatcggtagaaaccccaaaaatgagaacgaccagtatatttacatgggcgaaccactggagaatgacgaggattgcgcccactggaaggaagctaaaatgcttctggacaacatcaatactcctgaggggattatccccagtatgtttgaaccagagagggaaaaggtggatgccatagacggagagtaccggctccgtggcgaggctcgcaaaacattcgtcgatttgatgcgaagaggtgacctgcctgtgtggctcgcatatagggttgccgctgaagggattaactacgccgatcggcgctggtgttttgacggcatcaagaataaccaaattctggaggaaaacgtggaggtcgagatctggaccaaagaaggagagagaaagaaacttaaacccaggtggctagatgcacggatatatagcgacccactggcgttgaaggagttcaaagagttcgccgctggccgaaagtcgttaaccctgaatctcatcactgaaatggggagactgcctacatttatgacccagaaagcccgcgatgcacttgacaacctggctgtgctccatacagccgaggcaggaggtagggcctacaatcacgctttgtctgagctgccggaaactctagagacgctgctccttctgaccttattggcgacagtaactggcgggattttcctgtttctcatgtccggaaagggcatcggtaagatgaccctggggatgtgctgcattatcacagccagcatacttctgtggtatgcacagattcagccccactggatcgctgcctcaatcattctcgagttctttttgatcgtgctgttaataccagagcctgaaaaacaacggacaccacaggataaccagctaacttacgttgtcattgccatcctgacggtggtggcagctaccatggccaatgagatgggcttcctcgagaagaccaaaaaggaccttggactgggcagtattactacccaggaatctgagtccaacatcttggacatagatctgcgtccagcgagcgcttggacactctatgccgtcgcaaccacttttgttacacctatgctgagacattcaatcgaaaatagtagcgtgaacgtatcccttacggccattgctaatcaagcaaccgtgctcatggggctgggaaaaggttggcccttgtctaagatggacatcggcgtcccgctgttagccattgggtgttacagccaggtgaacccaatcactctaacagcggctctgctccttctggttgcccactacgcaattatcggacctggcttgcaggccaaggctaccagggaggcccagaaacgcgcagctgccggtataatgaagaatcccaccgtggatgggattacagtcatcgacctggaaccaatcccctatgatcctaaattcgagaagcaactcggccaggtaatgctgcttattttatgcgtgactcaggttctgatgatgcggacgacctgggcgctctgtgaggccttgacactggcaactggaccgatatccaccctatgggaaggcaaccccgggcgattttggaatacaaccatcgctgtgtcaatggccaacattttcagaggatcttacctggcaggcgctggtctcctttttagtatcatgaaaaatactacgaacacaaggcgcgggaccggaaatattggcgagactctgggtgaaaagtggaagtcgcggttgaacgccctgggcaaaagcgagttccagatctataagaaatccgggatacaagaggtcgacagaaccctcgccaaggaaggaatcaaacgtggcgagacagatcatcacgcggtgtctagggggtcagctaagctgcggtggtttgtcgaacgcaacatggtgactccagagggaaaagttgtggacttaggctgcggtcgagggggatggagctactattgtggcggtcttaagaatgtaagagaagtgaagggcctgaccaaagggggacctggccatgaggagcccattcctatgtccacatacgggtggaacctcgtcaggctacagagtggagttgatgtgttcttcacgccacccgaaaagtgcgacaccctgttgtgtgatatcggcgagtctagccctaatccaactattgaagcaggtcggacactgcgcgtcctcaaccttgtggagaattggctgaacaataacacccagttttgcatcaaagtattgaatccctatatgccgtcagtgatagaaaagatggagactctgcaaagaaaatacgggggagccctcgttaggaaccctttatcccgaaatagtacacacgagatgtactgggtgagcaacgctaccggcaatattgtctcttccgtgaacatgatctcacggatgctgatcaatcgtttcacgatgaagcacaagaaagccacctatgaaccagacgtcgatcttggcagcgggacaagaaacattggaatagagtcggaaatccccaacctggacattatcggtaagcgcattgagaaaatcaagcaggaacatgagacttcttggcactacgaccaggatcatccttataaaacctgggcataccacggcagttatgagacaaagcagactgggtccgccagctcaatggtgaatggagttgtaaggctactcaccaagccatgggacgtggtccccatggtgacacaaatggctatgaccgatactacgccgtttggccagcagcgggttttcaaagaaaaggtggacacaagaacccaggagcctaaagaaggtactaagaaactgatgcgcataaccgcggagtggttgtggaaggagctggggaagaaaaagacacccaggatgtgtacgcgagaagagtttacccggaaagtcagatccaacgccgcactcggagctatcttcactgatgaaaataagtggaaatctgccagggaggcagtggaagacagccgcttttgggagcttgtagatcgtgagcggaacctgcacttagaaggcaagtgcgagacatgtgtgtacaatatgatgggcaaaagagaaaagaagctgggggagttcggaaaagccaagggtagtagggctatttggtatatgtggttgggcgcccgctttctcgagttcgaggcgctggggtttctaaacgaggaccattggttctcccgaggaaatagcctttctggcgttgaaggtgaggggctgcaccggctcggatacatcctgagagatgtcagcaaaaaggaaggcggcgcaatgtacgccgacgataccgctgggtgggacactaggattacattggaggacctgaaaaacgaagagatggtgaccaatcatatgcgcggagagcacaagaagctcgccgaagcaatctttaaacttacatatcaaaacaaggtggtcagagttcagcggccaactcctaggggtaccgtgatggatattataagtcgtcgagaccagcgcggctccgggcaggtaggaacgtacggcctgaataccttcacaaacatggaggctcaattaatcagacagatggaaggtgaggggattttcaaaagcatcaagcatctgactgtgaccgaggaaatcgccgtccagaattggttggctcgggtgggaagggagcgcctctctagaatggccatttcgggcgatgactgcgttgtgaaacccctggatgaccggtttgcatcagcgctaacagcccttaacgatatgggcaaggtcaggaaggacatacaacagtgggaaccaagccgagggtggaatgattggactcaggtgcccttctgctcccaccactttcatgagctggtaatgaaagacggacgtgttctcgtggtcccttgtagaaaccaggatgaactgatcggtcgcgctcggattagtcaaggcgccgggtggtctttgaaggagaccgcatgcttaggaaaaagctatgctcagatgtggacgctgatgtacttccacaggagagacctccgccttgccgcaaacgccatctgttccgcggtgccatcacattgggtgccgacaagtcggaccacttggtctattcacgctaagcacgagtggatgacaaccgaagatatgctggccgtctggaatagggtttggatccaggagaacccctggatggaagacaaaactcctgtggagagctgggaagaggtaccatatctaggcaagcgagaggaccagtggtgcggttccctgatagggctcacctcaagagcaacatgggccaagaatatccaaacggctattaaccaggtgcggagcttgatcggaaatgaagagtacaccgattatatgccctctatgaaaaggtttcgccgtgaagaggaagaggccggcgtcctgtggtga

SEQ ID NO: 14761 - RNA, 9876 nt, synthetic construct
  misc_feature 1..9876: note = derived and/or modified CDS sequence (opt3) from DENV-2__GQ868540__SS-prME
  source 1..9876: mol_type = other RNA
accgcaggcgtgatcattatgctgatacccacagctatggcattccacctcactacgagaaacggggaacctcatatgatcgtcggaaggcaggaaaagggtaaaagccttctgtttaagaccgaggacggcgttaatatgtgcacattgatggcaattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcgccatcatggcagccattttggcttacacaatcggcaccacgcactttcagcgcgcactcattttcatcctgctgactgccgttgctccatccatgacaatgagatgcatagggatttctaacagggattttgtggaaggagtctcgggtggctcatgggtggacatcgtactcgagcacgggagctgtgttaccactatggccaagaataagcccacattagatttcgaactgattaaaaccgaggcgaagcagcctgcaacgcttcggaaatattgcatcgaagccaagttgaccaacacaactaccgagagtcgctgtccaacacaaggagagccctccctgaatgaagaacaggacaaacgatttatctgcaagcattctatggtggatagaggctggggtaacgggtgtggacttttcggcaagggcgggattgtcacttgcgctatgtttacctgcaaaaagaatatggaaggaaaagtggtgctccctgagaacctggaatacacaatagtcatcaccccacacagcggtgaggagcatgccgttggcaatgacactgggaagcacggaaaagaaattaagatcacgccgcagtcctcaataacagaggcagaacttaccggctatggtactgtgaccatggagtgtagtcccaggacagggctggatttcaacgaaatggtattgctccagatggaggagaaggcttggctggtgcaccggcaatggtttttagacctgcctctcccatggcttcccggcgccgatacccagggaagcaattggattcagaaggaaactctggtcacattcaagaaccctcatgcgaaaaagcaggacgtggttgtgttgggctctcaagagggggccatgcacacggcactaaccggagctactgaaatccagatgtcctcaggtaatctgctctttacaggccatctgaaatgccgtcttcgcatggacaagctgcagttgaaagggatgagctacagtatgtgtaccggaaagttcaagatcgtcaaagagattgccgagacacaacacggcactatcgtgattagagtacagtatgaaggtgatgggtctccatgcaagatacccttcgagatcatggacctcgagaagaggcatgttctgggccggttaattaccgtgaacccgatcgtcacggagaaggattcccctgtgaacatcgaagctgagcccccatttggagacagctacattataatcggcgtcgagcctgggcagctgaaactaaattggttcaagaagggatcgtctattggtcagatgtttgaaaccacaatgcgaggcgccaaacgcatggcaatcctcggggatactgcctgggacttcggatccctgggcggtgtgtttacctcaattgggaaggcacttcaccaagttttcggcgcgatctacggagcagcctttagtggcgtgagctggacaatgaaaatattgatcggggtaattatcacttggattggaatgaactccagatctaccagcctgtcagtcagtctcgtgctggttggcgtggtcacgctttatctgggtgctatggtgcaggccgattccgggtgtgtagtgagctggaagaataaagagttgaagtgcggatctggcatcttcataacagacaacgttcacacctggactgaacagtacaagtttcagcccgagtcaccaagtaaactcgcaagcgccattcaaaaggctcatgaagagggtatctgtggcattaggtccgtcacacggctggagaatttaatgtggaaacagatcacccccgaactgaaccacatactatctgagaatgaagtgaagctcactatcatgaccggggatattaaaggaatcatgcaggccggcaagcgctcgctgagacctcagccaacagagcttaaatatagctggaagacgtgggggaaggcaaaaatgttgtccaccgaatcacataaccaaactttcctggtggacggaccggagacagcggagtgccccaataccaacagggcttggaatagtctcgaagtcgaggattacggctttggtgttttcacaactaacatttggctgaagttacgtgaaaaacaggacgtgttttgtgactctaagctgatgagcgccgcaatcaaagataatcgggccgtgcacgctgacatggggtattggatagagtccgcccttaacgatacctggaagatggagaaggcatcattcattgaagtaaaaagctgccactggcctaagtctcatacgttgtggtccaatggagtcctcgagagtgaaatgatcatccccaagaatttcgctggccccgtgagccagcacaactaccgacctggttatcatacacagaccgccggcccatggcacctggggaagctagagatggactttgatttctgtgaaggaactaccgttgtggtcacagaggactgcggcaatagagggccctctctgaggactaccacagcgtccggaaaactcattacggagtggtgctgtcgctcatgcaccctgccgcctcttcggtacagaggcgaagatggttgttggtacgggatggagatcaggccattgaaggaaaaggaggaaaacctggtgaatagtttagttactgccggacatggccaaattgacaactttagcctcggtgtgctgggcatggctcttttcctggaggagatgttgcgcacacgagtagggaccaaacacgcaatactcctggtcgccgtgtcgtttgtgactctaatcacaggaaatatgtccttccgggatctgggccgtgtcatggttatggtgggggctaccatgacggacgatattggaatgggcgtaacttatctcgccctgcttgcagcgtttaaggtgagacccaccttcgccgctggtttgctgttaaggaaactcacatctaaggaactgatgatggccaccatcgggattgcacttctgagccagtcaactatccctgagacaatactagaactcaccgacgctctggccttgggaatgatggtcctgaaaatcgtgcgcaacatggagaagtaccagttagcagttacaattatggccatcagttgcgtgcccaatgctgtcattctcctgaacgcgtggaaggtgtcctgtactatccttgccgcagtttctgtgagcccactgttgctcacctcctcacaacagaaagctgattggatacctctggccctaacgattaagggcctgaatcccacagccatctttcttaccactctcagccggaccagtaaaaagagatcttggccactgaacgaagctgtcatggcagtaggcatggtgtccatcttggccagctcgctgctcaaaaatgacattccgatgacagggcctctagttgcgggaggtctgcttactgtgtgctatgtcctgaccggcaggtcagctgacttggagctcgagcgagccgcagatgtgaagtgggaagaccaggccgagatatctgggagttcccccatcctgagcattacgatctctgaagatggaagcatgtccattaaaaacgaggaggaagaacagacactaaccatcctgatacgcactggccttctcgtaatctcaggtgtgttcccagtcagtattcccatcacagctgcagcctggtacctgtgggaagttaagaagcaacgggcgggggtgttgtgggacgtgcctagcccaccccctgtcggaaaagctgagttagaagatggcgcctatagaattaagcagaggggcatcctggggtactctcagataggagctggtgtgtataaagagggcacctttcacactatgtggcatgttacacgtggggccgtactcatgcaccgcggaaagcggattgagccgtcctgggctgacgtgaaaaaggatctgatctcatacggcggtgggtggaaacttgaaggagagtggaaagaaggcgaggaagtccaggtgctggccttggagccaggcaagaatcccagagcagttcaaaccaaacctgggctattcaagacgaacactggaaccatcggtgctgtgagtctggactttagcccaggcacatccgggtctcccattgtcgataggaaaggaaaggtggtaggcctctacggtaatggggtcgtgacccgatcgggagcctatgttagcgcgatcgcccagacagagaagtcaatagaagacaaccctgagattgaagatgacatcttccggaaaaagcgcctgactattatggatcttcatccgggcgcaggcaaaaccaagagatacttacccgctatcgtgagggaggccataaaacgggggctgcgaacgctcattttggctccaacaagagtcgtggcagccgaaatggaggaggccctgcgcggactccctatcaggtatcagactcccgctatccgtgcggaacacaccggtcgggagattgttgacctgatgtgtcatgcaacattcaccatgagacttctgtccccagtgagggtccctaactacaatttgatcattatggacgaagcccactttactgatcccgctagtatagccgcacgcggctatatctctacccgagtggagatgggggaggccgctggaattttcatgacagcgacgccaccgggcagcagagacccttttccccagtccaacgccccaatcatggatgaagaacgggaaatccccgagaggtcatggaactctggtcacgaatgggtaactgacttcaaggggaagaccgtgtggtttgttcctagcattaaagcaggaaacgatatagctgcctgcctacgcaagaatggcaaaaaggtcatccaactgagtcgtaaaacattcgactccgagtacgtgaagaccagagcaaacgattgggactttgtggtcactacagatattagcgagatgggcgccaatttccgggctgaaagggtaatcgacccacgccgatgtatgaagcccgtgattctcaccgatggggaggaaagagttatcttagccggacctatgccggtgacgcattcttcagcggcacagcggaggggtcgcataggcagaaaccccaaaaatgagaacgaccagtatatctacatgggggaaccactggagaatgacgaggattgcgcccactggaaggaagctaaaatgcttctggacaacattaatactcctgagggaatcattccctccatgtttgaaccagagagggaaaaggtcgatgccatcgacggcgagtaccggctccgtggtgaggctcgcaaaacattcgtggatttgatgcgaagaggggacctgcctgtttggctcgcatatagggtggccgctgaaggcataaactacgccgatcggcgctggtgttttgacggaattaagaataaccaaatcctggaggaaaacatggaggtcgagatttggaccaaagaaggcgagagaaagaaacttaaacccaggtggctagatgcacggatctatagtgacccactggcgttgaaggagttcaaagagttcgccgctgggcgaaagagcttaaccctgaatctcataactgaaatgggaagactgcctacatttatgacccagaaagcccgcgatgcacttgacaacctggctgtgctccatacagccgaggccggtggcagggcctacaatcacgctttgtcggagctgccggaaactctagagacgctgctccttctgaccttattggcgacagtaactgggggaatcttcctgtttctcatgtctggcaagggtattgggaagatgaccctgggcatgtgctgcatcattacagcctccatccttctgtggtatgcacagatacagccccactggattgctgccagcatcatcctcgagttctttttgattgtgctgttaatcccagagcctgaaaaacaacggacaccacaggataaccagctaacttacgttgtcatagccattctgacggtggtggcagctaccatggccaatgagatgggattcctcgagaagaccaaaaaggaccttggcctggggtcaatcactacccaggaaagtgagtctaacattttggacatcgatctgcgtccagcgtccgcttggacactctatgccgtcgcaaccacttttgttacacctatgctgagacatagcatagaaaattcaagtgtgaacgtaagccttacggccatcgctaatcaagcaaccgtgctcatgggactgggtaaaggctggcccttgtccaagatggacattggggtcccgctgttagccatcggatgttactctcaggtgaacccaattactctaacagcggctctgctccttctggttgcccactacgcaatcattggccctggtttgcaggccaaggctaccagggaggcccagaaacgcgcagctgccgggatcatgaagaatcccaccgtggatggcataacagtcattgacctggaaccaatcccctatgatcctaaattcgagaagcaactcggacaggtaatgctgcttatcttatgcgtgactcaggttctgatgatgcggacgacctgggcgctctgtgaggccttgacactggcaactggcccgattagcaccctatgggaagggaaccccggacgattttggaatacaaccatagctgtgtccatggccaacatcttcagaggctcatacctggccggtgctgggctcctattttctattatgaaaaatactacgaacacaaggcgcggaaccggcaatatcggtgagactctgggcgaaaagtggaagagtcggttgaacgccctggggaaatcggagttccagatttataagaaaagcggaatccaagaggtcgacagaaccctcgccaaggaaggcataaaacgtggggagacagatcatcacgcggtgtccaggggatctgctaagctgcggtggtttgtcgaacgcaacatggtgactccagagggcaaagttgtggacttaggttgcgggcgaggaggctggtcatactattgtggtggccttaagaatgtaagagaagtgaaggggctgaccaaaggaggccctgggcatgaggagcccatccctatgagcacatacggatggaacctcgtcaggctacagtccggcgttgatgtgttcttcacgccacccgaaaagtgcgacaccctgttgtgtgatattggtgagagttctcctaatccaactatcgaagcagggcggacactgcgcgtcctcaaccttgtggagaattggctgaacaataacacccagttttgcattaaagtattgaatccctatatgccgagcgtgatcgaaaagatggagactctgcaaagaaaatacggaggcgccctcgttaggaaccctttatcacgaaattccacacacgagatgtactgggtgagtaacgctaccggcaatatagtcagctctgtgaacatgatttcccggatgctgatcaatcgtttcacgatgaagcacaagaaagccacctatgaaccagacgtcgatcttgggtcaggaacaagaaacatcggtattgagagcgaaatacccaacctggacatcattggcaagcgcatcgagaaaattaagcaggaacatgagacttcgtggcactacgaccaggatcatccttataaaacctgggcataccacgggtcttatgagacaaagcagactggaagtgcctccagcatggtgaatggcgttgtaaggctactcaccaagccatgggacgtggtccccatggtgacacaaatggctatgaccgatactacgccgtttggtcagcagcgggttttcaaagaaaaggtggacacaagaacccaggagcctaaagaagggactaagaaactgatgcgcatcaccgcggagtggttgtggaaggagctgggaaagaaaaagacacccaggatgtgtacgcgagaagagtttacccggaaagtcagatcaaacgccgcactcggcgctatattcactgatgaaaataagtggaaatccgccagggaggcagtggaagactctcgcttttgggagcttgtagatcgtgagcggaacctgcacttagaaggcaagtgcgagacatgtgtgtacaatatgatggggaaaagagaaaagaagctgggagagttcggtaaagccaagggcagcagggctatctggtatatgtggttgggggcccgctttctcgagttcgaggcgctgggatttctaaacgaggaccattggttcagtcgaggcaattcccttagcggtgttgaaggggagggactgcaccggctcggctacattctgagagatgtctctaaaaaggaaggcggggcaatgtacgccgacgataccgctggatgggacactaggatcacattggaggacctgaaaaacgaagagatggtgaccaatcatatgaagggtgagcacaagaaactcgccgaagcaatttttaaacttacatatcaaaacaaagtggtccgcgttcagagaccaactcctcggggcaccgtgatggatatcatttcaaggcgtgaccagcgagggagtggacaggtaggcacgtacggtctgaataccttcacaaacatggaggctcaattaatacgccagatggaaggggagggaatcttcaagtccattcagcatctgactgtgaccgaggaaatcgccgtccaaaattggttggctagagtgggccgggagaggctcagccgcatggccatctctggcgatgactgcgttgtgaaacccctggatgacagatttgcatcggcgctaacagcccttaacgatatggggaaggtccggaaggacattcagcagtgggaaccatcaaggggatggaatgattggactcaggtgcccttctgcagccaccactttcatgagctggtaatgaaagacggtcgagttctcgtggtcccttgtcgtaaccaagatgaactgataggcagagctcgcatctcccagggggccggatggagtttgaaggagaccgcatgcttaggcaaatcttatgctcagatgtggacgctgatgtacttccaccggagggacctcagacttgccgcaaacgccatttgtagcgcggtgccatcccattgggtgccgacatcacgcaccacttggagtatccacgctaagcacgagtggatgacaaccgaagatatgctggccgtctggaatcgggtttggattcaggagaacccctggatggaagacaaaactcctgtggagtcttgggaagagatcccatatctaggtaagagggaggaccaatggtgcgggagcctgataggactcacctcccgagcaacatgggccaagaatatccagacggctattaaccaggtaagatcattgatcggcaatgaagagtacaccgattatatgcccagcatgaaacggtttaggcgcgaagaggaagaggccggcgtgctgtggtga

SEQ ID NO: 14762 - RNA, 9876 nt, synthetic construct
  misc_feature 1..9876: note = derived and/or modified CDS sequence (opt3) from DENV-2__GQ868541__SS-prME
  source 1..9876: mol_type = other RNA
accgcaggcgtgatcattatgctgatacccacagctatggcattccacctcactacgagaaacggggaacctcatatgatcgtcggaaggcaggaaaagggtaaaagccttctgtttaagaccgaggacggcgttaatatgtgcacattgatggcaattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagttgcgctggtgccccatgtcggtatggggcttgagaccagaacagaaacttggatgagtagcgagggagcttggaaacacgtgcagaggatcgagacctggatactgcggcatcctggcttcgccatcatggcagccattttggcttacacaatcggcaccacgcactttcagcgcgcactcattttcatcctgctgactgccgttgctccatccatgacaatgagatgcatagggatttctaacagggattttgtggaaggagtctcgggtggctcatgggtggacatcgtactcgagcacgggagctgtgttaccactatggccaagaataagcccacattagatttcgaactgattaaaaccgaggcgaagcagcctgcaacgcttcggaaatattgcatcgaagccaagttgaccaacacaactaccgagagtcgctgtccaacacaaggagagccctccctgaatgaagaacaggacaaacgatttatctgcaagcattctatggtggatagaggctggggtaacgggtgtggacttttcggcaagggcgggattgtcacttgcgctatgtttacctgcaaaaagaatatggaaggaaaagtggtgctccctgagaacctggaatacacaatagtcatcaccccacacagcggtgaggagcatgccgttggcaatgacactgggaagcacggaaaagaaattaagatcacgccgcagtcctcaataacagaggcagaacttaccggctatggtactgtgaccatggagtgtagtcccaggacagggctggatttcaacgaaatggtattgctccagatggaggagaaggcttggctggtgcaccggcaatggtttttagacctgcctctcccatggcttcccggcgccgatacccagggaagcaattggattcagaaggaaactctggtcacattcaagaaccctcatgcgaaaaagcaggacgtggttgtgttgggctctcaagagggggccatgcacacggcactaaccggagctactgaaatccagatgtcctcaggtaatctgctctttacaggccatctgaaatgccgtcttcgcatggacaagctgcagttgaaagggatgagctacagtatgtgtaccggaaagttcaagatcgtcaaagagattgccgagacacaacacggcactatcgtgattagagtacagtatgaaggtgatgggtctccatgcaagatacccttcgagatcatggacctcgagaagaggcatgttctgggccggttaattaccgtgaacccgatcgtcacggagaaggattcccctgtgaacatcgaagctgagcccccatttggagacagctacattataatcggcgtcgagcctgggcagctgaaactaaattggttcaagaagggatcgtctattggtcagatgtttgaaaccacaatgcgaggcgccaaacgcatggcaatcctcggggatactgcctgggacttcggatccctgggcggtgtgtttacctcaattgggaaggcacttcaccaagttttcggcgcgatctacggagcagcctttagtggcgtgagctggacaatgaaaatattgatcggggtaattatcacttggattggaatgaactccagatctaccagcctgtcagtcagtctcgtgctggttggcgtggtcacgctttatctgggtgctatggtgcaggccgattccgggtgtgtagtgagctggaagaataaagagttgaagtgcggatctggcatcttcataacagacaacgttcacacctggactgaacagtacaagtttcagcccgagtcaccaagtaaactcgcaagcgccattcaaaaggctcatgaagagggtatctgtggcattaggtccgtcacacggctggagaatttaatgtggaaacagatcacccccgaactgaaccacatactatctgagaatgaagtgaagctcactatcatgaccggggatattaaaggaatcatgcaggccggcaagcgctcgctgagacctcagccaacagagcttaaatatagctggaagacgtgggggaaggcaaaaatgttgtccaccgaatcacataaccaaactttcctgattgacggaccggagacagcggagtgccccaataccaacagggcttggaatagtctcgaagtggaggattacggctttggtgtcttcacaactaacatctggctgaagttacgtgaaaaacaggacgtattttgtgactctaagctgatgagcgccgcaataaaagataatcgggccgtgcacgctgacatggggtattggattgagtccgcccttaacgatacctggaagatggagaaggcatcattcatcgaagtgaaaagctgccactggcctaagtctcatacgttgtggtccaatggagtactcgagagtgaaatgatcattcccaagaatttcgctggccccgtcagccagcacaactaccgacctggttatcatacacagaccgccggcccatggcacctggggaagctagagatggactttgatttctgtgaaggaactaccgtggttgtgacagaggactgcggcaatagagggccctctctgaggactaccacagcgtccggaaaactcatcacggagtggtgctgtcgctcatgcaccctgccgcctcttcggtacagaggcgaagatggttgttggtacgggatggagattaggccattgaaggaaaaggaggaaaacctggtcaatagtttagtgactgccggacatggccaaatagacaactttagcctcggtgttctgggcatggctcttttcctggaggagatgttgcgcacacgagtggggaccaaacacgcaatcctcctggtagccgtctcgtttgtgactctaattacaggaaatatgtccttccgggatctgggccgtgtgatggtcatggttggggctaccatgacggacgatatcggaatgggcgtgacttatctcgccctgcttgcagcgtttaaggtaagacccaccttcgccgctggtttgctgttaaggaaactcacatctaaggaactgatgatggccaccattgggatcgcacttctgagccagtcaactatacctgagacaatcctagaactcaccgacgctctggccttgggaatgatggtgctgaaaattgtccgcaacatggagaagtaccagttagcagtgacaatcatggccattagttgcgttcccaatgctgtgatcctcctgaacgcgtggaaggtctcctgtactatacttgccgcagtgtctgttagcccactgttgctcacctcctcacaacagaaagctgattggattcctctggccctaacgatcaagggcctgaatcccacagccatctttcttaccactctcagccggaccagtaaaaagagatcttggccactgaacgaagctgtgatggcagtcggcatggtatccattttggccagctcgctgctaaagaatgacataccgatgacagggcctctcgtggcgggaggtctgcttactgtttgctatgtgctgaccggcaggtcagctgacttggagctcgagcgagccgcagatgtcaagtgggaagaccacgccgagatctctgggagttcccccattctgagcatcacgatttctgaagatggaagcatgtccatcaaaaacgaggaggaagaacagacactaaccatactgatccgcactggccttctcgtgatttcaggtgtattcccagtgagtatccccattacagctgcagcctggtacctgtgggaagtcaagaagcagcgggcgggggttttgtgggacgtgcctagcccaccccctgtgggaaaagctgagttagaagatggcgcctatagaatcaagcaaaggggcatactggggtactctcagattggagctggtgtatataaagagggcacctttcatactatgtggcacgtgacacgtggggccgttctcatgcatcgcggaaagcggatcgagccgtcctgggctgacgtcaagaaagatctgatctcatacggcggtgggtggaaacttgaaggagagtggaaagaaggcgaggaagtgcaggtcctggccttggagccaggcaaaaatcccagagcagtgcagaccaaacctgggctattcaagacgaacactggaaccattggtgctgttagtctggactttagcccaggcacatccgggtctcccatcgtggataggaaaggaaaggtcgtgggcctctacggtaatggggtagtcacccgatcgggagcctatgtgagcgcgatagcccaaacagagaagtcaattgaagacaaccctgagatcgaagatgacattttccggaaaaagcgcctgactatcatggatcttcacccgggcgcaggcaaaaccaagagatacttacccgctatagttagggaggccattaaacgggggctgcgaacgctcatcttggctccaacaagagtggtcgcagccgaaatggaggaggccctgcgcggactccctatcaggtatcagactcccgctattcgtgcggaacataccggtcgggagatcgtggacctgatgtgtcacgcaacattcaccatgagacttctgtccccagttagggtgcctaactacaatttgattataatggacgaagcccactttactgatcccgctagtatcgccgcacgcggctatatttctacccgagtcgagatgggggaggccgctggaatcttcatgacagcgacgccaccgggcagcagagacccttttccccagtccaacgccccaatcatggatgaagaacgggaaattcccgagaggtcatggaactctggtcatgaatgggtgactgacttcaaggggaagaccgtatggtttgtgcctagcataaaagcaggaaacgatatcgctgcctgcctacgcaagaatggcaaaaaggttattcagctgagtcgtaaaacattcgactccgagtacgtcaagaccagagcaaacgattgggactttgtggtgactacagatatcagcgagatgggcgccaatttccgggctgaaagggtcattgacccacgccgatgtatgaagcccgtaatcctcaccgatggggaggaaagagtgatattagccggacctatgccggttacgcactcttcagcggcacaacggaggggtcgcatcggcagaaaccccaaaaatgagaacgaccagtatatttacatgggggaaccactggagaatgacgaggattgcgcccattggaaggaagctaaaatgcttctggacaacatcaatactcctgagggaattatcccctccatgtttgaaccagagagggaaaaggtggatgccatagacggcgagtaccggctccgtggtgaggctcgcaaaacattcgtcgatttgatgcgaagaggggacctgcctgtgtggctcgcatatagggttgccgctgaaggcattaactacgccgatcggcgctggtgttttgacggaatcaagaataaccagattctggaggaaaacgtggaggtcgagatctggaccaaagaaggcgagagaaagaaacttaaacccaggtggctagatgcacggatatatagtgacccactggcgttgaaggagttcaaagagttcgccgctgggcgaaagagcttaaccctgaatctcatcactgaaatgggaagactgcctacatttatgacccaaaaagcccgcgatgcacttgacaacctggctgtgctccacacagccgaggccggtggcagggcctacaatcacgctttgtcggagctgccggaaactctagagacgctgctccttctgaccttattggcgacagtaactgggggaattttcctgtttctcatgtctggcaagggtatcgggaagatgaccctgggcatgtgctgcattatcacagcctccatacttctgtggtatgcacagattcagccccattggatcgctgccagcatcattctcgagttctttttgatcgtgctgttaataccagagcctgaaaaacagcggacaccacaagataaccagctaacttacgttgtcattgccatcctgacggtggtggcagctaccatggccaatgagatgggattcctcgagaagaccaaaaaggaccttggcctggggtcaattactacccaggaaagtgagtctaacatcttggacatagatctgcgtccagcgtccgcttggacactctatgccgtcgcaaccacttttgttacacctatgctgagacacagcatcgaaaattcaagtgtgaacgtaagccttacggccattgctaatcaggcaaccgtgctcatgggactgggtaaaggctggcccttgtccaagatggacatcggggtcccgctgttagccattggatgttactctcaagtgaacccaatcactctaacagcggctctgctccttctggttgcccattacgcaattatcggccctggtttgcaggccaaggctaccagggaggcccagaaacgcgcagctgccgggataatgaagaatcccaccgtggatggcattacagtcatcgacctggaaccaatcccctatgatcctaaattcgagaagcagctcggacaagtaatgctgcttattttatgcgtgactcaggttctgatgatgcggacgacctgggcgctctgtgaggccttgacactggcaactggcccgataagcaccctatgggaagggaaccccggacgattttggaatacaaccatcgctgtgtccatggccaacattttcagaggctcatacctggccggtgctgggctcctattttctatcatgaaaaatactacgaacacaaggcgcggaaccggcaatattggtgagactctgggcgaaaagtggaagagtcggttgaacgccctggggaaatcggagttccagatctataagaaaagcggaatacaggaggtcgacagaaccctcgccaaggaaggcatcaaacgtggggagacagatcaccatgcggtgtccaggggatctgctaagctgcggtggtttgtcgaacgcaacatggtgactccagagggcaaagttgtggacttaggttgcgggcgaggaggctggtcatactattgtggtggccttaagaatgtaagagaagtgaaggggctgaccaaaggaggccctgggcacgaggagcccattcctatgagcacatacggatggaacctcgtcaggctacaatccggcgttgatgtgttcttcacgccacccgaaaagtgcgacaccctgttgtgtgatatcggtgagagttctcctaatccaactattgaagcagggcggacactgcgcgtcctcaaccttgtggagaattggctgaacaataacacccagttttgcatcaaagtattgaatccctatatgccgagcgtgatagaaaagatggagactctgcagagaaaatacggaggcgccctcgttaggaaccctttatcacgaaattccacacacgagatgtactgggtgagtaacgctaccggcaatattgtcagctctgtgaacatgatctcccggatgctgatcaatcgtttcacgatgaagcataagaaagccacctatgaaccagacgtcgatcttgggtcaggaacaagaaacattggtatagagagcgaaatccccaacctggacattatcggcaagcgcattgagaaaatcaagcaagaacacgagacttcgtggcatcacgaccaggatcacccttacaaaacctgggcatatcatgggtcttacgagacaaagcagactggaagtgcctccagcatggtgaatggcgttgtaaggctactcaccaagccatgggacgtggtccccatggtgacacagatggctatgaccgatactacgccgtttggtcaacagcgggttttcaaagaaaaggtggacacaagaacccaggagcctaaagaagggactaagaaactgatgcgcataaccgcggagtggttgtggaaggagctgggaaagaaaaagacacccaggatgtgtacgcgagaagagtttacccggaaagtcagatcaaacgccgcactcggcgctatcttcactgatgaaaataagtggaaatccgccagggaggcagtggaagactctcgcttttgggagcttgtagatcgtgagcggaacctgcacttagaaggcaagtgcgagacatgtgtgtataatatgatggggaaaagagaaaagaagctgggagagttcggtaaagccaagggcagcagggctatttggtacatgtggttgggggcccgctttctcgagttcgaggcgctgggatttctaaacgaggaccattggttcagtcgaggcaattcccttagcggtgttgaaggggagggactgcaccggctcggctatatcctgagagatgtctctaaaaaggaaggcggggcaatgtacgccgacgataccgctggatgggacactaggattacattggaggacctgaaaaacgaagagatggtgaccaatcatatgaagggtgagcacaagaaactcgccgaagcaatctttaaacttacataccagaacaaagtggtccgcgttcaaagaccaactcctcggggcaccgtgatggatattatatcaaggcgtgaccagcgagggagtggacaggtaggcacgtatggtctgaataccttcacaaacatggaggctcagttaatccgccaaatggaaggggagggaattttcaagtccatccagcacctgactgtgaccgaggaaatcgccgtccagaattggttggctagagtgggccgggagaggctcagccgcatggccatttctggcgatgactgcgttgtgaaacccctggatgacagatttgcatcggcgctaacagcccttaacgatatggggaaggtccggaaggacatacaacagtgggaaccatcaaggggatggaatgattggactcaggtgcccttctgcagccatcactttcatgagctggtaatgaaagacggtcgagttctcgtggtcccttgtcgtaaccaggatgaactgatcggcagagctcgcatttcccaaggggccggatggagtttgaaggagaccgcatgcttaggcaaatcttacgctcagatgtggacgctgatgtatttccaccggagggacctcagacttgccgcaaacgccatctgtagcgcggtgccatcccactgggtgccgacatcacgcaccacttggagtattcatgctaagcacgagtggatgacaaccgaagatatgctggccgtctggaatcgggtttggatccaggagaacccctggatggaagacaaaactcctgtggagtcttgggaagaggtaccatacctaggtaagagggaggaccagtggtgcgggagcctgataggactcacctcccgagcaacatgggccaagaatatccaaacggctattaaccaggtgagatcattgatcggcaatgaagagtataccgattacatgcccagcatgaaacggtttaggcgcgaagaggaagaggccggcgtcctgtggtga

SEQ ID NO: 14763 - RNA, 9876 nt, synthetic construct
  misc_feature 1..9876: note = derived and/or modified CDS sequence (opt3) from DENV-2__GQ868603__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttctatgcaagcattctatggtggatagaggctggggtaacgggtgtggactcttcggcaagggcgggatcgtcacctgcgccatgtttacatgcaaaaagaatatggaaggaaaagtggtgctgcctgagaaccttgaatacaccattgtcataactccacacagcggtgaggagcatgctgttggcaatgacacggggaagcacggaaaagaaatcaagattacaccgcagtcctcaatcaccgaggccgaactgactggctatggtaccgtgacaatggagtgtagtcccaggaccgggttggatttcaacgaaatggtactcctgcagatggaggacaaagcatggttagtgcaccggcaatggtttctggatctccctcttccatggctgcccggcgctgacactcagggaagcaattggatacagaaggagacattggtcacgttcaagaaccctcatgccaaaaagcaggacgtggttgtgctaggctctcaagaaggggcgatgcacaccgccctgactggagcaacagagattcagatgtcctcaggtaatctcctgtttaccggccatcttaaatgccgtctgcgcatggataagttgcagctcaaagggatgagctacagtatgtgtacaggaaagttcaagatcgtcaaagaaatcgctgagactcaacacggcaccattgtgatcagagtacagtatgagggtgacgggtctccatgcaagattcccttcgaaataatggatctggagaaaaggcatgttttaggccggctgatcacggtgaacccgattgtcaccgaaaaggactcccctgtgaacatcgaggccgaacccccatttggagatagctacatcattataggcgtcgagcctgggcagctaaaactcaattggttcaagaagggatcgtctatcggtcagatgtttgagacaactatgcgaggcgctaaacgcatggccattctgggggacaccgcatgggatttcggatcccttggcggtgtgtttacatcaatcgggaaggccttgcaccaagttttcggcgctatttacggagcggcatttagtggcgtgagctggactatgaaaatcctgataggggtaatcattacctggatcggaatgaactccagatctacgagcctctcagtcagtctggtgcttgttggcgtggtcacactgtatttgggtgccatggtgcaggctgactccgggtgtgtagtgagctggaagaataaagaactcaagtgcggatctggcattttcatcaccgataacgttcacacttggacagagcagtacaagtttcagcccgaatcaccaagtaaactggccagcgcaatacaaaaggcccatgaggaaggtatttgtggcatcaggtccgtcacccggttagagaatctgatgtggaaacagattactcccgagctaaaccacatcctctctgaaaatgaggtgaagctgaccataatgacaggggacatcaaaggaattatgcaggctggcaagcgctcgcttagacctcagccaacggaattgaaatatagctggaagacctgggggaaggccaaaatgctgtccactgagtcacataaccaaacattcctcatcgatggaccggaaaccgcagagtgccccaatacaaacagggcgtggaatagtctggaggtggaagactacggctttggtgtcttcactaccaacatttggttaaagctgcgtgagaaacaggacgttctttgtgattctaagttgatgagcgctgccatcaaagacaatcgggcagtgcacgccgatatggggtattggatagaatccgctctcaacgacacgtggaagatggagaaggcctcatttattgaggtgaaaagctgccactggcctaagtctcatacactgtggtccaatggagtactagaaagtgagatgatcatcccaaaaaacttcgcaggccccgtcagccagcacaactaccgacctggttatcatacccagactgctggcccatggcacctggggaagctcgaaatggatttcgacttttgtgagggaaccacagtggttgtgactgaagattgcggcaatagagggccctctctgaggaccacaacggcctccggaaaacttattaccgagtggtgctgtcgctcatgcactttgccgcctctgcggtacagaggcgaggacggttgttggtacgggatggaaatcaggccattaaaggagaaggaagagaacctcgtcaatagtctggtgacagcgggacatggccaaattgataacttcagccttggtgttctgggcatggccttgtttctcgaagagatgctgcgcacccgagtggggactaaacacgctatactactggcagccgtatcgttcgtcacactcatcaccggaaatatgtcctttcgggacctgggccgtgtgatggtgatggtcggggctacgatgactgatgacattggaatgggcgttacctatcttgccttgctggcagcgttcaaggtgagacccacatttgccgctggtttactcctgaggaaacttacctctaaggagctgatgatggccactatcgggattgcactactcagccagtcaacaatccctgaaaccatactggagttgacagatgctctggccttaggaatgatggtactcaaaatcgtgcgcaacatggaaaagtaccagctggtcgtgactattatggcaatcagttgcgttcccaatgccgtgattcttcaaaacgcttggaaggtctcctgtaccatcctggcggccgtgtctgttagcccattgctcctgacgtcctcacggcagaaagcagactggatacctctagctctgacaattaagggccttaatcccaccgccatcttcctcactaccctgagcagaacaagtaaaaagaggtcttggccattgaacgaggccatcatggctgtgggcatggtctccattctggcaagctcgttactcaaaaatgacataccgatgactgggcctctggtagccggaggtcttctgaccgtgtgctatgttttgacgggccgatcagcggatctcgaactggagcgcgctgccgacgtgaagtgggaggatcaggcagaaatctctgggagttcccccattctaagcatcacaatttctgaggacggaagcatgtccatcaaaaacgaagaggaggaacagaccctgactatacttatccggacaggcctcctggtcatttcaggtgtgtttccagtaagtatccccattaccgccgctgcatggtacttgtgggaggtgaagaagcaaagagccggggtcttatgggatgttcctagcccaccccctgtgggaaaagcggaactggaggacggcgcttataggatcaagcagcgtggcatactcgggtactctcagattggagccggtgtgtataaagaaggcactttccacacaatgtggcatgtcacccgcggggcagtgctgatgcaccggggaaagagaatcgagccgtcctgggccgatgttaaaaaggaccttatctcatacggcggtgggtggaagctggagggagaatggaaagagggcgaagaggtacaggtgttggctctagaaccaggcaagaatcccagggccgtccaaacgaaacctgggctgtttaagactaacaccggaacaattggtgcagtgagtctcgatttcagcccaggcacctccgggtctcccatcgttgaccgaaaaggaaaggtggtcggcctgtacggtaatggggtggtaacacggtcgggagcttatgtcagcgccatagcgcagactgagaagtcaattgaggataaccctgaaatcgaggacgatatttttcgcaaaaagagacttaccatcatggacttacatccgggcgccggcaaaacgaagaggtacctgcccgcaatagtgcgggaagctattaaacgagggctcagaacattgatcctggccccaactcgcgttgtggctgcagagatggaagaggccctcaggggactgcctatccgttatcagacccccgccattcgggctgagcacacaggtagagaaatcgtcgaccttatgtgtcatgcgaccttcactatgaggctgttgtccccagtgcgcgttcctaactacaatctaattataatggatgaggcacacttcaccgaccccgccagtatcgctgcccgaggctatatttctacaagagtggaaatgggggaggcagccggaatctttatgacggctactccaccgggcagccgggatcctttcccccagtccaacgcgccaatcatggacgaggaaagggagattcccgaacgctcatggaattctggtcacgagtgggtcaccgattttaaggggaagacagtgtggttcgtacctagcataaaagccggaaacgacatcgcagcttgcctgcgtaagaatggcaaaaaggtgattcaactcagtagaaaaacctttgattccgaatacgttaagactcgggccaacgactgggatttcgtcgtgacaaccgacatcagcgagatgggcgcaaattttaaggccgagagggtgattgatccacgccgatgtatgaaacccgtcatcttaacggacggggaagagagagtaatactggctggacctatgccggtgactcattcttcagccgcgcagcggaggggtcgcatcggcagaaacccaaagaatgaaaacgaccagtatatttacatgggggagccccttgaaaatgatgaggactgcgcacactggaaagaggccaagatgctgctcgataacatcaatacacctgaaggaattatcccctccatgttcgagccagaaagggagaaagttgacgctatagatggcgaataccggttgcgtggtgaggcccgcaagacctttgtggacctgatgcgaagaggggatctccctgtctggctggcttatagggtggcagccgagggcattaactacgctgaccggcgctggtgtttcgatggaatcaaaaataaccaaattcttgaagagaacgttgaagtggagatctggaccaaggagggcgaaagaaagaaactaaagcccaggtggctggacgcccggatatatagtgatccattggcattaaaagagtttaaggaattcgcggccgggcgaaaaagcctgactctcaatctgatcacagagatgggaagacttcctaccttcatgacacagaaggctcgcgacgccctggataacctcgcagtcttgcatactgctgaagccggtggcagggcatacaatcacgccctgtcggagctaccggagacgctggaaaccctccttctgttaacattgctggctactgtgaccgggggaatttttctcttcctgatgtctggcaagggtgtagggaaaatgacacttggcatgtgctgcatcattaccgcgtccatcctgctctggtatgcccagatacagccccactggattgcagctagcatcatcttggagtttttcctgattgtgttactaatcccagaacctgagaagcaacggactccccaggacaaccagctgacgtacgttgtcatagccattctcaccgtggtggccgcaacaatggctaatgaaatgggatttcttgagaaaactaagaaagacctgggcttggggtcaatcaccacacaggagagtgaatctaacattctggatatcgacctccgtccagcctccgcgtggaccctgtatgctgtcgccactacattctttacgcctatgcttagacatagcatagagaattcaagtgttaacgtgagcctcaccgcaatcgccaatcaagctactgtactgatgggattgggtaagggctggcccctgtccaagatggatattggggtgccgttactagcaatcggatgttactctcaggtcaacccaattacactgaccgccgcgctccttctgttggtggctcactacgccatcattggccctggtctgcaggcaaaagccaccagggaagctcagaagcgcgccgcagctgggatcatgaaaaatcccacagttgacggcataactgtgattgatctcgagccaatcccctatgaccctaagttcgaaaaacaactgggacaggtcatgcttttaatcctgtgcgtaacgcaggtgctcatgatgcggaccacatgggccttgtgtgaggcgctgactctagccaccggcccgattagcacactgtgggaggggaaccccggacgattttggaataccactatagcagtttccatggctaacatcttcagaggctcatacctcgccggtgcagggcttctgttttctattatgaagaatacgacaaacaccaggcgcggaactggcaatatcggtgaaaccttgggcgagaagtggaaaagtcggctgaacgctctcgggaagtcggaattccagatttataaaaagagcggaatccaagaggtggatagaacactggccaaagagggcataaagcgtggggaaactgaccatcacgccgtctccaggggatctgcgaaattacggtggtttgtggagcgcaacatggtcaccccagaaggcaaggtggttgatcttggttgcgggcgaggaggctggtcatactattgtggtggcctgaagaatgtgagagaggtaaaagggctcacaaagggaggccctgggcatgaagagcccatccctatgagcacgtacggatggaacctagtgaggctgcagtccggcgtcgacgttttcttcaccccacccgagaaatgcgatactttgctgtgtgacattggtgaaagttctcctaatccaacaatcgaggctgggcggaccctccgcgtgcttaacctggtcgaaaattggttgaacaataacactcagttttgcattaaggtgctgaatccctatatgccgagcgtaatcgagaaaatggaaacactccaaagaaagtacggaggcgcattagtgaggaaccctctgtcacgaaattccacccacgagatgtactgggttagtaacgccacgggcaatatagtgagctctgtcaacatgatttcccggatgcttatcaatcgtttcaccatgaagcacaaaaaggctacatatgagccagatgtggacctggggtcaggaactagaaacatcggtattgaaagcgagatacccaacctagacatcattggcaaacgcatcgaaaagattaaacaggagcatgaaacctcgtggcactacgatcaggaccatccttataagacatgggcctaccacgggtcttatgagactaagcagaccggaagtgcatccagcatggtcaatggcgtggttaggctcctgacaaaaccatgggatgtagtgcccatggtcacccaaatggccatgactgacacgacaccgtttggtcagcagcgggtgttcaaggagaaagttgataccagaactcaggaacctaaggaggggaccaaaaagttgatgaagatcacagctgaatggctgtggaaagagctcggaaagaaaaagataccccgcatgtgtacgagggaggaatttacccgaaaagtgcggtcaaacgcggcccttggcgcaatcttcactgacgagaataagtggaaatccgctagagaagccgtcgaggattctaggttttgggaactggtggaccgcgagcgtaacttacacctggagggcaagtgcgaaacatgtgtatacaatatgatggggaagcgggagaaaaagttgggagaattcggtaaagcaaagggcagcagagccatttggtatatgtggctcggggctaggtttctggagttcgaagccctaggatttcttaacgaggatcattggttcagtcgcggcaattccctgagcggtgtggagggggaaggactccaccgactgggctacatcttgcgggacgtttctaaaaaggagggcggggcgatgtacgcagatgacaccgccggatgggacactagaattacactggaagatctcaagaacgaggaaatggtcaccaatcatatgaaaggtgagcacaagaaacttgctgaggccatctttaagctgacatatcaaaacaaagtggtgagggtccagcgcccaactcctagaggcaccgttatggacattatatcacggagggatcagcgtgggagtggacaggtgggcacgtacggtttaaataccttcacaaacatggaagcacaactgatccgacagatggagggggaaggaattttcaagtccatccagcatttgactgtaaccgaggagatcgctgtgcaaaattggctcgcccgcgtcggcagagaacggctgagcaggatggctatttctggcgacgattgcgtggttaagcccctagacgatcgctttgcctcggcacttacagcgctgaacgacatggggaaagtgagaaaggatatacagcagtgggagccatcacggggatggaatgactggactcaggtccccttctgcagccaccactttcatgaactcgtgatgaaagatggtagggtactggttgtgccttgtcgaaaccaagacgagttgatcggccgtgccagaatttcccagggggctggatggagtttaaaggaaaccgcctgcctgggcaaatcttatgcacagatgtggacgctcatgtacttccaccgccgggatcttaggctggctgccaacgcaatctgtagcgccgtcccatcccattgggtgccgacatcaagaaccacttggagtattcacgcgaagcacgagtggatgacaaccgaggacatgctagctgtgtggaatcgcgtctggatccaggaaaacccctggatggaggacaagactcctgttgaatcttgggaggaagtgccatatctgggtaaacgggaggatcaatggtgcgggagcctcataggattgacctccagggccacatgggcaaagaatatccagacggccattaaccaggtacgatcactgatcggcaatgaggaatacaccgactatatgcccagcatgaaaagatttcggagggaggaagaggaagctggcgtgctttggtga

SEQ ID NO: 14764 - RNA, 9876 nt, synthetic construct
  misc_feature 1..9876: note = derived and/or modified CDS sequence (opt3) from DENV-2__FJ898450__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgccatggtgcaggctgactccgggtgtgtagtgagctggaagaataaagaattgaagtgcggatctggcatcttcataaccgataacgttcacacttggacagagcagtacaagtttcagcccgaatcaccaagtaaactcgccagcgcaattcaaaaggcccatgaggaaggtatctgtggcattaggtccgtcacccggctggagaatttaatgtggaaacagatcactcccgagctgaaccacatactatctgaaaatgaggtgaagctcaccatcatgacaggggacattaaaggaatcatgcaggctggcaagcgctcgctgagacctcagccaacggaacttaaatatagctggaagacctgggggaaggccaaaatgttgtccactgagtcacataaccaaacattcctgattgatggaccggaaaccgcagagtgccccaatacaaacagggcgtggaatagtctcgaggtggaagactacggctttggtgtcttcactaccaacatctggctgaagttacgtgagaaacaggacgctttttgtgattctaagctgatgagcgccgcaataaaagacaatcgggccgttcacgctgatatggggtattggattgaatccgcccttaacgacacgtggaagatggagaaggcatcattcatcgaggtgaaaagctgccactggcctaagtctcatacattgtggtccaatggagtgctcgaaagtgagatgatcattccaaaaaacttcgctggccccgtaagccagcacaactaccgacctggttatcatacccagactgccggcccatggcacctggggaagctagaaatggattttgacttctgtgagggaaccacagtcgtggttactgaagattgcggcaatagagggccctctctgaggaccacaacggcgtccggaaaactcatcaccgagtggtgctgtcgctcatgcactctgccgcctcttcggtacagaggcgaggacggttgttggtacgggatggaaattaggccattgaaggagaaggaagagaacctggtgaatagtttagtcacagccggacatggccaaatagataactttagcctcggtgtgctgggcatggctcttttcctggaagagatgttgcgcacccgagttgggactaaacacgcaatcctcctggtggccgtatcgtttgtcacactaattaccggaaatatgtccttccgggacctgggccgtgtgatggtgatggtcggggctacgatgactgatgacatcggaatgggcgttacctatctcgccctgcttgcagcgtttaaggtgagacccacattcgccgctggtttgctgttaaggaaactcacctctaaggagctgatgatggccactattgggatcgcacttctgagccagtcaacaatacctgaaaccatcctagagctcacagatgctctggccttgggaatgatggtactgaaaattgtgcgcaacatggaaaagtaccagttagcagtcactatcatggccattagttgcgtgcccaatgctgttatcctccaaaacgcgtggaaggtgtcctgtaccatactggccgcagtctctgtgagcccacttctgttgacgtcctcacagcagaaagctgactggattcctctcgccctgacaatcaagggcctaaatcccaccgccatctttctgactacccttagccggacaagtaaaaagagatcttggccactcaacgaggctgttatggcagtgggcatggtctccattctggccagctcgttgctgaaaaatgacataccgatgactgggcctttagtagcgggaggtctcctgaccgtgtgctatgttcttacgggcaggtcagctgatctggaattggagcgagccgcagacgtgaagtgggaggatcaggccgaaatctctgggagttcccccattctcagcatcacaatttctgaggacggaagcatgtccatcaaaaacgaagaggaggaacaaaccctgactatactaatccgcacaggcctgcttgtcatttcaggtgtgttcccagtaagtatccccattaccgctgcagcctggtacctctgggaggtgaagaagcagcgggcgggggtcctgtgggatgttcctagcccaccccctgtgggaaaagctgaattggaggacggcgcctatagaatcaagcagaggggcatattagggtactctcagattggagcaggtgtgtataaagaaggcacttttcacacaatgtggcatgtcacccgtggggccgtgctgatgcaccgcggaaagcggatcgagccgtcctgggctgatgttaaaaaggacctcatctcatacggcggtgggtggaagctggagggagaatggaaagagggcgaagaggtacaagtgcttgccctggaaccaggcaagaatcccagagcagtccagacgaaacctgggttgttcaagactaacaccggaacaattggtgctgtgagtctagattttagcccaggcacctccgggtctcccatcgttgacaggaaaggaaaggtggtcggcctgtacggtaatggggtggtaacacgatcgggagcctatgtcagcgcgatagcccagactgagaagtcaattgaggataaccctgaaatcgaggacgatattttccggaaaaagcgcctcaccatcatggacctgcatccgggcgcaggcaaaacgaagagataccttcccgctatagtgagggaagccattaaacgggggttacgaacactgatcctcgctccaactagagttgtggcagccgagatggaagaggccttgcgcggactgcctatcaggtatcagacccccgctattcgtgcggagcacacaggtcgggaaatcgtcgacctcatgtgtcatgcaaccttcactatgagactgctttccccagtgagggttcctaactacaatctgattataatggatgaggcccactttaccgaccccgctagtatcgccgcacgcggctatatttctacacgagtggaaatgggggaggccgctggaatcttcatgacggcgactccaccgggcagcagagatccttttccccaatccaacgccccaatcatggacgaggaacgggagattcccgaaaggtcatggaattctggtcacgagtgggtcaccgatttcaaggggaagacagtgtggtttgtacctagcataaaagcaggaaacgacatcgctgcctgcttgcgcaagaatggcaaaaaggtgattcagctaagtcgtaaaaccttcgattccgaatacgttaagactagagcaaacgactgggattttgtcgtgacaaccgacatcagcgagatgggcgccaatttccgggctgagagggtgattgatccacgccgatgtatgaagcccgtcatcctgacggacggggaagagagagtaatactcgccggacctatgccggtgactcattcttcagcggcacagcggaggggtcgcatcggcagaaacccaaaaaatgaaaacgaccaatatatttacatgggggagcccttagaaaatgatgaggactgcgcccactggaaggaggctaaaatgctgcttgataacatcaatacacctgaaggaattatcccctccatgtttgagccagaaagggagaaggttgacgccatagatggcgaataccggctgcgtggtgaggctcgcaaaaccttcgtggacctcatgcgaagaggggatttgcctgtctggctggcatatagggtggccgctgagggcattaactacgccgaccggcgctggtgttttgatggaatcaagaataaccagattctcgaagagaacgttgaagtggagatctggaccaaagagggcgaaagaaagaagctgaaacccaggtggcttgacgcacggatatatagtgatccactagcgctgaaggagttcaaagaattcgccgctgggcgaaagagcttgactttaaatctgatcacagagatgggaagactccctacctttatgacacagaaagcccgcgacgcactggataaccttgctgtcctgcatactgccgaagcaggtggcagggcctacaatcacgctctctcggagttgccggagacgctggaaaccctactgctccttacactgttagcgactgtgaccgggggaattttcttgtttctgatgtctggcaagggtatcgggaagatgacactcggcatgtgctgcattatcaccgcctccatactgctttggtatgcacagattcaaccccactggatcgctgccagcatcattctggagttctttctcatcgtattgctgataccagaacctgagaaacagcggactccccaggacaaccagttaacgtacgtggttattgccatcctaaccgtcgtggcagctacaatggccaatgaaatgggattcctggagaagactaaaaaggacctcggccttgggtcaattaccacacaagagagtgaatctaacatcctggatatagacttgcgtccagcgtccgcttggaccctgtatgccgtggcaactacatttgtcacgcctatgctcagacatagcatcgagaattcaagtgttaacgtgagcctgaccgccattgctaatcaggcaactgtacttatgggactcggtaaaggctggcccctgtccaagatggatatcggggtgccgttgctggccattggatgttactctcaggtcaacccaatcacattaaccgcggctctactgctccttgtggcccactacgcaattatcggccctggtctgcaggccaaggctaccagggaagcccaaaaacgcgcagctgccgggataatgaagaatcccacagttgacggcattactgtgatcgatttggagccaatcccctatgaccctaaattcgaaaagcagctgggacaggtcatgctcctgattctttgcgtaacgcaggtgttaatgatgcggaccacatgggcgctgtgtgaggccctcactttggcaaccggcccgataagcacactgtgggaggggaaccccggacgattttggaataccactatcgctgtttccatggccaacattttcagaggctcatacctagcaggtgctgggctgctcttttctatcatgaaaaatacgacaaacaccaggcgcggaactggcaatattggtgaaacccttggcgagaagtggaagagtcggctgaacgccttggggaaatcggaattccaaatctataagaaaagcggaatacaggaggtggatagaacactggccaaggagggcatcaaacgtggggaaactgaccatcacgcggtctccaggggatctgctaagctccggtggtttgtggagcgcaacatggtcaccccagaaggcaaagtggttgatctgggttgcgggcgaggaggctggtcatactattgtggtggcttaaagaatgtgagagaggtaaaggggcttacaaaaggaggccctgggcatgaagagcccattcctatgagcacgtacggatggaacctggtgaggctccagtccggcgtcgacgttttcttcaccccacccgagaagtgcgatactctactgtgtgacatcggtgaaagttctcctaatccaacaattgaggcagggcggaccttgcgcgtgctgaacctcgtcgaaaattggcttaacaataacactcaattttgcatcaaagtgctgaatccctatatgccgagcgtaatagagaagatggaaacattgcagagaaaatacggaggcgccctggtgaggaaccctctctcacgaaattccacccacgagatgtactgggttagtaacgctacgggcaatattgtgagctctgtcaacatgatctcccggatgttaatcaatcgtttcaccatgaagcacaagaaagccacatatgagccagatgtggacctggggtcaggaactagaaacattggtatagaaagcgagatccccaaccttgacattatcggcaagcgcattgaaaaaatcaagcaggagcatgaaacctcgtggcactacgatcaggaccatccttataggacatgggcataccacgggtcttatgagactaaacaaaccggaagtgcctccagcatggtcaatggcgtggttcggctgctaacaaagccatgggatgtagtgcccatggtcacccagatggctatgactgacacgacaccgtttggtcagcagagagtgttcaaggagaaagttgatacccgcactcaagaacctaaggaggggaccaaaaagctcatgaggataacagcggaatggctgtggaaagagttgggaaagaagaaaacgccccgaatgtgtacccgggaggaatttactagaaaggtgaggtcaaacgccgcactgggcgctatcttcacagacgagaataaatggaagtccgcccgcgaagcagtcgaggattctcgtttttgggaactcgtggaccgggagagaaaccttcacctggagggcaaatgcgaaacctgtgtatacaatatgatggggaagagggagaaaaagttaggagaattcggtaaggccaaaggcagccgcgctatttggtatatgtggctgggggcccgatttttggagttcgaagcgctcggatttctgaacgaggatcattggttcagtcggggcaattccctaagcggtgtggagggggaaggacttcacagactgggctacatcctcagggacgtttctaagaaagagggcggggcaatgtacgccgatgacactgctggatgggacacacgcattaccctggaagatttgaagaacgaggaaatggtcacaaatcatatgaaaggtgagcacaagaagctggccgaggcaatctttaaactcacttatcagaacaaggtggtgagagtccagcggccaacccctaggggcacggttatggacattatatcacgtcgagatcagcgcgggagtggacaagtgggcacctacggtcttaatacattcactaacatggaagctcagctgatcagacagatggagggggaaggaattttcaaatccatccaacatttaaccgtaacagaggagatcgccgtgcagaattggctggctcgggtcggcagggaacgcttgagcagaatggccatttctggcgacgattgcgtggttaagcccctcgacgatcggtttgcatcggcgctgactgccctaaacgacatggggaaagtgaggaaggatatacagcagtgggagccatcacgaggatggaatgactggacccaagtccccttctgcagccaccactttcatgaacttgtgatgaaggatggtcgtgtactggttgtgccttgtagaaaccaggacgagctcatcggccgcgctcggatttcccagggggccggatggagtctgaaagaaacggcatgcttgggcaagtcttatgctcagatgtggacattaatgtacttccacaggagagatctgcgcctcgccgcaaacgccatctgtagcgcggtcccatcccattgggtgccgacctcacggactacatggagtattcacgctaaacacgagtggatgaccactgaggacatgcttgccgtgtggaatagggtctggatccaagaaaacccctggatggaggacaagacccctgttgaatcttgggaggaagtgccatatctgggtaaacgagaggatcagtggtgcgggagcctaataggactgacatccagagcaacgtgggccaagaatatccagaccgctattaaccaggtacggtcactcatcggcaatgaggaatacactgactatatgcccagcatgaagaggtttcgccgtgaggaagaggaagccggcgtgttgtggtga

SEQ ID NO: 14765 - RNA, 9876 nt, synthetic construct
  misc_feature 1..9876: note = derived and/or modified CDS sequence (opt3) from DENV-2__FJ898453__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataagcttcaactgaaagggatgagctacagtatgtgtactggaaagttcaagatcgtcaaagaaatcgctgagacccagcacggcacgattgtgatcagagtacagtatgagggtgacgggtctccatgcaagattcccttcgaaataaccgatttggagaaaaggcatgttctcggccggctgatcacagtgaacccgattgtcactgaaaaggactcccctgtgaacatcgaggccgaacccccatttggagatagctacatcattgtcggcgtggagcctgggcagttaaaactgaattggttcaagaagggatcgtctataggtcaaatgtttgagaccacaatgcgaggcgctaaacgcatggccatcctaggggacactgcatgggatttcggatccctcggcggtgtttttacctcaattgggaaggccctgcaccaggtgttcggcgctatctacggagcggcatttagtggcgtaagctggacgatgaaaattcttatcggggtcataatcacatggattggaatgaactccagatctaccagcttgtcagtgagtctggttctcgtgggcgtcgtgactctgtatcttggtgccatggtacaggctgactccgggtgtatcgtgagctggaagaataaagaactgaagtgcggatctggcattttcatcacagataacgttcacacctggactgagcagtacaagtttcaacccgaatcaccaagtaaattggccagcgcaatacagaaggcccatgaggaaggtatttgtggcatcaggtccgtcacccggctcgagaatctgatgtggaaacagattacacccgagttaaaccacatcctgtctgaaaatgaggtgaagctaacgataatgaccggggacatcaaaggaattatgcaggctggcaagcgctcgctcagacctcaaccaactgaactgaaatatagctggaagacatgggggaaggccaaaatgctttccaccgagtcacataaccagacattcttgatcgatggaccggaaactgcagagtgccccaataccaacagggcgtggaatagtctggaggtggaagactacggctttggtgtcttctctacgaacatttggctcaagctgcgtgagcggcaggacgttttttgtgatagcaaattaatgtccgctgccatcaaggacaatcgagcagtgcacgccgatatggggtattggatagaatcagctctgaacgacacatggaaaatggagaaggccagcttcattgaggtgaagtcttgccactggcctaaatcccataccctttggagtaatggagtattggaaagcgagatgatcatcccaaagaacttcgcaggccccgtctctcagcacaactacagacctggttatcatactcaaaccgctggcccatggcacctcgggaaactggaaatggattttgacttctgtgagggaacaactgtggttgtgaccgaagattgcggcaatagggggccctccctacgcacaacgaccgcctcaggaaagctgattactgagtggtgctgtcggagttgcacactcccgcctctgagatacaggggcgaggacggttgttggtacgggatggaaatccgcccacttaaagagaaggaagagaacttggtcaatagcctggtgaccgcgggacatggccagattgataacttttcgttaggtgttctcggcatggccctgttccttgaagagatgctgcgaactcgggtggggacaaagcacgctatattgctcgtagcactgtcctttgtcaccctaatcacgggaaatatgtctttccgtgacctgggcagagtgatggtgatggtcggggccactatgaccgatgacattggaatgggcgttacatatctcgctctgcttgccgcatttaaagtgaggcccaccttcgcggccggtttgctgttacgcaagctcactagcaaagagctgatgatggctacaatcgggattgcccttctgtcacagagtaccctacctgaaacaatcctcgagctgactgatgcattggctctgggaatgatggtattaaagatagtgcggaacatggaaaaataccaactcgccgtcaccatcatggcaatttcctgcgtgcccaatgccgttatcctgcagaacgcttggaaggtgtcttgtacgattcttgcggccgtcagcgtgtccccactgttgctcacatcaagccagcagaaggcagactggatccctctggctctaaccataaaaggcctgaatcccactgccatttttcttaccacactcagtagaacttctaagaaaaggtcctggccactgaacgaggccatcatggctgttggcatggtgagcatcttggcatcgtcactgttaaagaatgacattccgatgaccgggcctctcgtcgccggaggtctgcttacggtatgctatgtgctgacaggccgatctgcggatttggaactcgagcgcgctgccgacgttaaatgggaggatcaagcagaaataagtgggtccagccccatcctgtctattaccatcagcgaggacggatccatgtcaattaagaacgaagaggaggaacagactctaacaatcctgatacggaccggccttctcgtgatcagtggtgtcttcccagtgagcattcccatcactgccgctgcatggtacctgtgggaggtaaaaaagcagagagccggggtgttgtgggatgtcccttctccaccccctgttggaaaggcggaattagaggacggcgtgtataggattaaacagcgtggcatcctggggtactcccaaataggagctggtgtgtataaggaaggcacatttcacaccatgtggcatgtcacgcgcggggccgtgctcatgcaccggggaaaaagaattgagccgtcatgggcagatgttaagaaagacctgatcagttacggcggtgggtggaagcttgagggagaatggaaggagggcgaagaggtacaggtgctggccttggaaccaggcaaaaatcccagggctgtccagactaagcctgggatcttcaaaaccaacacaggaaccattggtgccgtgagcctagatttttccccaggcacatctgggtcgcccatcgttgaccgaaagggaaaagtggtcggcctgtacggtaatggggtggtaactcggagcggagcatatgtctcagctatagcccagaccgagaagtccattgaggataaccctgaaatcgaggacgatattttccgcaagaaaagactcacgatcatggacctgcatccgggcgcgggcaagacaaaaaggtaccttcccgccatagtgcgggaagcaattaagcgagggttaagaactctgatcctcgctccaacccgcgttgtggccgctgagatggaagaggcattgaggggactgcctatccgttatcaaacacccgccattcgggccgagcacaccggtagagaaatcgtcgacctcatgtgtcatgctactttcaccatgaggctgcttagtccagtgcgcgttcctaactacaatctgattataatggatgaggcgcactttacagaccccgcatctatcgccgctcgaggctatattagcacgagagtggaaatgggggaggccgcaggaatcttcatgactgccaccccaccgggctcccgggatccttttccccagtcaaacgctccaatcatggacgaggaaagggagattcccgaacgctcttggaatagcggtcacgagtgggtcacagatttcaaagggaagaccgtgtggtttgtacctagtataaaggcgggaaacgacatcgccgcatgcttgcgtaaaaatggcaagaaagtgattcagctatccagaaagactttcgatagcgaatacgttaaaacacgggctaacgactgggattttgtcgtgaccacggacatctctgagatgggcgccaatttcaaggcagagagggtgattgatccacgccgatgtatgaagcccgtcatcctgactgacggggaagagagagtaatactcgccggacctatgccggtgacacattcatccgctgcccaacggaggggtcgcatcggcagaaacccaaaaaatgaaaacgaccagtatatttacatgggggagcccttagaaaatgatgaggactgcgcgcactggaaggaggcaaaaatgctgcttgataacatcaatacccctgaaggaattatccccagtatgtttgagccagaaagggagaaggttgacgccatagatggcgaataccggctgcgtggtgaggctcgcaaaaccttcgtggacctcatgcgaagaggggatttgcctgtctggctggcctataaggtggctgcagagggcattaactacgccgacaggaaatggtgttttgatggaatcaagaataaccagattctcgaagagaacgttgaagtggagatctggactaaggagggcgaacggaaaaagctgaaaccccgctggcttgacgctagaatatatagcgatccactagccctgaaggagttcaaagaattcgcagcggggaggaagtcgttgacattaaatctgatcaccgagatgggacggctccctacatttatgactcagaaggcccgaaacgctctggacaatcttgccgtcctgcatacggcagaagtgggtggcagagcttacaaccacgccctctctgagttgccggagaccctggaaacactactgctccttactctgttagcaaccgtaacagggggaattttcttgtttctgatgtccggcaaaggtatcgggaagatgaccctcggcatgtgctgcattatcactgccagcatactgctttggtatgctcaaattcagccccactggatcgcggcctcaatcattctggagttctttctcatcgtgttgctgataccagaacctgagaaacagcgcacgccccaggataatcaattaacctacgttgtcattgcaatcctaacagtggtggctgccactatggccaacgaaatgggattcctggagaagaccaaaaaggacctcggctttgggagtattacaacccaggagtctgaatccaatatccttgacatagatctgaggccagcaagcgcttggactttgtatgccgtcgcgacaacgttcgttacccctatgctgcggcattcaatcgagaacagtagcgtgaatgtatccctcactgctattgccaaccaggcaacagtgctgatgggacttggtaagggctggcccctctctaaaatggacatcggggtcccgctgttggccattggatgttacagccaggtgaatccaatcaccctgaccgctgcattactactgctcgttgcccactacgcgattatcggccctggtcttcaagctaaggccacacgtgaagcacagaaaagagccgctgccgggataatgaagaaccccactgtggatggcattacggtcatcgacctggagccaatcccctatgatcctaaatttgaaaagcagttgggacaggtaatgctgctcattctgtgcgtgacccaagttcttatgatgaggacaacttgggcattatgtgaggctctgaccctcgccacaggcccgatatccaccttgtgggaggggaatcccggacgcttctggaacactacgatcgcggtgtcaatggccaatatttttcggggctcttacctggcaggtgctgggctactgttcagtatcatgaagaacacaaccaatactcgaagaggaaccggcaacgtcggtgaaacactcggcgagaaatggaagtcgaggcttaacgccctggggaaaagcgaatttcagatttataagaaatccggaatccaggaggtggaccgcactttggcaaaggagggcataaaacggggggaaaccgatcatcacgctgtctctagaggatcagccaagctgcgttggttcgtggagaggaatatggttgccccagaaggcaaggtggtagacctcggttgcgggcggggaggctggagctactattgtggtggcctgaaaaacgtgcgcgaggtcaaggggttaacaaaaggaggccctgggcatgaagagcccatccctatgtccacgtacggatggaatcttgttcgactgcaaagtggcgtggatgtcttctttaccccacccgagaagtgcgacactctcctatgtgatattggtgaatctagccctaacccaacaatcgaggcggggagaaccctgagggtgttgaatctggtagaaaactggctcaataacaatactcagttctgcattaaagtgcttaacccctatatgccgtcagttatcgagaagatggaaacactgcagcggaagtacggaggcgctttggtgcgcaatcctctgtccagaaacagtacccacgagatgtactgggtcagcaatgcaacgggcaacatagtgtcttccgtcaatatgatttcaaggatgctcatcaaccgatttaccatgaaacacaagaaagccacatatgagccagacgtggatttagggagcggaactcggaacatcggtattgaatcggagatacccaatctggacatcattggcaagcgtatcgaaaaaattaagcaggagcatgaaacctcttggcactacgaccaagatcatccttataagacatgggcttaccacgggagttatgagactaaacagaccggatccgccagctcaatggttaacggcgtagtgagacttctgacaaagccatgggacgtcgtgcccatggttacccagatggcaatgactgatacgacaccgttcggtcagcaacgcgtgtttaaagagaaggtcgacaccaggactcaggaacctaaagaggggaccaagaagctaatgaaaatcacagccgaatggctctggaaggagctgggaaaagagaagacgccccggatgtgtaccagagaagagttcactcgcaaagtgaggtccaatgctgcgttgggcgccatatttacagatgaaaacaagtggaaatctgcacgagaggctgtagaagacggccggttctgggagctggtggatagagagaggaatctccaccttgaagggaagtgcgagacctgtgtttacaacatgatgggaaagcgcgaaaaaaagctgggtgagtttggcaaagccaaggggagccgtgcaatctggtatatgtggttaggagcccggttcctggaatttgaggctttgggcttcctcaatgaggaccattggtttagtagaggtaactccctgagcggggtcgaaggagagggcctacacaggcttggctacattctgcgcgaagtggggaaaaaggagggaggtgccatgtacgcggatgacactgcaggctgggatacacgaatcaccctcgaagacctgaagaatgaggagatggtgacaaaccatatgaaaggggaacacaagaaattggccgaggctattttcaagctgacttatcagaataaagtcgttcgggtgcagagaccaacccctaggggaacggtaatggacatcatttctcgcaaggatcaaagaggctcaggtcaggtggggacctacggactcaacacattcactaatatggaagcccagcttatacggcaaatggagggcgagggcatctttaagagtattcagcatctgaccgtcacagaagagatcgcagtgcagaactggttagctagggttgggcgtgaacgactgtcccgcatggccatcagcggagacgattgcgtggtcaaacccattgacgatagattcgcttctgccttgactgcactcaatgacatgggtaaggtgcggaaagatatacagcaatgggagccatcgaggggctggaacgactggacccaggtacccttttgctcacaccacttccatgaactggttatgaaggatgggcgcgtgctagtcgtgccttgtagaaaccaggacgagcttatcggacgggcgaggattagccagggcgccggttggtccctgaaagagacggcttgcctcgggaagagttatgcccaaatgtggacactgatgtactttcaccgacgtgatttgagattagcagctaatgccatctgttctgcagtgccaagccattgggtcccgacctcccgcactacatggtcaattcacgccaagcacgaatggatgaccactgaggacatgctggcggtttggaaccgggtgtggatccaggaaaatccctggatggaggataaaacccctgtagaaagttgggaggaggtgccatatctcggaaagagggaagaccagtggtgcggctctcttataggcctgacaagcagagctacgtgggccaaaaacatccagaccgcaattaatcaagtccgctccctaatcgggaacgaggaatacactgactatatgccctcaatgaagcggttcaggcgagaggaagaggaggccggagtgctgtggtga

SEQ ID NO: 14766 - RNA, 9876 nt, synthetic construct
  misc_feature 1..9876: note = derived and/or modified CDS sequence (opt3) from DENV-2__EU482445__SS-prME
  source 1..9876: mol_type = other RNA
agcgccggcatgataattatgctgatacccaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggacccttaaaatcttgattggcgttatcataacatggatcgggatgaactctcgcagcacttcactgagtgtgtccctcgtcctggtgggaattgtaaccctttacctgggcgtgatggttcaggcagatagcggttgtgtcgtgtcttggaagaataaggagttgaaatgcgggtcaggaatcttcattacggacaacgtgcacacatggaccgaacagtataagtttcaacccgagagtccaagcaaactcgcctccgctatccagaaggcccaggaagagggcatatgtggtattagatctgtcactaggctggagaatttaatgtggaaacagatcacacccgaactgaaccacattctagcagagaatgaagttaagctcaccatcatgactggcgatataaaagggatcatgcaagccggaaagcggtcgctgcgccctcagccaaccgagcttaagtacagctggaaaacatggggcaaggctaaaatgttgtccacggaatcatataaccagaccttcctgattgacgggccggagactacagagtgccccaataccaacagagcctggaatagtctcgaagtggaggattacggatttggcgtgttcacaactaacatctggctgaagttaaaagaaaagcaggacgcattttgtgactctaagctgatgagcgcggctattaaagataatagggccgtacatgcagacatgggttattggatcgagtccgcccttaacgatacctggaagatagagaaggcttcattcattgaagtcaagaattgccactggcctaaaagccatacgttgtggtctaacggggtgctcgagtccgaaatgatcatcccaaagaacctggccggacccgttagtcaacacaattaccgtcctggctaccacacacagattgcaggtccatggcatctaggcaagctggagatggacttcgatttttgtgacgggaccactgtgatcgtcaccgaagattgcggaaaccggggccccagcctccgaacaactaccgcttctgggaaactgattacagagtggtgctgtagatcctgcacgcttccgcctttgaggtatcgcggagaggacggctgttggtacggtatggaaatacggccactgaaggagaaagaagagaatttagtgaactcactcgttaccgccgggcacggacaggtggataatttcagtctgggcgtacttggtatggcgctgtttttggaagagatgctcagaactagggtcggcacaaagcatgccatcctgctagtggctgtgagcttcgtcaccctgattactgggaacatgtcgtttaaagacctcggacgcgttgtggtaatggtgggcgcaacaatggccgatgacatcgggatgggagtcacctatctggctcttttggccgcattcaaggtgcgacccacgtttgcggccggcctgttactccggaagctgacttccaaagagcttatgatgaccacaattggtatcgttctgctatctcaaagcaccatacctgaaactgtgctcgagctgacagatgctttggccctggggatgatggtcttaaagatcgtgcgtaatatggaaaaataccagctcgcagttaccattatggctatcctgtgcgtgcccaacgccgtcattcttcagaatgcatggaaggtatcatgtacaatcctggccgtggttagtgtgtccccattgctcctgacttctagccagcagaaaaccgactggatacctctagctctgacgattaagggacttaaccccacagcgatcttcctcaccactctgtccagaaccaataaaaagaggtcatggccattgaacgaggccatcatggcagtcggcatggtgagcattctggctagttctttactcaagaatgacataccgatgacaggccctctggtagccgggggacttctgactgtgtgctatgtcttgaccggtcgctccgccgatctcgaactggagcgggctacggacgttaaatgggaggatcaggcagaaatcagcggctcgtcacccattctatctatcacaattagtgaggacgggtccatgagcatcaagaacgaagaggaggaacagaccctgactatacttatcagaacaggactcctggtgatttctggcttgtttccaatcagcattcccatcaccgccgcggcttggtacttatgggaggtgaaaaagcagagggccggtgtcctgtgggatgtgccttccccaccccctatggggaaagcagaactcgaggacggagcctatcgaataaagcaaaagggcattctgggctactcacagatcggggctggagtttacaaagaaggtactttccacacaatgtggcatgtaacccgcggcgcagtgcttatgcacaaggggaaacggatcgagccgagttgggccgatgtcaagaaagacctgattagctatggaggcggttggaagttggagggggaatggaaggagggagaagaggtgcaggttctagcgctggaaccaggcaaaaatcccagagctgtgcagacgaagcctggcctctttaaaactaacaccgggacaatcggagccgtctctctggatttctccccaggtacctcaggcagtcccataattgacaagaaagggaaggtggtaggactttacggcaacggtgtcgtgacaaggagcggggcatatgtttccgccatcgctcaaactgagaagtctattgaggataatcctgaaatcgaggacgatatatttcgtaaacgccggttaaccattatggacctgcacccgggagccggcaagacgaaaagatacctccccgcaatcgtgagggaagctatcaagcgaggcttgcggacactgattctcgccccaactcgcgtcgtggcggccgagatggaagaggcactgagagggcttcctatcaggtatcagacccccgctattcgggccgagcatacaggacgagaaatagttgacctgatgtgtcacgctaccttcactatgagattgctatcgccagtgcgcgtccctaactacaatctgatcattatggatgaggcacatttcaccgaccccgccagcatcgccgctaggggttatatctcaacacgtgtggaaatgggcgaggcggcagggatttttatgacggccactccaccgggatcccgggatcctttcccccagagtaacgctccaataatcgacgaggaaagagagattcccgaaaggtcttggaataccggccacgagtgggtaacagattttaaaggtaagaccgtgtggttcgttcctagcatcaaggccgggaacgacattgcagcctgcctccgcaaaaatggaaagaaagtcatccaattatcccgaaagacttttgattcagaatacgtgaaaacaagaaccaacgactgggatttcgtggtcacgactgacatatctgagatgggcgctaattttaaggcggagcgggtaatcgatccaaggcgctgtatgaaacccgtgattctgacagacggcgaagaacgtgttatccttgccgggcctatgccggtgacccatagcagtgcagctcagagacggggaaggattggtcgcaacccaaagaatgaaaacgaccagtacatctatatgggcgagcccctggaaaatgatgaggactgcgcccactggaaggaggcaaaaatgctcttggataacataaatacccctgaagggattatcccctccatgttcgagccagaacgagagaaggtcgacgccattgatggagaatacagactgcggggcgaggctaggaaaacttttgtggacctcatgcgcagaggtgatctgcctgtttggcttgcctataaggtggcggcagaggggatcaactacgccgacaggcggtggtgtttcgatggcatcaaaaacaatcagatcctagaagagaacgtcgaagtggagatttggacaaaggagggagaacgtaagaaactgaagccccgctggttggacgctcgaatctatagcgatccattagccctgaaagagtttaaggagttcgctgcaggcagaaaatctctcaccctgaatcttattacagagatggggaggctgcctactttcatgacgcaaaagacccgggacgccctcgataacttggctgtactgcacacagccgaagcaggaggtcgcgcgtacaatcatgccctatcagagctgccggagactctcgaaacccttctgttattgacactgctcgctaccgtgactggcgggatctttctgttccttatgtccggaagaggcataggtaagatgacgctggggatgtgctgcattatcaccgccagtatcctcttgtggtatgcacagattcagccccactggatcgctgccagcataattctggagtttttcttaatcgttctactgattccagaacctgagaaacagaggacaccccaagacaaccagctcacttacgtcgtgatcgcaatacttaccgtggtcgccgctacaatggcgaatgaaatgggctttctggagaagaccaaaaaggacttgggactgggctcgatcgccactcagcagccagagtctaacattctcgatatcgacctgcggcctgcatccgcttggacactttacgccgttgccacgaccttcgtgactcccatgctccgacatagcattgaaaattcaagtgtaaacgtgtctctgacagcaatcgctaatcaagccaccgtcttgatggggctgggaaaaggttggccgttatccaagatggatattggcgtgccactactggcgatcgggtgttatagccaggttaaccctataaccctcacagctgcccttctgttgctggtggcacactacgccattatcggacccggcctccaggctaaggcaactagagaggcccagaaacgcgcggctgccggtatcatgaagaatccaacggtcgacgggattaccgtaatagatctggaccccatcccttatgatccgaaatttgaaaagcaacttggccaggtgatgttactgattctctgcgttacacaggtgttgatgatgaggactacctgggcactgtgtgaggccctaacactggctaccggacccatctcaactctctgggaaggcaacccagggcggttctggaatacgacaattgccgtcagtatggcaaacatctttcgtggaagctaccttgctggcgccggtctgttgttctccataatgaaaaataccactaacaccagaagggggacaggaaacatcggcgagactctgggtgagaagtggaaatctcgcctcaatgcgctgggcaagagcgaatttcaaatttataagaaatccgggatccaggaggtggaccggaccttagccaaggaaggaattaaacgaggcgagacagatcaccatgcagtctcaagagggtctgctaaacttaggtggttcgtggagcgcaacatggttacgcctgaaggaaaagtggtagacctgggctgcggtagagggggatggagttactattgtggcggtctcaagaatgtgagagaggtcaagggcctaaccaaagggggacccggccacgaggaacctatcccaatgtcgacttacgggtggaacctggttcgtttgcagagcggagtggatgtctttttcataccccctgaaaagtgcgacacactgctctgtgatattggcgagtcctctccaaatcccaccgtggaggccggtaggactcttcgggtactgaacttggtggaaaattggctgaacaataacacacagttctgcatcaaagttctcaatccgtacatgccttcagtgatcgagaagatggaagcattacaacgcaaatatgggggagctctggtccgaaacccacttagcagaaattccacccatgagatgtactgggtgagtaacgcctctggcaatattgtcagctcagtgaacatgatatccaggatgctgatcaaccggtttacgatgcgccacaagaaggccacctatgaacccgacgttgacctaggcagtgggacaagaaatattggaatcgagagcgagattcctaacctcgatatcataggtaaaaggatcgaaaagattaaacaggagcatgaaacttcttggcactacgaccaggatcacccatataagacctgggcgtaccatggctcctatgagacaaaacagactgggtcagctagctcgatggtaaatggagtggtccgactgttgaccaagccctgggacgtgctgccgacagttacccaaatggcaatgactgatacgacacctttcggccagcagcgggtgtttaaggaaaaagtcgacacccgtactcaggagcccaaggagggtaccaaaaagctcatgaaaatcacagccgaatggctttggaaggagctggggaaaaagaagacgccaagaatgtgtacccgcgaagagttcactaggaaagtgcggtctaacgctgccttaggagcaatttttacagatgagaataagtggaaaagtgccagagaagctgtagaggactcccgcttctgggaactggtggataaggagaggaacttgcacctcgaaggcaaatgcgagacctgtgtttacaatatgatgggcaagcgagagaagaaactgggggaatttggaaaggcgaaaggtagccgggccatctggtacatgtggctaggcgcaagattccttgagtttgaagctctggggttcctcaacgaggaccattggttttcaagggaaaattccctgtctggagtcgagggcgagggtttgcacaagctggggtatattctccgcgatgtgagcaaaaaggaaggaggcgccatgtacgcagacgacactgccggctgggatacacgtataacccttgaggacctgaagaacgaagagatggtgacaaatcacatggaaggggagcataaaaagttagctgaggccatcttcaaactgacttatcaaaacaaggtcgttcgggtgcagagacctacccccaggggaacggtaatggatattatcagtcgccgagaccagcggggttccggccaagtggggacctacggattgaatacatttactaacatggaagcgcagctcatcagacagatggagggcgaaggtgtcttcaaaaatattcagcacctgaccgtgacagaggaggttgcagtgcaaaactggctagccagggtcgggcgcgaaagacttagccggatggctatatctggagatgactgcgtggtaaagccactggatgacaggttcgccaacgcactcactgctctgaatgatatgggcaagatccgtaaagacattcagcagtgggagccctcaaagggctggaacgattggacccaggttcctttttgcagtcatcacttccatgaattgatcatgaaagacgggcgagtgttagtcgtgccatgtcgcaatcaagatgagctgattggacgggcccggatctcccagggtgctggctggagcctcagggaaacggcctgccttgggaagtcttatgcacagatgtggtcgctgatgtactttcaccgcagagacctacggctggcggccaacgctatatgttcagccgtgccgagccactgggtccccacatccaggaccacttggagtatccatgcaaaacacgagtggatgacaaccgaggacatgctcactgtttggaatcgagtgtggattcgtgaaaacccttggatggaggataagaccccagtagaatcttgggaggaaatcccctatttgggaaagagagaggaccagtggtgcggcagcctgattggtcttacatcccgcgctacgtgggccaaaaatatccaagcagccataaaccaggtgcggtcactgattgggaatgaggaatacaccgattacatgcctagtatgaagaggttcagacgcgaggaagaggaagcgggagtcctctggtga

SEQ ID NO: 14767 - RNA, 9876 nt, synthetic construct
  misc_feature 1..9876: note = derived and/or modified CDS sequence (opt3) from DENV-2__EU482446__SS-prME
  source 1..9876: mol_type = other RNA
agcgccggcatgataattatgctgatacccaccgtgatggctttccacctcactactagaaacggggagcctcatatgatcgtcggtattcaagaaaaaggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactacagagtgccccaataccaacagagcctggaatagtctggaagtggaggattacggatttggcgtgttcacaactaacatctggctcaagctgaaagaaaagcaggacgcattttgtgactctaagttaatgagcgcggctattaaagataatagggccgtacatgcagacatgggttattggatcgagtccgccctgaacgatacctggaagatagagaaggcttcattcattgaagtcaagaattgccactggcctaaaagccatacgctttggtctaacggggtgttggagtccgaaatgatcatcccaaagaacctcgccggacccgttagtcaacacaattaccgtcctggctaccacacacagattgcaggtccatggcatctgggcaagctagagatggacttcgatttttgtgacgggaccactgtgatcgtcaccgaagattgcggaaaccggggccccagcctgcgaacaactaccgcttctgggaaactcattacagagtggtgctgtagatcctgcacgctgccgcctcttaggtatcgcggagaggacggctgttggtacggtatggaaatacggccattgaaggagaaagaagagaatctggtgaactcattagttaccgccgggcacggacaggtggataatttcagtctcggcgtactgggtatggcgctttttctggaagagatgttgagaactagggtcggcacaaagcatgccatcctcctggtggctgtgagcttcgtcaccctaattactgggaacatgtcgtttaaagacctgggacgcgttgtggtaatggtgggcgcaacaatggccgatgacatcgggatgggagtcacctatctcgctctgcttgccgcattcaaggtgcgacccacgtttgcggccggcttgctgttacggaagctcacttccaaagagctgatgatgaccacaattggtatcgttcttctgtctcaaagcaccatacctgaaactgtgctagagctcacagatgctctggccttggggatgatggtcctgaagatcgtgcgtaatatggaaaaataccagttagcagttaccattatggctatcctctgcgtgcccaacgccgtcattctgcagaatgcatggaaggtatcatgtacaatccttgccgtggttagtgtgtccccactgttgctcacttctagccagcagaaaaccgactggatacctctggctctaacgattaagggactgaaccccacagcgatcttccttaccactctctccagaaccaataaaaagaggtcatggccactgaacgaggccatcatggcagtcggcatggtgagcattttggctagttctctgttaaagaatgacataccgatgacaggccctctcgtagccgggggactgcttactgtgtgctatgtcctgaccggtcgctccgccgatttggaactcgagcgggctacggacgttaaatgggaggatcaggcagaaatcagcggctcgtcacccattctgtctatcacaattagtgaggacgggtccatgagcatcaagaacgaagaggaggaacagaccctaactatactgatcagaacaggacttctcgtgatttctggcctgtttccaatcagcattcccatcaccgccgcggcttggtacttgtgggaggtgaaaaagcagagggccggtgtcttatgggatgtgccttccccaccccctatggggaaagcagaactggaggacggagcctatcgaataaagcaaaagggcattctcggctactcacagatcggggctggagtttacaaagaaggtactttccacacaatgtggcatgtaacccgcggcgcagtgctgatgcacaaggggaaacggatcgagccgagttgggccgatgtcaagaaagaccttattagctatggaggcggttggaagctggagggggaatggaaggagggagaagaggtgcaggttttggcgctagaaccaggcaaaaatcccagagctgtgcagacgaagcctggcctgtttaaaactaacaccgggacaatcggagccgtctctctcgatttctccccaggtacctcaggcagtcccataattgacaagaaagggaaggtggtaggactgtacggcaacggtgtcgtgacaaggagcggggcatatgtttccgccatcgctcaaactgagaagtctattgaggataatcctgaaatcgaggacgatatatttcgtaaacgccggcttaccattatggacttacacccgggagccggcaagacgaaaagatacctgcccgcaatcgtgagggaagctatcaagcgaggcctccggacattgattctggccccaactcgcgtcgtggcggccgagatggaagaggcactcagagggctgcctatcaggtatcagacccccgctattcgggccgagcatacaggacgagaaatagttgaccttatgtgtcacgctaccttcactatgagactgttgtcgccagtgcgcgtccctaactacaatctaatcattatggatgaggcacatttcaccgaccccgccagcatcgccgctaggggttatatctcaacacgtgtggaaatgggcgaggcggcagggatttttatgacggccactccaccgggatcccgggatcctttcccccagagtaacgctccaataatcgacgaggaaagagagattcccgaaaggtcttggaataccggccacgagtgggtaacagattttaaaggtaagaccgtgtggttcgttcctagcatcaaggccgggaacgacattgcagcctgcctgcgcaaaaatggaaagaaagtcatccaactctcccgaaagacttttgattcagaatacgtgaaaacaagaaccaacgactgggatttcgtggtcacgactgacatatctgagatgggcgctaattttaaggcggagcgggtaatcgatccaaggcgctgtatgaaacccgtgattttaacagacggcgaagaacgtgttatcctggccgggcctatgccggtgacccatagcagtgcagctcagagacggggaaggattggtcgcaacccaaagaatgaaaacgaccagtacatctatatgggcgagccccttgaaaatgatgaggactgcgcccactggaaggaggcaaaaatgctgctcgataacataaatacccctgaagggattatcccctccatgttcgagccagaacgagagaaggtcgacgccattgatggagaatacagattgcggggcgaggctaggaaaacttttgtggacctgatgcgcagaggtgatctccctgtttggctggcctataaggtggcggcagaggggatcaactacgccgacaggcggtggtgtttcgatggcatcaaaaacaatcagatccttgaagagaacgtcgaagtggagatttggacaaaggagggagaacgtaagaaactaaagccccgctggctggacgctcgaatctatagcgatccattggccttaaaagagtttaaggagttcgctgcaggcagaaaatctctgaccctcaatctgattacagagatggggaggcttcctactttcatgacgcaaaagacccgggacgccctggataacctcgctgtattgcacacagccgaagcaggaggtcgcgcgtacaatcatgccctgtcagagctaccggagactctggaaaccctccttctgttaacattgctggctaccgtgactggcgggatctttctcttcctgatgtccggaagaggcataggtaagatgacgcttgggatgtgctgcattatcaccgccagtatcctgctctggtatgcacagattcagccccactggatcgctgccagcataattttggagtttttcctgatcgttttactaattccagaacctgagaaacagaggacaccccaagacaaccagctgacttacgtcgtgatcgcaatactcaccgtggtcgccgctacaatggcgaatgaaatgggctttcttgagaagaccaaaaaggacctgggattgggctcgatcgccactcagcagccagagtctaacattctggatatcgacctccggcctgcatccgcttggacactgtacgccgttgccacgaccttcgtgactcccatgcttcgacatagcattgaaaattcaagtgtaaacgtgtctctcacagcaatcgctaatcaagccaccgtcctgatggggttgggaaaaggttggccgctgtccaagatggatattggcgtgccattactagcgatcgggtgttatagccaggttaaccctataaccctgacagctgccctccttctgttggtggcacactacgccattatcggacccggcctgcaggctaaggcaactagagaggcccagaaacgcgcggctgccggtatcatgaagaatccaacggtcgacgggattaccgtaatagatctcgaccccatcccttatgatccgaaatttgaaaagcaactgggccaggtgatgcttttaattctgtgcgttacacaggtgctcatgatgaggactacctgggcattgtgtgaggccctgacactagctaccggacccatctcaactctgtgggaaggcaacccagggcggttctggaatacgacaattgccgtcagtatggcaaacatctttcgtggaagctacctcgctggcgccggtcttctgttctccataatgaaaaataccactaacaccagaagggggacaggaaacatcggcgagactttgggtgagaagtggaaatctcgcctgaatgcgctcggcaagagcgaatttcaaatttataagaaatccgggatccaggaggtggaccggaccctggccaaggaaggaattaaacgaggcgagacagatcaccatgcagtctcaagagggtctgctaagttaaggtggttcgtggagcgcaacatggttacgcctgaaggaaaagtggtagaccttggctgcggtagagggggatggagttactattgtggcggtctgaagaatgtgagagaggtcaagggcctcaccaaagggggacccggccacgaggaacctatcccaatgtcgacttacgggtggaacctagttcgtctgcagagcggagtggatgtctttttcataccccctgaaaagtgcgacacattgctgtgtgatattggcgagtcctctccaaatcccaccgtggaggccggtaggactctccgggtacttaacctggtggaaaattggttgaacaataacacacagttctgcatcaaagttctgaatccgtacatgccttcagtgatcgagaagatggaagcactccaacgcaaatatgggggagctttagtccgaaacccactgagcagaaattccacccatgagatgtactgggtgagtaacgcctctggcaatattgtcagctcagtgaacatgatatccaggatgcttatcaaccggtttacgatgcgccacaagaaggccacctatgaacccgacgttgacctgggcagtgggacaagaaatattggaatcgagagcgagattcctaacctagatatcataggtaaaaggatcgaaaagattaaacaggagcatgaaacttcttggcactacgaccaggatcacccatataagacctgggcgtaccatggctcctatgagacaaaacagactgggtcagctagctcgatggtaaatggagtggtccgactcctgaccaagccctgggacgtgttgccgacagttacccaaatggcaatgactgatacgacacctttcggccagcagcgggtgtttaaggaaaaagtcgacacccgtactcaggagcccaaggagggtaccaaaaagctgatgaaaatcacagccgaatggctctggaaggagcttgggaaaaagaagacgccaagaatgtgtacccgcgaagagttcactaggaaagtgcggtctaacgctgccctgggagcaatttttacagatgagaataagtggaaaagtgccagagaagctgtagaggactcccgcttctgggaattagtggataaggagaggaacctgcacttggaaggcaaatgcgagacctgtgtttacaatatgatgggcaagcgagagaagaaactcggggaatttggaaaggcgaaaggtagccgggccatctggtacatgtggctgggcgcaagattcctagagtttgaagctcttgggttcctgaacgaggaccattggttttcaagggaaaattccctctctggagtcgagggcgagggtctgcacaagttggggtatattctgcgcgatgtgagcaaaaaggaaggaggcgccatgtacgcagacgacactgccggctgggatacacgtataaccctcgaggaccttaagaacgaagagatggtgacaaatcacatggaaggggagcataaaaagctggctgaggccatcttcaaattaacttatcaaaacaaggtcgttcgggtgcagagacctacccccaggggaacggtaatggatattatcagtcgccgagaccagcggggttccggccaagtggggacctacggactgaatacatttactaacatggaagcgcagttgatcagacagatggagggcgaaggtgtcttcaaaaatattcagcacctcaccgtgacagaggaggttgcagtgcaaaactggctggccagggtcgggcgcgaaagactaagccggatggctatatctggagatgactgcgtggtaaagccacttgatgacaggttcgccaacgcactgactgctctcaatgatatgggcaagatccgtaaagacattcagcagtgggagccctcaaagggctggaacgattggacccaggttcctttttgcagtcatcacttccatgaactgatcatgaaagacgggcgagtgttggtcgtgccatgtcgcaatcaagatgagttaattggacgggcccggatctcccagggtgctggctggagcctgagggaaacggcctgcctcgggaagtcttatgcacagatgtggtcgcttatgtactttcaccgcagagacctgcggctagcggccaacgctatatgttcagccgtgccgagccactgggtccccacatccaggaccacttggagtatccatgcaaaacacgagtggatgacaaccgaggacatgctgactgtttggaatcgagtgtggattcgtgaaaacccttggatggaggataagaccccagtagaatcttgggaggaaatcccctatctcggaaagagagaggaccagtggtgcggcagcttgattggtctgacatcccgcgctacgtgggccaaaaatatccaagcagccataaaccaggtgcggtcacttattgggaatgaggaatacaccgattacatgcctagtatgaagaggttcagacgcgaggaagaggaagcgggagtcctgtggtga

SEQ ID NO: 14768 - RNA, 9876 nt, synthetic construct
  misc_feature 1..9876: note = derived and/or modified CDS sequence (opt3) from DENV-2__EU482448__SS-prME
  source 1..9876: mol_type = other RNA
agcgccggcatgataattatgctgatacccaccgtgatggctttccacctcactactagaaacggggagcctcatatgatcgtcggtattcaagaaaaaggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactacagagtgccccaataccaacagagcctggaatagtctggaagtggaggattacggatttggcgtgttcacaactaacatctggctcaagctgaaagaaaagcaggacgcattttgtgactctaagttaatgagcgcggctattaaagataatagggccgtacatgcagacatgggttattggatcgagtccgccctgaacgatacctggaagatagagaaggcttcattcattgaagtcaagaattgccactggcctaaaagccatacgctttggtctaacggggtgttggagtccgaaatgatcatcccaaagaacctcgccggacccgttagtcaacacaattaccgtcctggctaccacacacagattgcaggtccatggcatctgggcaagctagagatggacttcgatttttgtgacgggaccactgtgatcgtcaccgaagattgcggaaaccggggccccagcctgcgaacaactaccgcttctgggaaactcattacagagtggtgctgtagatcctgcacgctgccgcctcttaggtatcgcggagaggacggctgttggtacggtatggaaatacggccattgaaggagaaagaagagaatctggtgaactcattagttaccgccgggcacggacaggtggataatttcagtctcggcgtactgggtatggcgctttttctggaagagatgttgagaactagggtcggcacaaagcatgccatcctcctggtggctgtgagcttcgtcaccctaattactgggaacatgtcgtttaaagacctgggacgcgttgtggtaatggtgggcgcaacaatggccgatgacatcgggatgggagtcacctatctcgctctgcttgccgcattcaaggtgcgacccacgtttgcggccggcttgctgttacggaagctcacttccaaagagctgatgatgaccacaattggtatcgttcttctgtctcaaagcaccatacctgaaactgtgctagagctcacagatgctctggccttggggatgatggtcctgaagatcgtgcgtaatatggaaaaataccagttagcagttaccattatggctatcctctgcgtgcccaacgccgtcattctgcagaatgcatggaaggtatcatgtacaatccttgccgtggttagtgtgtccccactgttgctcacttctagccagcagaaaaccgactggatacctctggctctaacgattaagggactgaaccccacagcgatcttccttaccactctctccagaaccaataaaaagaggtcatggccactgaacgaggccatcatggcagtcggcatggtgagcattttggctagttctctgttaaagaatgacataccgatgacaggccctctcgtagccgggggactgcttactgtgtgctatgtcctgaccggtcgctccgccgatttggaactcgagcgggctacggacgttaaatgggaggatcaggcagaaatcagcggctcgtcacccattctgtctatcacaattagtgaggacgggtccatgagcatcaagaacgaagaggaggaacagaccctaactatactgatcagaacaggacttctcgtgatttctggcctgtttccaatcagcattcccatcaccgccgcggcttggtacttgtgggaggtgaaaaagcagagggccggtgtcttatgggatgtgccttccccaccccctatggggaaagcagaactggaggacggagcctatcgaataaagcaaaagggcattctcggctactcacagatcggggctggagtttacaaagaaggtactttccacacaatgtggcatgtaacccgcggcgcagtgctgatgcacaaggggaaacggatcgagccgagttgggccgatgtcaagaaagaccttattagctatggaggcggttggaagctggagggggaatggaaggagggagaagaggtgcaggttttggcgctagaaccaggcaaaaatcccagagctgtgcagacgaagcctggcctgtttaaaactaacaccgggacaatcggagccgtctctctcgatttctccccaggtacctcaggcagtcccataattgacaagaaagggaaggtggtaggactgtacggcaacggtgtcgtgacaaggagcggggcatatgtttccgccatcgctcaaactgagaagtctattgaggataatcctgaaatcgaggacgatatatttcgtaaacgccggcttaccattatggacttacacccgggagccggcaagacgaaaagatacctgcccgcaatcgtgagggaagctatcaagcgaggcctccggacattgattctggccccaactcgcgtcgtggcggccgagatggaagaggcactcagagggctgcctatcaggtatcagacccccgctattcgggccgagcatacaggacgagaaatagttgaccttatgtgtcacgctaccttcactatgagactgttgtcgccagtgcgcgtccctaactacaatctaatcattatggatgaggcacatttcaccgaccccgccagcatcgccgctaggggttatatctcaacacgtgtggaaatgggcgaggcggcagggatttttatgacggccactccaccgggatcccgggatcctttcccccagagtaacgctccaataatcgacgaggaaagagagattcccgaaaggtcttggaataccggccacgagtgggtaacagattttaaaggtaagaccgtgtggttcgttcctagcatcaaggccgggaacgacattgcagcctgcctgcgcaaaaatggaaagaaagtcatccaactctcccgaaagacttttgattcagaatacgtgaaaacaagaaccaacgactgggatttcgtggtcacgactgacatatctgagatgggcgctaattttaaggcggagcgggtaatcgatccaaggcgctgtatgaaacccgtgattttaacagacggcgaagaacgtgttatcctggccgggcctatgccggtgacccatagcagtgcagctcagagacggggaaggattggtcgcaacccaaagaatgaaaacgaccagtacatctatatgggcgagccccttgaaaatgatgaggactgcgcccactggaaggaggcaaaaatgctgctcgataacataaatacccctgaagggattatcccctccatgttcgagccagaacgagagaaggtcgacgccattgatggagaatacagattgcggggcgaggctaggaaaacttttgtggacctgatgcgcagaggtgatctccctgtttggctggcctataaggtggcggcagaggggatcaactacgccgacaggcggtggtgtttcgatggcatcaaaaacaatcagatccttgaagagaacgtcgaagtggagatttggacaaaggagggagaacgtaagaaactaaagccccgctggctggacgctcgaatctatagcgatccattggccttaaaagagtttaaggagttcgctgcaggcagaaaatctctgaccctcaatctgattacagagatggggaggcttcctactttcatgacgcaaaagacccgggacgccctggataacctcgctgtattgcacacagccgaagcaggaggtcgcgcgtacaatcatgccctgtcagagctaccggagactctggaaaccctccttctgttaacattgctggctaccgtgactggcgggatctttctcttcctgatgtccggaagaggcataggtaagatgacgcttgggatgtgctgcattatcaccgccagtatcctgctctggtatgcacagattcagccccactggatcgctgccagcataattttggagtttttcctgatcgttttactaattccagaacctgagaaacagaggacaccccaagacaaccagctgacttacgtcgtgatcgcaatactcaccgtggtcgccgctacaatggcgaatgaaatgggctttcttgagaagaccaaaaaggacctgggattgggctcgatcgccactcagcagccagagtctaacattctggatatcgacctccggcctgcatccgcttggacactgtacgccgttgccacgaccttcgtgactcccatgcttcgacatagcattgaaaattcaagtgtaaacgtgtctctcacagcaatcgctaatcaagccaccgtcctgatggggttgggaaaaggttggccgctgtccaagatggatattggcgtgccattactagcgatcgggtgttatagccaggttaaccctataaccctgacagctgccctccttctgttggtggcacactacgccattatcggacccggcctgcaggctaaggcaactagagaggcccagaaacgcgcggctgccggtatcatgaagaatccaacggtcgacgggattaccgtaatagatctcgaccccatcccttatgatccgaaatttgaaaagcaactgggccaggtgatgcttttaattctgtgcgttacacaggtgctcatgatgaggactacctgggcattgtgtgaggccctgacactagctaccggacccatctcaactctgtgggaaggcaacccagggcggttctggaatacgacaattgccgtcagtatggcaaacatctttcgtggaagctacctcgctggcgccggtcttctgttctccataatgaaaaataccactaacaccagaagggggacaggaaacatcggcgagactttgggtgagaagtggaaatctcgcctgaatgcgctcggcaagagcgaatttcaaatttataagaaatccgggatccaggaggtggaccggaccctggccaaggaaggaattaaacgaggcgagacagatcaccatgcagtctcaagagggtctgctaagttaaggtggttcgtggagcgcaacatggttacgcctgaaggaaaagtggtagaccttggctgcggtagagggggatggagttactattgtggcggtctgaagaatgtgagagaggtcaagggcctcaccaaagggggacccggccacgaggaacctatcccaatgtcgacttacgggtggaacctagttcgtctgcagagcggagtggatgtctttttcataccccctgaaaagtgcgacacattgctgtgtgatattggcgagtcctctccaaatcccaccgtggaggccggtaggactctccgggtacttaacctggtggaaaattggttgaacaataacacacagttctgcatcaaagttctgaatccgtacatgccttcagtgatcgagaagatggaagcactccaacgcaaatatgggggagctttagtccgaaacccactgagcagaaattccacccatgagatgtactgggtgagtaacgcctctggcaatattgtcagctcagtgaacatgatatccaggatgcttatcaaccggtttacgatgcgccacaagaaggccacctatgaacccgacgttgacctgggcagtgggacaagaaatattggaatcgagagcgagattcctaacctagatatcataggtaaaaggatcgaaaagattaaacaggagcatgaaatctcttggcactacgaccaggatcacccatataagacttgggcgtaccatggctcctatgagaccaaacagacagggtcagctagctcgatggtaaatggagtggtccgactcctgactaagccctgggacgtgttgccgaccgttacacaaatggcaatgaccgatactacgcctttcggccagcagcgggtgtttaaggaaaaagtcgacacacgtacccaggagcccaaggagggtactaaaaagctgatgaaaattaccgccgaatggctctggaaggagcttgggaaaaagaagacaccaagaatgtgtacgcgcgaagagttcaccaggaaagtgcggtctaacgctgccctgggagcaatctttactgatgagaataagtggaaaagtgccagagaagctgtagaggactcccgcttctgggaattagtggataaggagaggaacctgcacttggaaggcaaatgcgagacatgtgtttacaatatgatgggcaagcgagagaagaaactcggggaatttggaaaggcgaaaggtagccgggccatttggtacatgtggctgggcgcaagattcctagagtttgaagctcttgggttcctgaacgaggaccattggttttcaagggaaaattccctctctggagtcgagggcgagggtctgcacaagttggggtatatactgcgcgatgtgagcaaaaaggaaggaggcgccatgtacgcagacgacaccgccggctgggatactcgtatcacactcgaggaccttaagaacgaagagatggtgaccaatcacatggaaggggagcataaaaagctggctgaggccattttcaaattaacatatcaaaacaaggtcgttcgggtgcagagacctactcccaggggaaccgtaatggatatcatcagtcgccgagaccagcggggttccggccaagtggggacgtacggactgaatacctttacaaacatggaagcgcagttgattagacagatggagggcgaaggtgtcttcaaaaatatacagcacctcactgtgaccgaggaggttgcagtgcaaaactggctggccagggtcgggcgcgaaagactaagccggatggctatctctggagatgactgcgtggtaaagccacttgatgacaggttcgccaacgcactgacagctctcaatgatatgggcaagattcgtaaagacatccagcagtgggagccctcaaagggctggaacgattggactcaggttcctttttgcagtcatcacttccatgaactgattatgaaagacgggcgagtgttggtcgtgccatgtcgcaatcaagatgagttaatcggacgggcccggatatcccagggtgctggctggagcctgagggaaaccgcctgcctcgggaagtcttatgcacagatgtggtcgcttatgtactttcaccgcagagacctgcggctagcggccaacgctatctgttcagccgtgccgagccactgggtccccacgtccaggacaacctggagtattcatgcaaaacacgagtggatgactacagaggacatgctgaccgtttggaatcgagtgtggatccgtgaaaacccttggatggaggataagactccagtagaatcttgggaggaaattccctatctcggaaagagagaggaccagtggtgcggcagcttgatcggtctgacctcccgcgctacatgggccaaaaatatacaagcagccattaaccaggtgcggtcacttatcgggaatgaggaatacacggattacatgcctagtatgaagaggttcagacgcgaggaagaggaagcgggagtcctgtggtga

SEQ ID NO: 14769 - RNA, 9876 nt, synthetic construct
  misc_feature 1..9876: note = derived and/or modified CDS sequence (opt3) from DENV-2__EU482449__SS-prME
  source 1..9876: mol_type = other RNA
accgccggagtgataattatgctgatacccacagctatggcattccacctcactacgaggaacggggagcctcatatgatcgtcgggaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtggcgctggtgccccatgtcggtatggggcttgagacccggacagaaacttggatgagtagcgagggagcttggaaacacgcccagaggatcgagacctggatactgcggcatcctggcttcacaatcatggcagccattttggcttacaccatcggcacgactcactttcagcgcgcactcattttcatcctgctgacagccgtggctccatccatgaccatgagatgcatagggatttctaacagggattttgttgaaggagtgtcgggtggctcatgggtcgacatcgtgctcgagcacgggagctgtgtaactacaatggccaagaataagcccaccttagatttcgaactgattaaaacggaggcgaagcagcctgcaacccttcggaaatattgcatcgaagccaagttgacaaacactaccacagagagtcgctgtccaactcaaggagagccctccctgaatgaagaacaggacaaacgatttgtttgcaagcattctatggtggatagaggctggggtaacgggtgtggactgttcggcaagggcgggatcgtcacatgcgctatgtttacatgcaaaaagaatatggaaggaaaaattgtgcagcctgagaacctcgaatacaccatagtgatcactccacacagcggtgaggagcatgccgtcggcaatgacacggggaagcacggaaaagaaattaagatcacaccgcagtcctcaaacaccgaggcagaactgactggctatggtaccgttacaatggagtgtagtcccaggaccgggcttgatttcaatgaaatggtgctgttgcaaatggaggacaaggcttggctcgtacaccggcagtggtttctggatttacctctgccatggctccccggcgccgacactcagggaagcaactggatacagaaggagacacttgtgacgttcaagaatcctcatgcgaaaaagcaagacgtcgtggttctgggctctcaggaaggggccatgcacaccgcattgactggagctacagagattcagatgtcctcaggtaacctactgtttaccggccatctcaaatgccgtctgcgcatggataaacttcaactgaaagggatgagctacagtatgtgtacaggaaagttcaagatcgtgaaagaaatcgccgagactcagcacggcaccattgtcatcagagtgcagtatgagggtgacgggtctccatgcaagattcccttcgaaataatggatttggagaaaaggcatgtactcggccggctgatcacggttaacccgattgtgaccgaaaaggactcccctgtcaatatcgaggctgaacccccatttggagatagctacatcattataggcgtggagcctgggcagttaaaactgaactggttcaagaagggatcgtctatcggtcaaatgtttgagacaactatgcgaggcgccaaacgcatggcaattctaggggacaccgcctgggatttcggatccctcggcggtgtctttacatcaatcgggaaggctctgcaccaggtgttcggcgcgatttacggagcagcctttagtggcgttagctggactatgaaaatccttataggggctatcattacctggatcggaatgaactccagatctacgagcttgtcagtgagtctggtactcgtcggcgtgattacactgtatcttggtgccatggttcaggcagactccgggtgtgtggtcagctggaagaacaaagaactgaagtgcggatctggcatcttcataaccgataatgtgcacacttggacagagcagtacaagtttcaacccgaatcaccaagtaaattggccagcgctattcagaaggcccatgaggaaggtatctgtggcattaggtccgtaacccggctcgagaacctgatgtggaaacagatcactcccgagttaaatcacatactgtctgaaaacgaggtgaagctaaccatcatgacaggggacattaaaggaatcatgcaggcaggcaagcgctcgctcagacctcaaccaacggaactgaaatatagctggaagacctgggggaaggcgaaaatgctttccactgagtcacataatcagacattcttgattgatggaccggaaaccgctgagtgccccaacacaaatagggcctggaacagtctggaggttgaagactacggctttggtgtcttcactaccaatatctggctcaagctgcgtgagaaacaggacgtgttttgtgattctaagttaatgagcgcagccataaaagacaaccgggctgtgcacgccgatatggggtattggattgaatccgcactgaatgacacgtggaagatggagaaggcttcattcatcgaggtcaaaagctgccactggcctaagtctcatacactttggtccaacggagttttggaaagtgagatgatcattccaaagagcttcgccggccccgtgtctcagcacaactaccgacctggttattacacccaaactgcgggcccatggcatctcgggaagctggaaatggattttgacttctgtgagggaaccacagtggtagtcactgaagattgcggcaatagagggccctccctaaggaccacaacggcctcaggaaaactgatcaccgagtggtgctgtcgcagttgcactctcccgcctctgcggtacagaggcgaggacggttgttggtatgggatggaaattaggccacttaaggagaaggaagagaacttggtgaatagcctggttacagctggacacggccagatagataacttttcgttaggtgtgctcggcatggcactgttccttgaagagatgctgcgcacccgagtcgggactaaacatgccatcttgctcgtggctgtttcctttatgacactgattaccggaaatatgtctttccgggacctaggccgtgtgatggtaatggtcggggccacgatgactgatgacatcggaatgggcgtgacctacctggcactcctggcggcctttaaggtgagacccacattcgctgccggtcttttgctgaggaaattaaccagcaaggagctcatgatggcaactattgggatcgctctgctttcacagagtacaatacctgaaaccatcctggagctaacagatgccctcgcactgggaatgatggtcttgaaaattgttcgcaacatggaaaagtatcaactggccgtgactatcatggctatttcctgcgtacccaatgcggtgatcttacagaacgcctggaaggtctcttgtaccatactcgcagctgtgagcgtttccccactgcttctgacgtcaagccagcagaaagccgactggattcctttggccctcacaatcaagggcctgaatcccaccgctatctttctaactaccctgagtcggacatctaaaaagagatcctggccacttaacgaggcaattatggccgtgggcatggtcagcatactcgcgtcgtcactgttgaaaaatgacatcccgatgactgggcctctggtggctggaggtttactcaccgtttgctacgtgctgacgggcaggtctgccgatcttgaactggagcgagcaacagacgtcaagtgggaggatcaagccgaaattagtgggtccagccccatcttgtctattaccatcagcgaggacggatccatgtcaatcaagaatgaagaggaggaacagactctcacaatcctgattcgcaccggcctactggtaatcagtggtcttttcccagtgagcattcccatcactgctgcagcctggtatctctgggaggttaagaagcagcgggcgggggtgctgtgggatgtcccttctccaccccctgtgggaaaagctgaattggaggacggcgcctacagaataaagcagaaaggcattttagggtattcccaaatcggagctggtgtatacaaggaaggcacatttcacaccatgtggcacgtgacgagaggggcagtcctgatgcatcgtggaaaacgcatcgagccgtcatgggcagatgttaagaaggacctcattagttacggcggtgggtggaaactggagggagaatggaaggagggcgaagaggtacaggtgcttgccctggaaccaggcaaaaatccccgggcagtccagactaagcctgggttgttcaaaaccaacacaggaaccatcggtgctgtgagcctagatttttccccaggcacatctgggtcgcccatagttgacagaaagggaaaggtagtgggcctgtatggtaatggggtcgtgactaggagcggagcctacgtttcagcgattgcccagaccgagaaatccatcgaggataaccctgaaattgaggacgatatcttccgaaagaaacggctcacgataatggacctgcacccgggcgcaggcaagacaaaacgctatcttcccgctattgtgagagaagccatcaagagggggttacggactctgatcctcgctccaacccgagtcgtggcagccgagatggaagaggccttgagaggactgcctattcgctaccaaacacccgctatcagggcggagcataccggtcgtgaaattgtagacctcatgtgtcacgcaactttcaccatgcggctgcttagtccagtcagagtgcctaactataatctgataatcatggatgaggcccattttacagaccccgcttctattgccgcaaggggctacatcagcacgcgcgttgaaatgggggaggccgctggaatcttcatgactgcgaccccaccgggctcccgagatccttttccccagtcaaacgccccaattatagacgaggaaagagagatccccgaacggtcttggagcagtggtcacgagtgggtgacagatttcaaggggaaaaccgtctggtttgtgccttccattaaggcaggaaatgacatcgctgcctgcttgaggaaaaacggcaagaaagttattcagctaagccgcaagactttcgattctgaatatgtgaagacacgtaccaatgactgggattttgtcgtgacgactgacatctcagagatgggcgcaaacttcaaagccgagagagtaatagatccacggaggtgtatgaagcccgtgatcctgacagacggggaagaacgcgttattctcgctggacctatgccggtcacccactccagtgccgcgcaacgaagaggtcggatcggcaggaatcccaaaaacgaaaatgaccagtacatttacatgggggagcccttagaaaacgatgaggactgcgcacattggaaggaggccaaaatgctgcttgataatatcaacacccctgaaggaataattcccagcatgtttgagccagaacgcgagaaggtggacgctatcgatggcgaatatagactgaggggtgaggcccggaaaactttcgtggacctcatgcgtcgcggggatttgcctgtctggctggcttaccgagtagcagccgagggcattaattatgctgacagaaggtggtgttttgatggagtgaagaacaatcagatcctcgaagagaacgttgaagtggagatatggacaaaggagggcgaacggaaaaagctgaaaccccgctggcttgacgccagaatctactcggatccactagcactgaaggagttcaaagagttcgcggccgggaggaagtctttgaccttaaacctgattacagagatgggacggctccctacttttatgacgcagaaggctcgagacgccctggataatcttgcagtcctgcacaccgctgaagccggtggcagagcatataaccatgccctctccgagttgccggagacactggaaactctactgctccttaccctgttagctacagtgaccgggggaatcttcttgtttctgatgagcggcaaaggtgttgggaagatgactctcggcatgttctgcattatcacggcgtcaatactgctttggtacgcccaaattcagccccactggatcgcagctagtatcattctggagtttttcctcatcgtgttgctgataccagaacctgagaaacagcgcaccccacaggacaatcaattaacatatgtcgtgattgccatcctaactgtagtggccgcaaccatggctaacgaaatgggatttctggagaagaccaagaaagacctcggccttgggtctattgccacccaggagccagaatccaatatcctggatatagacttgaggcctgcgagcgcttggactctgtacgccgttgcaacaacgttcgtcacccccatgctccggcactcaatcgagaacagtagcgtgaatgtgtccctgactgccattgctaaccaggcaacagtccttatgggactcggtaaaggctggccgctgtctaaaatggatatcggggttccattgctggccattggatgctacagccaggtgaatcctatcaccttaaccgcggctctactgctccttattgcccattatgcaatcataggccccggtctgcaagccaaggctacacgtgaagcccagaaaagagcagctgccgggattatgaagaacccaactgtagacggcatcacggtgatcgatttggaccccattccttacgatccgaaatttgagaagcagctgggacaggtcatgctcctgatactttgtgtgacccaagttttaatgatgaggacaacttgggcgctgtgcgaagccctcaccttggcaacaggccccatctccaccctgtgggaggggaatccaggacgcttctggaacactacgattgctgtgtcaatggccaatatctttcggggctcttatctagccggtgctgggctactcttcagtattatgaagaacacaaccaatactcgaagaggaaccggcaacatcggtgagacacttggcgaaaaatggaagtcgaggctgaatgccttggggaaaagcgagtttcagatatacaagaaatccggaatccaggaagtcgaccgcactctggccaaggagggcattaaaagaggggagaccgatcaccatgcggtatctagaggatcagctaagctccgttggttcgtggaaaggaacatggttacacctgagggcaaggtggtcgacctgggttgtgggcggggaggctggagctattactgcggtggccttaaaaacgtgcgcgaagtcaaggggctaacgaaaggaggccccgggcacgaggaacctatcccaatgtccacctatggatggaatctggtgcgactccaaagtggcgttgatgtgttctttactccccctgagaagtgtgacacactactgtgcgatattggtgagtctagcccaaaccccaccatcgaagcagggagaactttgagggtactgtcactcgtggagaattggcttaacaatgacacacagttctgtataaaagtcctgaacccgtacatgccttccgttattgaaaagatggagaccttgcagcggaagtacggaggcgccctggtgcgcaatccactcagtagaaacagcacgcatgaaatgtattgggtctctaatgctaccggcaacatcgtgtcctcagtaaatatgatcagcaggatgttaattaaccgatttacaatgaaacacaagaaagccacttacgagcccgacgtggatctggggtcgggaacccggaatataggtatcgagtctgaaattcctaaccttgacatcattggcaagcgtatcgagaaaataaagcaggaacacgagacaagttggcattatgatcaagaccacccatacaagacttgggcatatcatgggtcctacgaaaccaaacagacaggaagcgcctcatccatggttaatggcgtggtcagactgctaaccaagccctgggatgtggtcccgatggtgactcagatggctatgacggacacaacccctttcggtcagcaacgcgtttttaaagagaaggtagatactaggacccaggagcccaaagaagggacaaagaagctcatgaaaatcacggcggagtggctgtggaaggaattgggcaaaaagaaaaccccacggatgtgcactagagaggagttcacacgcaaggtgaggtctaacgccgcactgggcgctatttttaccgacgaaaacaaatggaaaagcgcccgagaggcagtcgaagatagtcggttctgggagctcgtggacaaggaaagaaatcttcacctggagggcaaatgtgagacttgcgtttataacatgatggggaagagggagaaaaagttaggagagtttggtaaagccaagggctcccgcgctatctggtacatgtggctgggggcccgtttcttggaatttgaggcgctcggattcctgaatgaagatcactggtttagccgggagaactctctatcaggcgtggagggtgaagggcttcataagctgggatacattctcagagacgtcagtaaaaaggagggcggcgcaatgtatgccgacgatacagctgggtgggacaccaggatcacactggaagatttgaaaaatgaggaaatggtgactaaccacatggagggagagcataagcgcctggccgaagcaattttcaaactcacctaccagaataaggtagtgcgagttcagcggcctacgcccagaggtaccgtcatggacataatctccaggcgcgatcaaagaggcagcggacaggtgggaacatatggccttaacactttcaccaatatggaggctcagctgattcggcaaatggaaggtgaggggatctttaagtctatccagcacttaacagtgactgaggaaattgccgtccagaactggctggctagggttggacgtgagcgattgtcgcgcatggccatatcaggcgacgattgtgtggtaaaaccactcgacgatagattcgcaagcgcgctgaccgccctaaatgacatgggcaaggtgcggaaagatatccagcaatgggaaccctccaaggggtggaacgactggacgcaggtccctttttgcagtcatcacttccacgagcttattatgaaagatggaagggtgctggttgtgccatgccgcaatcaggacgaactcatcggtagagctcggatttctcagggcgccgggtggagcctgaaggagacagcatgtttgggaaagtcctacgctcaaatgtggtcattaatgtattttcataggcgagacctgcgtctcgccgcaaacgccatctgcagtgcggtcccgtctcactgggtgcccaccagcagaactacatggtccatacatgctaaacacgagtggatgaccactgaagatatgcttaccgtatggaatcgcgtttggatccaggagaacccttggatggaagacaagacaccagtggagtcatgggaagaggtcccctacctgggcaaacgggaggatcagtggtgtggtagcctaattgggctgacgtctagggccacctgggcaaagaacatccagactgccattaatcaagtgagatccctcatcggaaacgaagagtatacagactacatgcctagtatgaaacgcttccggagggaagaggaagaggctggcgtgttgtggtga

SEQ ID NO: 14770 - RNA, 9876 nt, synthetic construct
  misc_feature 1..9876: note = derived and/or modified CDS sequence (opt3) from DENV-2__EU482450__SS-prME
  source 1..9876: mol_type = other RNA
agcgcaggaatgatcattatgctgataccaaccgtgatggctttccacctcactactcggaacggggagcctcatatgatcgtcggcattcaggaaaagggtaaatcccttctgtttaagacggaggacggagttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagcactggtgccacatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccaattaaagctgaattggttcaagaaagggtcttccattggacagatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacaatataaatttcagcccgagagtccaagcaagttggcctccgctatccagaaagcccaggaagagggcatatgtggtattagatctgtcactaggctcgagaatctgatgtggaagcaaatcacacccgaattaaaccacattctggcagagaatgaagttaaactaaccatcatgactggcgatataaaggggatcatgcaggccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaagacgcgttttgtgactctaagttaatgagcgctgccattaaggataatagggcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatccccaagaacctcgcaggacccgttagtcagcacaattaccgtcctggctaccacacgcagattgctggtccatggcatctgggcaagctagagatggacttcgatttttgtgacgggacaaccgtggtcgtgactgaagattgcggaaaccggggccccagcctgcgaaccacaactgcctctgggaagctcatcaccgagtggtgctgtagatcctgcacactgccgcctcttaggtatcgcggagaggacggctgttggtacggtatggaaattcggccattgaaagagaaggaagagaatctggttaactcattagtgacggcggggcacggacaagtagataatttcagtctcggcgtcctgggtatggccctttttctggaagagatgttgagaaccagggtgggcactaaacatgctatactcctggtggcagtcagcttcgttacactaatcaccgggaacatgtcgtttaaggacctgggacgcgtggtagtgatggtcggcgccactatgacagatgacattgggatgggagtgacctatctcgctctgcttgccgcattcaaagttcgacccacgtttgcggccggcttgctgttacggaagctcacttccaaggagctgatgatgaccacaatcggtattgtgcttctgtctcagagcgctatccctgaaaccgtcctagagctcactgatgccctggcattggggatgatggtgctgaaaatagttcgtaatatggaaaagtaccagttagctgtgacaatcatggccattctctgcgtccccaacgcagtaatcctgcagaatgcctggaaagtgtcatgtaccattcttgctgttgtgagtgtctccccactgttgctcacatctagccaacagaagactgactggatccctctggcgctaaccataaaaggactgaaccccacggccattttccttacaaccctctccagaactaataagaaaaggtcatggccactgaacgaggcaatcatggctgtgggcatggtaagcatcttggccagttctctgttaaagaatgacattccgatgaccggccctctcgtggccgggggactgcttacagtctgctatgttctgactggtcgctccgctgatttggaactcgagcgggcaaccgacgtgaagtgggaggatcaggccgaaataagcggctcgtcacccatcctgtctattacgatcagtgaggacgggtccatgagcattaaaaacgaagaggaggaacagacactaaccatcctgataagaactggacttctcgtgatctctggcctgtttccaattagcatccccattacagcggctgcctggtacttgtgggaggtcaagaaacaaagggccggtgtgttatgggatgttccttccccaccccctatggggaaggccgaactggaggacggagcttatcgaatcaaacagaagggcatactcggctactcacagattggggcaggagtatacaaggaaggtaccttccacactatgtggcatgtgacacgcggcgccgtcctgatgcacaaagggaagcggatcgagccgagttgggcggatgtgaaaaaggaccttatcagctatggaggcggttggaaactggagggggaatggaaggagggagaagaggttcaggtgttggctctagaaccaggcaagaatcccagagccgtccaaaccaaacctggcctgtttaagacgaacactgggaccattggagcagtgtctctcgatttctccccaggtacatcaggcagtcccatcatagacaaaaaggggaaagtagtcggactgtacggcaacggtgtggttaccaggagcggggcctatgtgtccgctattgcccagacagagaagtctatcgaggataatcctgaaattgaggacgatatctttcgtaagcgccggcttactataatggacttacacccgggagcaggcaaaaccaagagatacctgcccgctattgtcagggaagccatcaaacgaggcctccggacgttgatcctggcgccaacacgcgtggttgccgcagagatggaagaggctctcagagggctgcctattaggtatcagactcccgccatccgggctgagcataccggacgagaaattgtggaccttatgtgtcacgcaacattcaccatgagactgttgtcgccagtccgcgtgcctaactacaatctaataatcatggatgaggcccatttcactgaccccgccagcattgctgcgaggggttatatctcaacccgtgtagaaatgggcgaggcagccgggatctttatgacagctacgccaccgggatcccgggatcctttcccccaaagtaacgccccaattatagacgaggaaagagagatccccgaaaggtcttggaatagcggccacgagtgggtgactgattttaagggtaaaaccgtttggttcgtcccttccattaaggcagggaacgacatcgccgcttgcctgcgcaagaatggcaagaaggtgattcagctctcacgaaaaacatttgattctgaatacgtgaagaccagaactaacgactgggatttcgtcgtaacaaccgacatcagcgagatgggcgcgaattttaaagccgagcgggtgatagatccaaggcgctgtatgaagcccgttatcttaacggacggcgaagaacgtgtgattctggcagggcctatgccggtcactcatagttccgctgcccagagacggggaaggatcggtcgcaaccccaaaaatgaaaacgaccagtacatttatatgggcgagccccttgaaaatgatgaggactgcgcacactggaaggaggccaagatgctgctcgataacatcaatacacctgaagggataattcccagcatgttcgagccagaacgagagaaagtggacgctatcgatggagaatacagattgcggggcgaggccaggaagacctttgttgacctgatgcgcagaggtgatctccctgtgtggctggcgtataaagtcgcagccgaggggattaactacgctgacaggcggtggtgtttcgatggcatcaagaacaatcaaatacttgaagagaacgtggaagtagagatctggaccaaagagggagaacgtaagaagctaaaaccccgctggctggacgcccgaatttattctgatccattggctttaaaggagtttaaagagttcgcagccggcagaaagtcactgactctcaatctgatcacagagatggggaggcttcctaccttcatgacacagaaaactcgggacgctctggataacctcgccgtgttgcacacggcagaagcgggaggtcgcgcctacaatcatgctctgtccgagctaccggagaccctggaaacactccttctgttaactttgctggccaccgttacaggcgggatttttctcttcctgatgagtggaagaggcatcggtaagatgacccttgggatgtgctgcataattactgcaagcatcctgctctggtatgctcagatccagccccactggattgccgcatcgatcatattggagtttttcctgattgtcttactaatcccagaacctgagaagcaaaggacgccccaggacaaccagctgacctacgtggtgattgccatcctcacagtcgttgctgcgactatggccaatgaaatgggctttcttgagaaaaccaagaaagacctgggattgggctctatagcaacacagcaaccagagtccaacatcctggatattgacctccggcctgctagcgcctggaccctgtacgccgtggcaactacattcgtaacgcccatgcttcgacattcaatcgaaaatagttctgtgaacgtctccctcaccgctattgccaatcaggcgactgtgctgatggggttgggaaagggttggccgctgagcaaaatggatatcggcgttccattactagctattgggtgttattcacaggtgaaccctatcacactgaccgccgcactccttctgttggtcgcccactacgctataattggacccggcctgcaggcaaaggccaccagagaggcgcaaaagcgcgctgccgcaggtatcatgaaaaatccaacagtagacgggatcactgtgattgatctcgaccccataccttatgatccgaagtttgaaaaacagctgggccaggttatgcttttaatcctgtgcgtgacgcaagtcctcatgatgaggaccacatgggccttgtgtgaggctctgactctagccaccggacccattagtacactgtgggaaggcaacccagggcggttctggaataccactatcgcagtgagcatggctaacatttttcgtggatcctacctcgccggcgcgggtcttctgttctctatcatgaagaatacgacaaacaccagaagggggactggaaacatgggcgagaccttgggtgagaaatggaaaagccgcctgaatgccctcggcaaatccgaatttcagatatataagaagtcagggatccaggaggtcgaccggacactggcaaaagaaggaattaagcgaggcgagactgatcaccatgctgtgtctagagggagtgccaaattaaggtggttcgttgagcgcaacatggtgacccctgaaggaaaggtagtggaccttggctgcggtagagggggatggtcgtactattgtggcggtctgaaaaatgtcagagaggttaagggcctcacaaaagggggacccggccacgaggaacctatcccaatgagcacgtacgggtggaacctagtgcgtctgcagtccggagtcgatgtgtttttcattccccctgaaaaatgcgacaccttgctgtgtgatatcggcgagtcttcaccaaatcccactgtagaggcaggtaggacactccgggtgcttaacctggttgaaaattggttgaacaataacacccaattctgcataaaggtgctgaatccgtacatgcctagcgtcattgagaaaatggaagctctccagcgcaagtatgggggagccttagtgcgaaacccactgtccagaaatagtactcatgagatgtactgggtctctaacgccagcggcaatatcgtgtcatccgttaacatgatcagtaggatgcttattaaccggtttacaatgcgccacaaaaaggcgacctatgaacccgacgtagacctgggcagcgggacgagaaatataggaatcgagtctgagattcctaacctagatatcattggtaagaggatcgagaaaataaagcaggagcatgaaacctcctggcactacgaccaggatcacccatataaaacatgggcttaccatggctcatatgagactaagcaaaccgggagcgcatcgtctatggtgaatggagtcgtgcgactcctgacaaaaccctgggacgttttgccgactgtgacccagatggccatgacagataccactcctttcggccagcagcgggtctttaaggaaaaggtggacacgcgtacacaagagcccaaagagggtaccaagaaactgatgaagatcactgctgaatggctctggaaagagcttgggaagaaaaagaccccaagaatgtgtacacgcgaagagttcacgaggaaggtacggagtaacgccgcactgggagccatttttaccgatgagaataaatggaagtccgctagagaagcggtggaggacagccgcttctgggaattagttgataaagagaggaacctgcacttggaaggcaagtgcgagacttgtgtctacaatatgatgggcaaacgagagaagaagctcggggaatttggaaaagccaagggttcacgggcaatctggtacatgtggctgggcgctagattcctagagtttgaagcccttgggttcctgaacgaggaccattggttttccagggaaaattctctcagcggagtggagggcgagggtctgcacaaattggggtatattctgcgcgatgtgagtaagaaagaaggaggcgcaatgtacgccgacgacacagctggctgggatacccgtatcactctcgaggaccttaagaacgaagagatggtcacaaatcacatggaaggggagcataagaaactggccgaggcgattttcaagttaacctatcagaacaaagttgtgcgggtacagagacctacacccaggggaactgtgatggatataatctcccgccgagaccaacggggtagcggccaggtcgggacctacggactgaatacgtttaccaacatggaagcacagttgattagacagatggagggcgaaggtgtgttcaagaatatccaacacctcacagttactgaggaggtggccgtcaaaaactggctggctagggtggggcgcgaaagactatctcggatggccatctcaggagatgactgcgtagttaagccacttgatgacaggttcgcaaacgctctgaccgccctcaatgatatgggcaagattcgtaaagacatacagcagtgggagcccagtaagggctggaacgattggacacaggtgcctttttgctcccatcacttccatgaactgatcatgaaagacgggcgagtcttggtggtgccatgtcgcaatcaagatgagttaattggtagagctcggatcagccagggagccggctggtctctgagggaaactgcatgcctcgggaagtcgtatgcgcagatgtggtcacttatgtactttcaccgcagagacctgcggctagccgctaacgccatttgtagcgcagtcccgtcccactgggttcccaccagtaggacgacatggtctatccatgctaaacacgagtggatgaccactgaggacatgctgacagtgtggaatcgagtatggatacgtgaaaacccttggatggaggataagaccccagtggaaagctgggaggaaatcccctatctcggaaagagagaggaccagtggtgcggctccttgattggtctgacttcacgcgccacctgggccaaaaatatccaagccgcgattaaccaggtccggagtcttatcgggaatgaggaatacgctgattacatgccttctatgaagaggttcagacgcgaggaagaggaagccggagtgctgtggtga

SEQ ID NO: 14771 - RNA, 9876 nt, synthetic construct
  misc_feature 1..9876: note = derived and/or modified CDS sequence (opt3) from DENV-2__EU569721__SS-prME
  source 1..9876: mol_type = other RNA
agcgcaggcatgataattatgctgatacccaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagcactggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccaattaaagctgaattggttcaagaaagggtcttccattggacagatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacaatataaatttcagcccgagagtccaagcaagttggcctccgctatccagaaagcccaggaagagggcatatgtggtattagatctgtcactaggctcgagaatctgatgtggaagcaaatcacacccgaattaaaccacattctggcagagaatgaagttaaactaaccatcatgactggcgatataaaggggatcatgcaggccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaagacgcgttttgtgactctaagttaatgagcgctgccattaaggataatagggcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatccccaagaacctcgcaggacccgttagtcagcacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaagctcattaccgagtggtgctgtagatcctgcacactgccgcctcttaggtatcgcggagaggacggctgttggtacggtatggaaatacggccattgaaagagaaggaagagaatctggtgaactcattagttacggcggggcacggacaagtggataatttcagtctcggcgtactgggtatggccctttttctggaagagatgttgagaaccagggtcggcactaaacatgctatcctcctggtggcagtgagcttcgtcacactaattaccgggaacatgtcgtttaaggacctgggacgcgttgtggtaatggtgggcgccactatggctgatgacatcgggatgggagtcacatatctcgccctgcttgcagcgttcaaagtgcgacccacctttgccgctggcttgctgttacggaagctcacgtccaaggagctgatgatgactaccattggtatcgttcttctgtctcagagcacaatacctgaaaccgtgctagagctcactgatgccctggcattggggatgatggtcctgaaaatcgtgcgtaatatggaaaagtaccagttagctgttacaattatggccatcctctgcgtgcccaacgcagtcattctgcagaatgcctggaaagtatcatgtaccatccttgctgtggttagtgtgtccccactgttgctcacatctagccaacagaagactgactggatacctctggcgctaaccattaaaggactgaaccccacggccatcttccttacaaccctctccagaactaataagaaaaggtcatggccactgaacgaggcaatcatggctgtcggcatggtgagcattttggccagttctctgttaaagaatgacataccgatgaccggccctctcgtagccgggggactgcttacagtgtgctatgtcctgactggtcgctccgctgatttggaactcgagcgggcaaccgacgttaagtgggaggatcaggccgaaatcagcggctcgtcacccattctgtctatcacgattagtgaggacgggtccatgagcatcaaaaacgaagaggaggaacagacactaaccatactgatcagaactggacttctcgtgatttctggcctgtttccaatcagcattcccatcacagcggctgcctggtacttgtgggaggtgaagaaacaaagggccggtgtcttatgggatgtgccttccccactgcccatggggaaggccgaactcgaggacggagcttatcgaataaaacagaagggcattctgggctactcacagatcggggcaggagtttacaaggaaggtaccttccacactatgtggcatgtaacacgcggcgccgtgcttatgcacaaagggaagcggatcgagcctagttgggcggatgtcaaaaaggacctgattagctatggaggcggttggaaattggagggggaatggaaggagggagaagaggtgcaggttctagctctggaaccgggcaagaatccaagagccgtgcaaaccaaacccggcctctttaagacgaacactgggaccatcggagcagtctctctggatttctcccctggtacatcaggcagtccaataattgacaaaaaggggaaagtggtaggactttacggcaacggtgtcgtgaccaggagcggggcctatgtttccgctatcgcccagacagagaagtctattgaggataatcccgaaatcgaggacgatatatttcgtaagaaacgcttaactattatggacctgcaccctggagcaggcaagaccaaacggtacctcccggctatcgtgagagaagccatcaagaggggcttgcgaacgctgattctcgcgcccacacgggtcgtggccgcagagatggaagaggctctgcgcgggcttccaatcagatatcagactcctgccattagggctgagcataccggacgggaaatagttgacctgatgtgtcacgcaacattcaccatgcgattgctatcgcccgtgagagtcccaaactacaatctgatcattatggatgaggcccatttcactgaccctgccagcatcgctgcgcgcggttatatctcaaccagggtggaaatgggcgaggcagccgggatttttatgacagctacgcccccaggatcccgtgatccgttccctcaaagtaacgcccccataatcgacgaggaacgggagattccagaaagatcttggaatagcggccacgagtgggtaactgattttaaaggtaagaccgtgtggttcgttccctccatcaaggcagggaacgacattgccgcttgcctcaggaaaaatggaaagaaagtcatccagttatcacgcaagacatttgattctgaatacgtgaaaacccgaactaacgactgggatttcgtggtcacaaccgacataagcgagatgggcgcgaattttaaggccgagagagtaatcgatcctcggaggtgtatgaaaccagtgattctgacggacggcgaagaacgcgttatccttgcagggcccatgcctgtgactcatagttccgctgcccagcgtagaggacggattggtaggaacccgaagaatgaaaacgaccagtacatctatatgggcgagccactggaaaatgatgaggactgcgcacactggaaggaggccaaaatgctcttggataacataaatacacccgaagggattatccctagcatgttcgagcccgaacgcgagaaggtcgacgctattgatggagaataccgactgagaggcgaggcccggaaaacctttgtggacctcatgaggcgcggtgatctgccagtttggcttgcgtataaggtggcagccgaggggatcaactacgctgacagaaggtggtgtttcgatggcatcaaaaacaatcaaatcctagaagagaacgtcgaagtggagatttggaccaaggagggagaacggaagaaactgaagcctcgttggttggacgcccgcatctattctgatcccttagctctgaaagagtttaaggagttcgcagccggccgaaaatcactcactctgaatcttattacagagatggggagactgccaaccttcatgacacagaagactagggacgctctcgataacttggccgtactgcacacggcagaagcgggaggtcgggcctacaatcatgctctatccgagctgcctgagaccctcgaaacacttctgttattgactctgctcgccaccgtgacaggcgggatctttctgttccttatgagtggacgcggcataggtaagatgaccctggggatgtgctgcattatcactgcaagcatcctcttgtggtatgctcagattcagccgcactggatcgccgcatcgataattctggagtttttcttaatcgttctactgattcccgaaccagagaaacaaagaacgcctcaggacaaccagctcacctacgtcgtgatcgccatacttacagtggtcgctgcgactatggccaatgaaatgggctttctggagaagaccaaaaaggacttgggactgggctctatcgcaacacagcaacccgagtccaacattctcgatatcgacctgaggccagctagcgcctggaccctttacgccgttgcaactacattcgtgacgcctatgctccggcattcaattgaaaatagttctgtaaacgtgtccctgaccgctatcgccaatcaggcgactgtcttgatggggctgggaaaaggttggcccttaagcaagatggatattggcgtgccgctactggctatcgggtgttattcacaggttaacccaataacactcaccgccgcacttctgttgctggtggcccactacgctattatcggacctggcctccaggcaaaggccacccgagaggcgcagaaaagagctgccgcaggtatcatgaagaatcccacagtcgacgggattactgtaatagatctggacccaatcccctatgatcctaaatttgaaaagcagcttggccaggtgatgttactgattctctgcgttacgcaagtgttgatgatgcgcaccacatgggccctgtgtgaggctctaactctggccaccggaccgatcagtacactctgggaaggcaaccccgggaggttctggaataccactattgcagtcagcatggctaacatctttcggggatcctaccttgccggcgcgggtctgttgttctctataatgaaaaatacgacaaacacccgtagagggactggaaacatgggcgagaccctgggtgagaagtggaaaagcaggctcaatgccctgggcaagtccgaatttcagatctataagaaatcagggattcaggaggtggaccgcacattagcaaaggaaggaatcaaacggggcgagactgatcaccatgctgtctctcgagggagtgccaaacttagatggttcgtggagaggaacatggttaccccagaaggaaaagtggtagacctgggctgcggtcgcgggggatggtcgtactattgtggcggtctcaagaatgtgcgggaggtcaagggcctaacaaaagggggacctggccacgaggaaccaattcctatgagcacgtacgggtggaacctggttagattgcagtccggagtggatgtctttttcatcccacccgaaaagtgcgacaccctgctctgtgatataggcgagtcttcacctaatccaactgtggaggcaggtcgtacacttagggtactgaacttggtggaaaattggctgaacaataacacccaattctgcattaaagttctcaatccctacatgccgagcgtgatcgagaagatggaggctttacagcggaaatatgggggagccctggtccgcaaccctctttcccgaaatagtactcatgagatgtactgggtgtctaacgccagcggcaatatcgtctcatccgtgaacatgattagtagaatgctgataaacaggtttacaatgcggcacaagaaggcgacctatgaaccagacgttgacctaggcagcgggacgcgcaatatcggaattgagtctgagacccccaacctcgatatcattggtaaaagaatcgaaaagataaaacaggagcatgaaacatcctggcactacgaccaggatcacccttataagacttgggcttaccatggctcatatgagaccaaacaaacagggagcgcatcgtctatggtaaatggagtggtcaggctgttgactaagccatgggacgtgctgcccaccgttacacagatggccatgaccgatactacgccgttcggccagcagcgagtgtttaaggaaaaagtcgacacacggacccaagagcctaaggagggtactaaaaagctcatgaaaatcaccgctgaatggctttggaaggagctggggaaaaagaagacaccccgtatgtgtacgagagaagagttcacccgcaaagtgaggagtaacgccgcattaggagccatttttactgatgagaataagtggaaatccgctcgggaagcggtagaggacagcagattctgggaactggtggataaggagcgcaacttgcacctcgaaggcaaatgcgagacatgtgtttacaatatgatgggcaagagggagaagaaactgggggaatttggaaaggccaaaggttcacgagcaatctggtacatgtggctaggcgctcggttccttgagtttgaagccctggggttcctcaacgaggaccattggttttccagagaaaattctctgagcggagtcgagggcgagggtttgcacaagctggggtatattctcagggatgtgagtaaaaaggaaggaggcgcaatgtacgccgacgacaccgctggctgggatactcgcatcacacttgaggacctgaagaacgaagagatggtgaccaatcacatggaaggggagcataaaaagttagccgaggcgattttcaaactgacatatcagaacaaggtcgttcgtgtgcagcggccaactcctagaggaaccgtaatggatataatctccaggcgcgaccaacgaggtagcggccaggtggggacgtacggattgaatacctttacaaacatggaagcacagctcattcggcagatggagggcgaaggtgtcttcaaaaatatccaacacctgactgtgaccgaggaggttgccgtgcagaactggctagctagagtcgggagggaacgcctttctagaatggccatctcaggagatgactgcgtggtaaagcccctggatgaccggttcgcaaacgctctcacagccctgaatgatatgggcaagattaggaaagacatacagcagtgggagccaagtaagggctggaacgattggactcaagttcccttttgctcccatcacttccatgaattgatcatgaaagacgggcgtgtgttagtcgtgccttgtcgaaatcaggatgagctgattggacgcgctagaatcagccagggtgccggctggtctctccgggaaaccgcatgccttgggaagtcgtatgcgcagatgtggtcactgatgtactttcacaggcgcgacctaagactggccgctaacgccatttgtagcgcagtgccatcccactgggtcccgacgagtcggacaacctggtctatccatgctaaacacgagtggatgactacagaggacatgctcaccgtttggaatagggtgtggatacgagaaaacccctggatggaggataagactcctgtagaaagctgggaggaaatcccatatttgggaaagcgtgaggaccaatggtgcggctccctgattggtcttacctcaagagccacatgggccaaaaatatccaggccgcgattaaccaggtgcgcagtctgatcgggaatgaggaatacacggattacatgccctctatgaagcggttcaggagagaggaagaggaagctggagtcctctggtga

SEQ ID NO: 14772 - RNA, 9876 nt, synthetic construct
  misc_feature 1..9876: note = derived and/or modified CDS sequence (opt3) from DENV-2__EU482451__SS-prME
  source 1..9876: mol_type = other RNA
agcgccggcatgatcattatgctgatacccaccgtgatggctttccacctcactactcggaacggggaacctcatatgatcgtcggtattcaagaaaagggtaaatcccttctgtttaagacggaagacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacaggcgctgagctgaccggttatgggactgtgaccatggaatgtagccccagaacaggccttgatttcaatgagatggtcctgttgcaaatggaaaacaaggcctggctcgtgcacaggcagtggtttctggacttacctctgccatggctccccggagcagataagcaggagtctaattggatccagaaagagacccttgttactttcaagaaccctcatgctaaaaagcaagacgtggtcgtgctgggctcccaggaaggggccatgcacacagcgttgacgggagccaccgagatacagatgtcaagcggtaatctactgtttactggccatctcaaatgccggctgcgtatggacaaacttcaactgaaggggatgagttactctatgtgtacaggaaaattcaaggtagttaaagaaattgcagagacccagcacggcacaatcgtgatccgcgtccagtatgagggtgatgggtccccatgcaagattcccttcgaaatcatggacttggagaaaagatacgtgctcggcaggctgattactgtcaacccgatagtgaccgaaaaggatagccctgttaacatcgaggctgaacccccatttggagactcgtacattatcatcggcgtggagcctgggcagttaaagctgaattggttcaaaaagggatcttccattggtcaaatgtttgagacgaccatgcggggcgccaaacgaatggctatactaggggatacagcctgggacttcggatcactcggcggtgtatttacaagtatcgggaaggcactgcatcaggtcttcggcgccatttatggagctgcgtttagcggcgtgtcctggaccatgaaaatccttattggggttatcataacatggatcggaatgaactctcgcagcacttcattgagtgtgtccctggtcctcgtgggcattgtaaccctgtaccttggtgtgatggttcaggcagatagcgggtgtgtcgtgtcttggaagaataaggaactgaaatgcggatcaggcatcttcgtgacggacaacgtccacacatggaccgagcagtataagtttcaacccgaaagtccaagcaaattggcctccgctattcagaaggcccaggaggaaggtatctgtggcataagatctgttactaggctcgagaatctgatgtggaaacagattacacccgagttaaaccacatcctggcagaaaatgaggtgaagctaaccattatgactggggatatcaaaggaataatgcaagccggcaagcggtcgctccgccctcagccaaccgaactgaagtacagctggaaaacatgggggaaggctaaaatgctttccacggagtcatataaccagaccttcttgatcgacggaccggaaactgccgagtgccccaatacaaacagagcatggaatagtctggaggtggaagattacggctttggtgtattcaccacaaacatttggctcaagctgaaagagaagcaggacgcgttttgtgactctaagttaatgagcgctgccatcaaagataatagggcagtccatgccgacatggggtattggattgaatccgctctgaacgatacttggaagatcgagaaagcctcattcatagaggtgaagaattgccactggcctaaaagccataccctttggtctaacggagttttggaatccgagatgattatcccaaagaacctcgcaggccccgtgagtcaacacaattaccgtcctggttaccacacgcagatcgctggcccatggcatctggggaagctagaaatggacttcgatttttgtgacggaacaaccgtcattgtgactgaggattgcggcaaccgggggcccagcctgcgaaccacaactgcctctggaaaactcatcaccgaatggtgctgtagatcctgcacactgccgcctcttaggtatcgcggcgaggacggttgttggtacgggatggagattcggccattgaaggaaaaagaggaaaatctggttaactcattagtgacggcgggacacggccaggtagataatttcagtctcggtgtcctgggcatggccctttttctggaggaaatgttgagaaccagggtggggactaagcatgctatactcctggtggcagtcagcttcgttacactaatcaccggaaacatgtcgtttaaagacctgggccgcgtggtagtgatggtcggggccactatggctgatgacattggaatgggcgtgacatatctcgccctgcttgcagcgttcaaggttcgacccacctttgccgctggtttgctgttacggaagctcacgtccaaagagctgatgatgactaccatcgggattgtgcttctgtctcaaagcacaatccctgagaccgtcctagaactcactgatgccctggcattgggaatgatggtgctgaagatagttcgtaatatggagaaataccagttagctgtgacaatcatggccattctctgcgtccccaacgcagtaatcctgcagaatgcctggaaggtgtcatgtaccattcttgctgttgtgagtgtctccccactgttgctcacatctagccagcagaagactgactggatccctctggcgctaaccataaagggcctgaaccccacggccattttccttacaaccctctccagaactaataaaaagaggtcatggccactgaacgaagcaatcatggctgtgggcatggtaagcatcttggccagttctctgttaaagaatgacattccgatgaccgggcctctcgtggccggaggtctgcttacagtctgctatgttctgactggccgctccgctgatttggagctcgaacgggcaaccgacgtgaaatgggaggatcaggccgagataagcgggtcgtcacccatcctgtctattacgatcagtgaagacggatccatgagcattaagaacgaggaagaggagcagacactaaccatcctgataagaactggccttctcgtgatctctggtctgtttccaattagcatccccattacagcggctgcctggtacttgtgggaagtcaaaaagcagagggcaggggtgttatgggatgttccttccccaccccctatgggaaaagccgagctggaagacggcgcttatcgaatcaagcaaaagggcatactcgggtactcacagattggagcaggagtatacaaagagggcaccttccacactatgtggcatgtgacacgcggggccgtcctgatgcacaagggaaaacggatcgaaccgagttgggcggatgtgaagaaagaccttatcagctatggcggtgggtggaagctggagggagagtggaaggaaggcgaggaagttcaggtgttggctctagagccaggcaaaaatcccagagccgtccagaccaagcctgggctgtttaaaacgtctactggaaccattggtgcagtgtccctcgatttctcaccaggcacaagtgggagccccatcatagacaagaaaggaaaggtagtcggcctgtacggtaacggggtggttaccaggtccggagcctatgtgtctgctattgcccaaacagaaaagtcgatcgaggataaccctgagattgaagacgatatctttcgtaaacgccggcttactataatggacttacacccgggcgcaggcaagaccaaaagatacctgcccgctattgtcagggaggccatcaagcgagggctccggacgttgatcctggcgccaacacgcgtggttgccgcagaaatggaggaagctctcagaggactgcctattaggtatcagactcccgccatccgggctgagcataccggtcgagagattgtggaccttatgtgtcacgcaacattcaccatgagactgttgagcccagtccgcgtgcctaattacaacctaataatcatggatgaagcccatttcactgaccccgcctcaattgctgcgaggggctatatctccacccgtgtagagatgggggaagcagccggaatctttatgacagctacgccaccgggcagtcgggatcctttcccccagtctaatgccccaattatagacgaggagagagaaatccccgagaggagctggaactccggtcacgaatgggtgactgattttaaagggaagaccgtttggttcgtcccttcaattaaggcaggaaatgacatcgccgcttgcctgcgcaaaaacggcaagaaagtgattcaactctctcgaaagacatttgatagcgagtacgtgaaaaccaagactaatgactgggatttcgtcgtaacaaccgacatcagtgaaatgggcgcgaactttaaagccgagagagtgatagatccacggaggtgtatgaagcccgttatcttaacggacggggaggaacgcgtgattctggcaggacctatgccggtcactcattccagcgctgcccagcgtagaggtcggatcggcaggaatccaaagaacgagaatgaccagtacatttatatgggggaaccccttgagaacgatgaagactgcgcacactggaaagaggccaagatgctgctcgataatatcaacacacctgagggaataattccctctatgttcgaaccagagcgcgaaaaagtggacgctatcgatggcgagtaccgattgagaggtgaagcccggaagacctttgttgacctgatgaggcgcggggatctccctgtgtggctggcgtataaagtcgcagccgagggcattaattacgctgacagaaggtggtgtttcgatggaatcaagaacaaccagatacttgaggaaaatgtggaggtagaaatctggaccaaggagggcgagcggaaaaagctaaaaccccgttggctggacgcccgcatttattcagatccattggctttaaaggaatttaaagagttcgcagccgggcgaaagtccctgactctcaacctgatcacagaaatgggaagacttcctaccttcatgacacaaaagactagggacgctctggataatctcgccgtgttgcacacggcagaggcgggtggccgggcctacaaccatgctctgagtgaactaccggagaccctggagacactccttctgttaactttgctggccaccgttacagggggaatttttctcttcctgatgagcggccgcggtatcgggaaaatgacccttggcatgtgctgcataattactgcatcgatcctgctctggtatgctcagatccagccccactggattgccgcatctatcatattggaatttttcctgattgtcttactaatcccagagcctgaaaagcagagaacgccccaagacaatcagctgacctacgtggtgattgccatcctcacagtcgttgctgcgactatggccaacgagatgggatttcttgagaagaccaagaaagacctgggcttggggtccatagcaacacagcagccagagagcaatatcctggatattgacctcaggcctgcttcagcctggaccctgtacgccgtggcaactacattcgtaacgcccatgcttcggcatagtatcgagaactcttccgtgaatgtcagcctcaccgctattgccaaccaagcgactgtgctgatgggattgggtaagggctggccgctgtcaaagatggatatcggggttccattactagctattggatgttatagtcaggtgaatcctatcacactgaccgccgcactccttctgttggtcgcccactacgctataattggccccggtctgcaggcaaaagccacccgagaagcgcagaagagagctgccgcagggatcatgaaaaacccaacagtagacggcatcactgtgattgatctcgaccccataccttatgatccgaagtttgagaaacaactgggacaggttatgcttttaatcctgtgcgtgacgcaggtcctcatgatgcgcaccacatgggccttgtgtgaagctctgactctagccaccggccccattagcacactgtgggaggggaatccaggaaggttctggaacaccactatcgcagtgtccatggctaatatttttcggggctcttacctcgccggtgcggggcttctgttcagcatcatgaagaacacgacaaatacccgtagaggaactggcaacataggtgaaaccttgggcgagaaatggaagtccaggctgaacgccctcgggaagtcagagtttcaaacatataaaaagtctggaatccaggaagtcgaccgcactctggcaaaagagggcattaagagaggggaaaccgatcaccatgctgtgagtcgaggatcggccaaattaagatggttcgttgagaggaatatggtgacacctgagggcaaggtagtggaccttggttgcgggcgcggaggctggagctactattgtggtggcctgaagaacgtccgggaagttaaagggctcacgaagggaggccccgggcacgaggaacctatcccaatgtccacctacggatggaatctagtgagactgcagtctggcgtcgatgtgtttttcattccccctgagaaatgcgacactttgctgtgtgatatcggtgaatcaagcccaaaccccacagtagaggcagggcgtaccctcagggtgcttaatctggttgagaactggttgaataacaatactcagttctgcataaaggtgctgaacccgtacatgccttccgtcattgagaaaatggaggctctccaacggaagtatggaggcgccttagtgcgcaatccactgagtcgaaactctacacatgaaatgtactgggtcagcaatgcctcaggcaacatcgtgtccagtgttaatatgatcagcagaatgcttattaacaggtttaccatgcggcacaagaaagcgacgtatgagcccgacgtagacctggggtctggaacccgcaacataggtaatgaatccgagatccctaacctagatattatcggcaagagaattgagaaaatcaagcaggaacatgagacatcatggcactacgaccaggatcacccatataaaacttgggcttaccatgggagctatgaaaccaagcagacaggatcggcatctagtatggtgaatggcgtcgtgaggctcctgactaagccctgggacgttttgccgaccgtgacacaaatggccatgaccgatactacgcctttcggtcagcagcgagtctttaaagagaaggtggacacacggacccaggaacccaaagaggggactaagaaactgatgaagataaccgctgagtggctctggaaagaacttggaaagaagaaaacaccacgtatgtgtacgagagaggagttcacccgcaaggtaaggtccaacgccgcactgggcgccatctttactgatgagaataaatggaaaagcgctcgggaggcggtggaagactcaagattctgggagttagttgataaagaacgcaacctgcacttggagggcaagtgcgaaacatgtgtctacaatatgatggggaagagggagaaaaagctcggagagtttggtaaagccaagggctcccgagcaatttggtacatgtggctgggggctcggttcctagaatttgaggcccttggattcctgaacgaagaccattggttttctagagagaatagcctcagtggcgtggaaggtgaggggctgcacaaattgggatatatcctgagggatgtgtccaagaaggagggcggcgcaatgtacgccgacgacaccgctgggtgggatactcgcattacactcgaagaccttaaaaacgaggaaatggtcaccaatcacatggagggagaacataagaaactggccgaggcgatcttcaagttaacatatcaaaacaaagttgtgcgtgtacagcggcctactcccagaggtaccgtgatggatattataagcaggcgcgaccagcgaggctctgggcaagtcggaacgtacggcctgaatacctttacaaacatggaggcacagttgatccggcagatggaaggtgagggggtgttcaagaatattcagcacctcactgttaccgaagaggtggccgtccaaaactggctggctagagtgggaagggagcgcctatcaagaatggccatcagtggcgatgactgcgtagttaagccacttgatgaccggttcgcaaacgctctgacagccctcaatgatatgggcaaaatcaggaaggacattcagcagtgggaaccctccaaagggtggaacgattggactcaggtgcctttttgcagccatcacttccatgagctgataatgaaggacggacgtgtcttggtggtgccatgtcgaaatcaagatgaattaatcggtcgcgctagaatttctcagggcgccgggtggtcgctgcgggagaccgcatgcctcggaaaatcatatgcgcagatgtggagccttatgtactttcacaggcgcgacctgagactagccgctaacgccatctgttccgcagtcccgagtcactgggttcccacgtctcggacaacctggagcattcatgctaagcacgaatggatgactacagaggacatgctgaccgtgtggaatagggtatggatccgagagaacccttggatggaagataagactccagtggagtcctgggaagagataccctatctcggcaaacgtgaagaccagtggtgcggttcattgatcgggctgaccagtagagccacatgggcaaagaatattcaagtcgccatcaaccaggtgcgctctcttattggaaatgaggagtacacggattacatgcctagcatgaaacggttcaggagagaagaggaagaggcgggcgttctgtggtga

SEQ ID NO: 14773 - RNA, 9876 nt, synthetic construct
  misc_feature 1..9876: note = derived and/or modified CDS sequence (opt3) from DENV-2__EU660413__SS-prME
  source 1..9876: mol_type = other RNA
agcgcaggaatgataattatgctgataccaaccgtgatggctttccacctcacaactagaaacggggaacctcatatgatcgtaggcattcaggaaaagggtaaatcccttctgtttaagacggaggacggagttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggagagcaccggcgcgaaaagcgaagtgtagcactggtgccccatgtcggtatggggcttgagactcgtaccgaaacatggatgagctccgagggagcgtggaaacacgctcagagaatcgagacttggatactgaggcatcctggattcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggttcgattttaatgaaatggtccttctgcaaatggagaacaaggcctggttggtgcacaggcagtggttcctcgacctgcctttaccatggctgcccggcgcagataagcaggagtctaattggatccagaaagaaaccctcgttacttttaagaaccctcatgctaaaaagcaagacgtggtcatacttggatcccaggagggcgccatgcacacagcgctgacgggggccaccgaaattcagatgtcaagcggaaatttgctattcactggtcatctgaaatgccggctccgtatggacaagctgcaacttaagggcatgagttactctatgtgtacagggaaattcaaggtggtaaaagagatcgcagagacccagcacggaacaatcgttattcgcgtgcagtatgaaggcgatggttccccatgcaagatcccctttgagattatggacctggagaagagatacgtcttggggaggctcataactgtgaacccgatcgtcaccgagaaggatagccctgtgaacattgaagctgagcccccattcggcgactcgtacatcatcattggagttgagcctggccagctgaagttaaattggtttaaaaaggggtcttccataggacaaatgttcgaaacgaccatgcggggtgccaaacgaatggctatcctgggcgatacagcctgggactttgggtcactaggaggcgtgttcacaagtattggtaaggcactccatcaggtatttggggccatctatggcgctgcgttcagcggagtctcctggaccatgaaaattctgatcggcgtgataatcacatggattgggatgaactctcgcagcacttcacttagtgtttccttggtgctggtcggaatcgtgaccctctacctgggcgtaatggtgcaggcagatagcggttgtgttgtctcttggaagaataaggagcttaaatgcgggtcaggaatttttatcacggacaacgtgcacacatggaccgaacagtataagttccaacccgagagtccaagcaaactggcctccgctatacagaaggcccaggaagagggcatttgtggtatcagatctgtgactaggttggagaatctcatgtggaaacagattacacccgaactgaaccacatcttagcagagaatgaagtcaagctgaccataatgactggcgatatccgggggattatgcaagccggaaaacgctcgctaagacctcagccaaccgagctcaagtacagctggaagacatggggcaaagctaagatgctgtccacggaatcatataaccagacctttcttatcgacgggccggagactgccgagtgccccaatacaaacagggcatggaatagtttggaagttgaggattacggattcggcgtgtttaccacaaacatttggctgaaactcaaggaaaaacaggacgcgttctgtgactctaagctgatgagcgctgccatcaaggataatcgtgcagtgcatgccgacatgggttattggatagagtccgctttaaacgatacttggaaaattgagaaggcctcattcatcgaagtcaagaattgccactggcctaagagccataccctgtggtctaacggggtccttgagtccgaaatgatcattcccaaaaacttggcaggacccgtgagtcaacacaattaccggcctggctaccacacgcagatcgctggtccatggcatctcggcaagctggagatggactttgatttctgtgacgggacaaccgttattgtgactgaagattgcggaaaccgaggccccagcctaagaaccacaactgcctctgggaagctgataaccgagtggtgctgtaggtcctgcacactcccgcctctgcgctatcggggagaggacggctgttggtacggtatggaaatcagaccacttaaagagaaggaagagaatttggtcaactcactggtgacggcggggcacggacaggttgataattttagtttaggcgtgctcggtatggccctgttccttgaagagatgctgaggacccgcgtaggcactaaacatgctattttgctcgtcgcagtgagctttgtgacactgatcaccgggaacatgtcgttcaaggacctaggacgagtcgttgtgatggtaggcgccactatggctgatgacattgggatgggagtgacatatctggccctcctggcagcgtttaaagtccggcccaccttcgccgctggccttttgctgcgtaagttaacgtccaaggagctcatgatgactaccatcggtatagtgctgctttctcaaagcacaatccctgaaaccgttctggagctaactgatgccctcgcactggggatgatggtgttgaaaattgtcagaaatatggaaaagtaccagctggctgtgacaatcatggccattttatgcgttcccaacgcagtgatcctccagaatgcctggaaagtctcatgtaccatactggctgtagtgagtgtttccccacttctgttgacatctagccagcaaaagactgactggattcctctcgcgctgaccatcaaaggactatcccccacggccatctttctgacaaccctttcaaggagcaacaagaaacgcagttggccactcaatgaggcaattatggctgtgggcatggtctctatactggcctccagcttgctgaagaacgacatcccgatgactggccctttagtggccgggggactcctgaccgtatgctatgtgcttacaggtcggtcggctgatctggaattggagagagcaactgacgtcaagtgggaggatcaggccgaaatttcaggctctagtcccatcctctccattaccatcagcgaggacgggtctatgagcatcaaaaatgaagaggaggaacagacgctgacaatcctaattaggaccggactgcttgttatctccggcctcttcccaatttcaatccccataactgcggctgcctggtacctgtgggaggtgaagaaacagcgagccggtgtgttgtgggatgtccctagtccaccccctatggggaaggccgaattagaggacggagcttatcgcattaaacaaaagggcatcctgggctacagccagatcggggcaggagtgtacaaggaaggtacatttcacaccatgtggcatgttactcggggcgccgtactcatgcacaaagggaagagaattgagccgtcttgggcggatgtgaaaaaggacctgatctcctatggaggcggttggaaacttgagggggaatggaaggagggagaagaggtccaggtgctggctttggaaccaggcaagaaccccagggccgttcagacaaaacctggcctattcaagaccaatacggggactataggagcagtgtcactggattttagtccaggtaccagcggctcccccattatcgacaaaaaggggaaagtcgtgggactctacggcaacggtgtagtcacacgttctggggcctatgtgtcggctattgcccaaaccgaaaagagcatcgaggataaccctgaaatagaggacgatattttccgcaagcggagactgacaatcatggaccttcacccgggagcaggcaaaactaagaggtacttacccgctatcgttcgagaagccattaaacggggcctgcgcaccctcatcttggcgccaacgagagtggtcgccgcagagatggaagaggctctgagggggctccctattcggtatcagacacccgccatacgagctgagcatactggaagagaaatcgtggacctgatgtgtcacgcaaccttcacaatgcgccttctgtcaccagttagggtgcctaattacaacttgattatcatggatgaggcccattttaccgaccccgcctccatcgctgcgcgtggttatattagtactcgggtcgaaatgggcgaggcagccgggatattcatgaccgctacaccaccgggatctagagatccttttccccagagcaatgccccaatcattgacgaggaaagggagatccccgaacgctcctggaactcaggccacgagtgggtgacggatttcaagggtaaaactgtatggtttgtgccttctattaaggcagggaatgacatcgccgcttgcctacgaaagaacggcaaaaaggttatacaactgagcagaaaaaccttcgatagtgaatacgtcaagacacggaccaatgactgggattttgtggtgactacagacatctccgagatgggcgcgaacttcaaagccgagagggtcattgatccacgccgttgtatgaagcccgtaatcctcaccgacggcgaagagagagtgattttagcagggcctatgccggttacgcatagctctgctgcccagcggaggggacgcatcggtcgaaatcccaaaaacgaaaatgaccagtacatatatatgggcgagcccctggaaaacgatgaggactgcgcacactggaaggaggccaagatgcttctggataatattaacactcctgaagggatcattccctcaatgtttgagccagaaagagagaaagtggacgctatcgatggagaataccggctcaggggcgaggcccgcaagacattcgtcgacttgatgagaaggggtgatctgcctgtgtggctcgcgtataaagttgcagccgaggggataaattacgctgaccggcgttggtgttttgatggcatcaagaacaaccagattctggaagagaatgtggaagtcgagatctggaccaaagagggagaacgcaagaaacttaaaccccgatggctagacgccagaatttattccgatccactggctttgaaggagttcaaagagttcgcagccggcaggaagagtttaaccctgaacctcatcactgagatggggcggctgcctacatttatgacccagaaaactcgcgacgctcttgataatctggccgtgctccacactgcagaagcgggaggtagagcctacaaccatgctttgagcgagctgccggagacgctagaaaccctgctccttctgacattattggccactgtaaccggcgggatattcctgtttctcatgtcgggaaggggcattggtaagatgacactggggatgtgctgcatcatcaccgcatctattcttctgtggtatgctcaaatccagccccactggatagccgcatccattatcctcgagttctttttgattgtgctgttaatcccagaacctgagaagcagcggactccccaagacaatcagctaacgtacgttgtcatagccatcctgaccgtggtggctgcgacaatggccaacgaaatgggcttcctcgagaaaactaagaaagaccttggactgggcgggattgcaacccagcagccagagagcaatatcttggatattgacctgcgacctgcttcagcctggacactctacgccgtcgcaaccacttttgttacacccatgctgagacatagtatcgaaaactcttccgtgaatgtaagccttacggctattgccaaccaagcgaccgtgctcatgggactgggtaagggctggccgttgtcaaaaatggatatcggggtcccactgttagctataggatgttatagtcaggtgaatcctattactctaacagccgcactgctccttctggttgcccactacgctatcatcggccccggtttgcaggcaaaggccacccgcgaggcgcagaagagggctgccgcagggattatgaaaaacccaaccgtggacggcataacagtcatcgatctggaccccattccttatgatccgaagttcgaaaaacaactcggacaggtaatgctgcttatcttatgcgtgactcaggttctgatgatgcggacgacctgggccctctgtgaggctttgacactggccactggccccattagcaccctatgggaagggaatccaggacgtttttggaacacaaccatcgcagtgtccatggctaatatattcagaggctcttacctggccggtgcggggctcctttttagcatcatgaagaacactacgaatacaaggcgcggaaccggcaacattggtgagactctgggcgagaaatggaagtcccggttgaacgccctggggaaatcagagttccaaatctataagaagtctggcattcaggaggtcgaccgaaccctcgcaaaagaaggcatcaagagaggggagacagatcaccatgctgtgagtaggggatcggccaaactgcgctggtttgtcgagcggaatatggtgactcctgaaggcaaggttgtggacttaggttgcgggagaggaggctggagctactattgtggtggccttaaaaacgtacgtgaggtgaaggggctgaccaagggaggccccgggcacgaagaacctataccaatgtccacatacggatggaatctcgtcaggctacagtctggcgttgatgtgttcttcattccccctgaaaaatgcgacacgctgttgtgtgatatcggtgagtcaagcccaaaccccaccgtcgaggcagggcggactctgcgcgtgctcaatcttgtagaaaactggctgaataacaatacacagttttgcatcaaggtgttgaacccgtacatgccttccgttattgagaaaatggaagctctgcaacgaaagtatggaggcgccctcgtgagaaatccattaagtaggaactctacccatgagatgtactgggtcagcaatgcctcaggcaacatagtgtccagtgtcaatatgatcagccggatgctgattaaccgcttcactatgagacacaaaaaggcgacatatgaacccgacgtggaccttgggtctggaaccaggaacatcggtattgagtccgagaagcctaatctggatatcataggcaaacgaatcgaaaagattaaacaggagcatgaaacgtcatggcactacgaccaggatcacccatataagacctgggcttaccatgggagctatgagacaaaacagactggatcggcatctagtatggttaacggcgtagtgcggctactcaccaagccctgggacgtcctgccgacagtgactcaaatggccatgaccgatacaaccccttttggtcagcagcgtgttttcaaggaaaaagtggacactagaacgcaggagcccaaggaggggaccaaaaagttgatgaaaatcacagctgaatggctgtggaaggagctcggcaaaaagaagactccacgcatgtgtaccagggaagagtttacacggaaagtcagatccaatgccgcacttggcgccattttcacggatgagaacaagtggaaaagcgctcgcgaagcggtggaggactcaaggttttgggaactggtagataaggagcgaaatttacacctggaaggcaaatgcgagacctgtgtgtacaacatgatggggaagcgggagaagaaattgggagagttcggtaaggccaaaggctccagagcaatctggtacatgtggctcggggctaggtttctggagttcgaagccctaggatttcttaatgaggaccattggttctctcgcgaaaacagcctgagtggcgttgagggtgaggggctccacaagctgggatatattttgcgtgatgtctccaaaaaggaaggcggcgcaatgtacgccgacgacactgctgggtgggatacacggataaccctggaggacctcaagaatgaagagatggtgactaaccacatggaaggagagcataagaaacttgccgaggcgatctttaaactgacatatcaaaataaagtggtcagagttcagaggcctaccccacgcggtacagtgatggatattatcagccgacgggaccagagaggctctgggcaagtaggaacttacggcttaaacaccttcacgaatatggaagcacagctgatcaggcagatggagggtgaaggggtgttcaaaaacattcagcacttgaccgtcacagaggaggtggccgttcataattggctcgctcgcgtgggaagagaacggctgtcaaggatggccataagtggcgatgactgcgtcgtgaagccactagatgaccgttttgcaaacgctcttactgccctgaacgatatgggcaagatccgaaaagacattcaacagtgggagccctccaaggggtggaatgattggacccaggtacctttctgcagccaccattttcacgaactcatcatgaaagacggacgcgttctggtggtcccatgtagaaaccaggatgagttgattggtcgggctaggatctctcaaggcgccgggtggtcgttacgcgaaacagcatgcctgggaaagtcatatgcgcagatgtggagcctcatgtacttccacagacgggaccttaggctggccgctaatgccatatgttccgcagtgccgagtcattgggtgcccacttctcgaaccacgtggagcatccacgctaaacatgagtggatgacaaccgaggacatgctaactgtctggaaccgtgtttggattagagaaaatccttggatggaggataagacaccagtggaatcctgggaggaaatcccctatctgggcaagcgcgaggaccagtggtgcggttcactcattgggttgaccagtcgggccacttgggccaaaaacatccaggccgcgataaatcaagtaaggtctctgattggaaacgaggaatacaccgattacatgcctagcatgaagagatttcgccgggaggaagaggaagctggcgtgctttggtga

SEQ ID NO: 14774 - RNA, 9876 nt, synthetic construct
  misc_feature 1..9876: note = derived and/or modified CDS sequence (opt3) from DENV-2__EU660414__SS-prME
  source 1..9876: mol_type = other RNA
agcgcaggaatgatcattatgctgataccaaccgtgatggctttccacctcactactcggaacggggagcctcatatgatcgtcggcattcaggaaaagggtaaatcccttctgtttaagacggaggacggagttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttgggtgctgaggcatcctggcttcaccataatggccgcaatcttggcctacacaattggcaccacgcactttcagcgggttctcatcttcattctgctgactgctgtggcaccatctatgacaatgcgctgcatcgggatatcgaacagagattttgtcgaaggagtgtcaggtggcagctgggtagacattgttctcgagcacgggagttgtgtgaccactatggccaagaataagcccacattagatttcgaactgatcaaaaccgaggctaagcagcctgccacgcttaggaaatattgcattgaagcgaagttgaccaacacaactaccgagtcccggtgtccaacacaaggagagccctctctgaaagaagaacaggacaagcgctttgtctgcaagcatagcatggtggatcgaggctggggtaatgggtgtggactattcggcaaaggcgggatcgtgacttgcgcaatgtttacctgcaagaaaaacatggaaggaaagatcgtccagcctgagaatctcgaatacacaattgttgtgaccccacactccggtgaggagcatgccgtaggcaacgacactgggaaacacggacaggaaataaaggtgacgccgcaatcaagtatcacagaggctgaactgaccggctatggtactgtcaccatggagtgtagccccagaacagggcttgatttcaatgaaatggtgctgttgcagatggagaacaaagcctggctcgttcacaggcagtggtttctggacttacctctgccatggctccccggcgcagataagcaggagtctaattggattcaaaaggaaacccttgtgactttcaaaaaccctcatgctaagaaacaggacgtcgtggtactgggatcccaggagggcgccatgcacacagcgttgacgggggccaccgaaatccaaatgtcaagcggaaatctactgtttactggtcatctcaagtgccggctgcgtatggacaaacttcagctgaagggcatgagttactctatgtgtacagggaagttcaaagttgtgaaggagatagcagagacccagcacggaacaattgtcatccgcgtgcagtatgaaggcgatggttccccatgcaaaatccccttcgagattatggacttggaaaagagatacgtcctcgggaggctgatcactgtgaacccgattgttaccgagaaagatagccctgtgaacatagaagctgagcccccatttggcgactcgtacatcattatcggagtagagcctggccaattaaagctgaattggttcaagaaagggtcttccatcggacagatgtttgaaacgaccatgcggggtgccaagcgaatggctattctaggcgatacagcctgggacttcgggtcactcggaggcgtctttacaagtataggtaaagcactgcatcaggtgttcggggccatctatggcgctgcgtttagcggagtttcctggaccatgaagattcttatcggcgtgattatcacatggatagggatgaactctcgcagcacttcattgagtgtctccctggtgctcgtaggaatcgtgaccctgtaccttggcgttatggtccaggcagatagcggttgtgtggtgtcttggaaaaataaggagctgaagtgcgggtcaggaattttcatcacggacaacgtccacacatggaccgaacaatataaatttcagcccgagagtccaagcaagttggcctccgctattcagaaagcccaggaagagggcatctgtggtataagatctgttactaggctcgagaatctgatgtggaagcaaattacacccgaattaaaccacatcctggcagagaatgaagtgaaactaaccattatgactggcgatatcaaggggataatgcaggccggaaaacggtcgctccgccctcagccaaccgagctgaagtacagctggaagacatggggcaaagctaagatgctttccacggaatcatataaccagaccttcttgatcgacgggccggagactgccgagtgccccaatacaaacagagcatggaatagtctggaagtggaggattacggatttggcgtattcaccacaaacatttggctcaaactgaaggaaaaacaagacgcgttttgtgactctaagttaatgagcgctgccatcaaggataatagggcagtccatgccgacatgggttattggattgagtccgctctgaacgatacttggaaaatcgagaaggcctcattcatagaagtgaaaaattgccactggcctaagagccataccctttggtctaacggggttttggagtccgaaatgattatccccaagaacctcgcaggacccgtgagtcagcacaattaccgtcctggctaccacacgcagatcgctggtccatggcatctgggcaagctagagatggacttcgatttttgtgacgggacaaccgtcattgtgactgaagattgcggaaaccggggccccagcctgcgaaccacaactgcctctgggaagctcatcaccgagtggtgctgtagatcctgcacactgccgcctcttaggtatcgcggagaggacggctgttggtacggtatggaaattcggccattgaaagagaaggaagagaatctggttaactcattagtgacggcggggcacggacaagtagataatttcagtctcggcgtcctgggtatggccctttttctggaagagatgttgagaaccagggtgggcactaaacatgctatactcctggtggcagtcagcttcgttacactaatcaccgggaacatgtcgtttaaggacctgggacgcgtggtagtgatggtcggcgccactatggctgatgacattgggatgggagtgacatatctcgccctgcttgcagcgttcaaagttcgacccacctttgccgctggcttgctgttacggaagctcacgtccaaggagctgatgatgactaccatcggtattgtgcttctgtctcagagcacaatccctgaaaccgtcctagagctcactgatgccctggcattggggatgatggtgctgaaaatagttcgtaatatggaaaagtaccagttagctgtgacaatcatggccattctctgcgtccccaacgcagtaatcctgcagaatgcctggaaagtgtcatgtaccattcttgctgttgtgagtgtctccccactgttgctcacatctagccaacagaagactgactggatccctctggcgctaaccataaaaggactgaaccccacggccattttccttacaaccctctccagaactaataagaaaaggtcatggccactgaacgaggcaatcatggctgtgggcatggtaagcatcttggccagttctctgttaaagaatgacattccgatgaccggccctctcgtggccgggggactgcttacagtctgctatgttctgactggtcgctccgctgatttggaactcgagcgggcaaccgacgtgaagtgggaggatcaggccgaaataagcggctcgtcacccatcctgtctattacgatcagtgaggacgggtccatgagcattaaaaacgaagaggaggaacagacactaaccatcctgataagaactggacttctcgtgatctctggcctgtttccaattagcatccccattacagcggctgcctggtacttgtgggaggtcaagaaacaaagggccggtgtgttatgggatgttccttccccaccccctatggggaaggccgaactggaggacggagcttatcgaatcaaacagaagggcatactcggctactcacagattggggcaggagtatacaaggaaggtaccttccacactatgtggcatgtgacacgcggcgccgtcctgatgcacaaagggaagcggatcgagccgagttgggcggatgtgaaaaaggaccttatcagctatggaggcggttggaaactggagggggaatggaaggagggagaagaggttcaggtgttggctctagaaccaggcaagaatcccagagccgtccaaaccaaacctggcctgtttaagacgaacactgggaccattggagcagtgtctctcgatttctccccaggtacatcaggcagtcccatcatagacaaaaaggggaaagtagtcggactgtacggcaacggtgtggttaccaggagcggggcctatgtgtccgctattgcccagacagagaagtctatcgaggataatcctgaaattgaggacgatatctttcgtaagcgccggcttactataatggacttacacccgggagcaggcaaaaccaagagatacctgcccgctattgtcagggaagccatcaaacgaggcctccggacgttgatcctggcgccaacacgcgtggttgccgcagagatggaagaggctctcagagggctgcctattaggtatcagactcccgccatccgggctgagcataccggacgagaaattgtggaccttatgtgtcacgcaacattcaccatgagactgttgtcgccagtccgcgtgcctaactacaatctaataatcatggatgaggcccatttcactgaccccgccagcattgctgcgaggggttatatctcaacccgtgtagaaatgggcgaggcagccgggatctttatgacagctacgccaccgggaaaccgggatcctttcccccaatccaatgccccaattatagacgaggaaagagagatccccgaaaggagttggaactctggccacgagtgggtgactgattttaagggtaaaaccgtttggttcgtccctagcattaaggcagggaatgacatcgccgcttgcctgcgcaagaacggcaagaaggtgattcagctctcccgaaaaacatttgattcagaatacgtgaagaccagaatcaatgactgggatttcgtcgtaactacagacatatctgagatgggcgcgaactttaaagccgagcgggtgatcgatccaaggcgctgtatgaagcccgttattttaaccgacggcgaagaacgtgtgatcctggcagggcctatgccggtcacgcatagcagtgctgcccagagacggggaaggattggtcgcaatcccaaaaacgaaaatgaccagtacatctatatgggcgagccccttgaaaacgatgaggactgcgcacactggaaggaggccaagatgctgctcgataatataaacactcctgaagggattatcccctccatgttcgagccagaacgagagaaagtggacgctattgatggagaatacagattgcggggcgaggccaggaagacatttgttgacctgatgcgcagaggtgatctccctgtgtggctggcgtataaagtcgcagccgaggggatcaactacgctgacaggcggtggtgtttcgatggcataaagaataaccaaatccttgaagagaatgtggaagtagagatttggaccaaagagggagaacgtaagaagctaaaaccccgctggctggacgcccgaatctatagcgatccattggctttaaaggagtttaaagagttcgcagccggcagaaagtctctgaccctcaacctgattactgagatggggaggcttcctacattcatgacccagaaaacacgggacgctctggataatctcgccgtgttgcacactgcagaagcgggaggtcgcgcctacaaccatgctctgtcagagctaccggagacgctggaaaccctccttctgttaacattgctggccactgttaccggcgggatctttctcttcctgatgtccggaagaggcataggtaagatgacacttgggatgtgctgcattatcaccgcaagtatcctgctctggtatgctcagattcagccccactggatcgccgcaagcataattttggagtttttcctgatcgtcttactaattccagaacctgagaagcaaaggactccccaggacaatcagctgacgtacgtggtgatcgccatactcaccgtcgttgctgcgacaatggccaacgaaatgggctttcttgagaaaactaagaaagacctgggattgggctcgatcgcaacccagcaaccagagtctaatattctggatatcgacctccggcctgcttccgcctggacactgtacgccgtggcaaccactttcgtaacacccatgcttcgacatagcattgaaaactcaagtgtgaatgtctctctcacggctatcgccaaccaggcgaccgtgctgatggggttgggaaagggttggccgctgtccaaaatggatattggcgttccattactagctatcgggtgttatagccaggtgaatcctataactctgacagccgcactccttctgttggtcgcccactacgctattatcggacccggcctgcaggcaaaggccaccagagaggcgcaaaagcgcgctgccgcaggtatcatgaaaaacccaaccgtagacgggattacagtgatagatctcgaccccatcccttatgatccgaagtttgaaaaacagctgggccaggttatgcttttaattctgtgcgtgactcaagtcctcatgatgaggacgacctgggccttgtgtgaggctctgacactagccactggacccatctcaaccctgtgggaaggcagtccagggcggttctggaatacaaccattgcagtgagcatggctaacatctttcgtggatcctacctcgccggcgcgggtcttctgttctctataatgaagaatactacgaacacaagaagggggaccggaaacatgggcgagactttgggtgagaaatggaaaagccgcctgaatgccctcggcaaatccgaatttcagatctataagaagtcagggattcaggaggtcgaccggaccctggcaaaagaaggaatcaagcgaggcgagacagatcaccatgctgtgtctagagggagtgccaaattaaggtggttcgttgagcgcaacatggtgactcctgaaggaaaggtagtggaccttggctgcggtagagggggatggtcgtactattgtggcggtctgaaaaatgtcagagaggttaagggcctcaccaaagggggacccggccacgaggaacctattccaatgagcacatacgggtggaacctagtgcgtctgcagtccggagtcgatgtgtttttcatcccacctgaaaaatgcgacacgttgctgtgtgatataggcgagtcttcaccaaatcccaccgtagaggcaggtaggactctccgggtgcttaacctggttgaaaattggttgaacaataacacacaattctgcattaaggtgctgaatccgtacatgcctagcgtcatcgagaaaatggaagctctccagcgcaagtatgggggagccttagtgcgaaacccactgtccagaaatagtacccatgagatgtactgggtctctaacgccagcggcaatatcgtgtcatccgttaacatgattagtaggatgcttataaaccggtttactatgcgccacaaaaaggcgacatatgaacccgacgtagacctgggcagcgggaccagaaatatcggaattgagtctgagacgcctaacctagatatcattggtaagaggatcgagaaaataaagcaggagcatgaaacctcctggcactacgaccaggatcacccatataaaacatgggcttaccatggctcatatgagactaagcaaaccgggagcgcatcgtctatggtgaatggagtcgtgcgactcctgacaaaaccctgggacgttttgccgactgtgacccagatggccatgacagataccactcctttcggccagcagcgggtctttaaggaaaaggtggacacgcgtacacaagagcccaaagagggtaccaagaaactgatgaagatcactgctgaatggctctggaaagagcttgggaagaaaaagaccccaagaatgtgtacacgcgaagagttcacgaggaaggtacggagtaacgccgcactgggagccatttttaccgatgagaataaatggaagtccgctagagaagcggtggaggacagccgcttctgggaattagttgataaagagaggaacctgcacttggaaggcaagtgcgagacttgtgtctacaatatgatgggcaaacgagagaagaagctcggggaatttggaaaagccaagggttcacgggcaatctggtacatgtggctgggcgctagattcctagagtttgaagcccttgggttcctgaacgaggaccattggttttccagggaaaattctctcagcggagtggagggcgagggtctgcacaaattggggtatattctgcgcgatgtgagtaagaaagaaggaggcgcaatgtacgccgacgacacagctggctgggatacccgtatcactctcgaggaccttaagaacgaagagatggtcacaaatcacatggaaggggagcataagaaactggccgaggcgattttcaagttaacctatcagaacaaagttgtgcgggtacagagacctacacccaggggaactgtgatggatataatctcccgccgagaccaacggggtagcggccaggtcgggacctacggactgaatacgtttaccaacatggaagcacagttgattagacagatggagggcgaaggtgtgttcaagaatatccaacacctcacagttactgaggaggtggccgtccagaactggctggctagggtggggcgcgaaagactatctcggatggccatctcaggagatgactgcgtagttaaaccacttgatgacaggttcgcaaacgctctgaccgccctcaatgatatgggcaagattcgtaaggacatacagcagtgggagcccagtaaaggctggaacgattggacacaagtgcctttttgctcccatcacttccatgaactgatcatgaaggacgggcgagtcttggtggtgccatgtcgcaatcaggatgagttaattggtagagctcggatcagccagggagccggctggtctctgagggaaactgcatgcctcgggaaatcgtatgcgcagatgtggtcacttatgtactttcaccgcagagacctgcggctagccgctaacgccatttgtagcgcagtcccgtcccactgggttcccaccagtaggacgacatggtctatccatgctaagcacgagtggatgaccactgaggacatgctgacagtgtggaatcgagtatggatacgtgaaaacccttggatggaggataaaaccccagtggaaagctgggaggaaatcccctatctcggaaagagagaggaccaatggtgcggctccttgattggtctgacttcacgcgccacctgggcaaagaatatccaggtcgccattaaccaggtgcggagtcttatcgggaatgaggaatacacagattacatgccttctatgaaaaggttcagacgcgaggaagaggaagcgggagttctgtggtga

SEQ ID NO: 14775 - RNA, 9876 nt, synthetic construct
  misc_feature 1..9876: note = derived and/or modified CDS sequence (opt3) from DENV-2__EU660415__SS-prME
  source 1..9876: mol_type = other RNA
agcgccggcatgataattatgctgatacccaccgtgatggctttccacctcactactagaaacggggagcctcatatgatcgtcggtattcaagaaaagggtaaatcccttctgtttaagacggaggacggcgttaatatgtgcaccttgatggcaatggatttaggggaactgtgtgaggacacgatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaggaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagcggtacgtgctcgggaggctgattactgtcaacccgatagtgaccgagaaggatagccctgttaacatcgaagctgagcccccatttggcgactcgtacattatcatcggagtgggccctgggcagttaaagctgaattggttcaaaaagggatcttccattggtcaaatgtttgagacgaccatgcggggcgccaaacgaatggctatactaggggatacagcctgggacttcggatcactcggcggtgtatttacaagtatcgggaaggcactgcatcaggtcttcggcgccatttatggagctgcgtttagcggcgtgtcctggaccatgaaaatccttattggggttatcataacatggatcggaatgaactctcgcagcacttcattgagtgtgtccctggtcctcgtgggcattgtaaccctgtaccttggtgtgatggttcaggcagatagcgggtgtgtcgtgtcttggaagaataaggaactgaaatgcggatcaggcatcttcattacggacaacgtgcacacatggaccgagcagtataagtttcaacccgaaagtccaagcaaattggcctccgctatccagaaggcccaggaggaaggtatatgtggcattagatctgtcactaggctcgagaatctgatgtggaaacagatcacacccgagttaaaccacattctggcagaaaatgaggttaagctaaccatcatgactggggatataaaaggaatcatgcaagccggcaagcggtcgctccgccctcagccaaccgaactgaagtacagctggaaaacatgggggaaggctaaaatgctttccacggagtcatataaccagaccttcttgattgacggaccggaaactgccgagtgccccaatacaaacagagcatggaatagtctggaggtggaagattacggctttggtgtgttcaccacaaacatctggctcaagctgaaagagaagcaggacgcgttttgtgactctaagttaatgagcgctgccattaaagataatagggcagtacatgccgacatggggtattggatcgaatccgctctgaacgatacttggaagatagagaaagcctcattcattgaggtcaagaattgccactggcctaaaagccataccctttggtctaacggagtgttggaatccgagatgatcatcccaaagaacctcgcaggccccgttagtcaacacaattaccgtctgggttaccacacgcagattgctggcccttggcatctagggaagctggaaatggacttcgatttttgtgacggaacaaccgtgatcgtcactgaggattgcggcaaccgggggccaagcctccgaaccacaactgcctctggaaaactgattaccgaatggtgctgtagatcctgcacacttcccccgttgaggtatcgcggcgaggacggttgttggtacgggatggagatacggcctctgaaggaaaaagaggaaaatttagtgaactcactcgttacggcgggacacggccaggtggataatttcagtctgggtgtacttggcatggccctgtttttggaggaaatgctcagaaccagggtcgggactaagcatgctatcctgctagtggcagtgagcttcgtcacactgattaccggaaacatgtcgtttaaagacctcggccgcgttgtggtaatggtgggggccactatggctgatgacatcggaatgggcgtcacatatctggcccttttggcagcgttcaaggtgcgaccaacctttgccgctggtctgttactccggaagctgacgtccaaagagcttatgatgactaccattgggatcgttctgctatctcaaagcacaatacccgagaccgtgctcgaactgactgatgccttggcactgggaatgatggtcttaaagatcgtgcgtaatatggagaaataccagctcgctgttacaattatggccatcctgtgcgtgcctaacgcagtcattcttcagaatgcctggaaggtatcatgtaccatcctggctgtggttagtgtgtcccccttgctcctgacatctagccagcagaaaactgactggataccactagcgctgaccattaagggccttaaccctacggccatcttcctcacaaccctgtccagaactaataaaaagaggtcatggcccttgaacgaagcaatcatggctgtcggcatggtgagcattctggccagttctttactcaagaatgacataccaatgaccgggccgctggtagccggaggtcttctgacagtgtgctatgtcttgactggccgctccgctgatctcgagctggaacgggcaaccgacgttaaatgggaggatcaggccgagatcagcgggtcgtcacctattctatctatcacgattagtgaagacggatccatgagcatcaagaacgaggaagaggagcagacactgaccatacttatcagaactggcctcctggtgatttctggtttgtttcccatcagcattccaatcacagcggctgcctggtacttatgggaagtgaaaaagcagagggcaggggtcctgtgggatgtgccctcccctccacccatgggaaaagccgagctcgaagacggcgcttatcgaataaagcaaaagggcattctggggtactcacagatcggagcaggagtttacaaagagggcaccttccacactatgtggcatgtaacacgcggggccgtgcttatgcacaagggaaaacggatcgaacctagttgggcggatgtcaagaaagacctgattagctatggcggtgggtggaagttggagggagagtggaaggaaggcgaggaagtgcaggttctagctctggagccgggcaaaaatccaagagccgtgcagaccaagcccgggctctttaaaacgaacactggaaccatcggtgcagtctctctggatttctcccctggcacatcagggagtccaataattgacaagaaaggaaaggtggtaggcctttacggtaacggggtcgtgaccaggagcggagcctatgtttccgctatcgcccaaacagaaaagggcattgaggataatcccgagatcgaagacgatatatttcgtaaacgccggttaactattatggacctgcaccctggcgcagggaagaccaaaagatacctcccggctatcgtgagggaggccatcaagcgaggattgcggacgctgattctcgcgcccacacgcgtcgtggccgcagaaatggaggaagctctgagaggtcttccaatcaggtatcagactcctgccattcgggctgagcataccggccgagagatagttgacctgatgtgtcacgcaacattcaccatgagattgctatctcccgtgcgcgtcccaaactacaatctgatcattatggatgaagcccatttcactgaccctgcctcgatcgctgcgagggggtatatcagcacccgtgtggagatgggagaagcagccggcatttttatgacagctacgcccccaggttcacgggatccgttccctcagtccaacgcccccataatcgacgaggagagagaaattccagagaggagttggaactctgggcacgaatgggtaactgattttaaaggaaagaccgtgtggttcgttcccagcatcaaggcaggcaacgacattgccgcttgcctccgcaaaaatggcaagaaagtcatccaattatcccgaaagacatttgattcagagtacgtgaaaaccagaactaacgactgggatttcgtggtcacaaccgacatatctgaaatgggggcgaattttaaggccgagcgggtaatcgatcctaggcgctgtatgaaaccagtgattctgacggacggagaggaacgtgttatccttgcaggtcccatgcctgtgactcatagcagtgctgcccagagacggggcaggattgggcgcaacccgaagaatgagaacgaccagtacatctatatgggagaaccactggagaatgatgaagactgcgcacactggaaggaggccaaaatgctcttggataacataaatacacccgagggcattatcccttccatgttcgaacccgagcgagaaaaggtcgacgctattgatggtgagtacagactgagaggggaagccaggaaaacctttgtggacctcatgcgcagaggcgatctgccagtttggcttgcgtataaggtggcagccgagggaatcaactacgctgacaggcggtggtgtttcgatggcatcaaaaataatcagatcctagaggaaaacgtcgaggtggaaatttggaccaaggagggggagcgtaagaaactgaagcctcgctggttggacgcccgaatctatagcgatcccttagctctgaaagaatttaaggagttcgcagccggaagaaaatctctcactctgaatcttattacagaaatgggtaggctgccaaccttcatgacacaaaagactcgggacgctctcgataacttggccgtactgcacacggcagaggcgggcgggcgcgcctacaatcatgctctatcagaactgcctgagaccctcgagacacttctgttattgactctgctcgccaccgtgacaggaggcatctttctgttccttatgtccggtagagggataggcaagatgaccctgggaatgtgctgcattatcactgcaagtatcctcttgtggtatgctcagattcagccgcactggatcgccgcaagcataattctggaatttttcttaatcgttctactgattcccgagccagaaaaacagaggacgcctcaagacaaccagctcacctacgtcgtgatcgccatacttacagtggtcgctgcgactatggccaatgagatgggctttctggaaaagaccaaaaaggacttcgggttgggatcgatcgcaacacagcagcccgagtctaacattctggatatcgacctccggccagcttccgcctggaccctgtacgccgttgcaactacatttgtgacgcctatgcttcgacatagcattgaaaattcaagtgtaaacgtgtctctcaccgctatcgccaatcaagcgactgtcctgatgggtttgggcaaagggtggcccctgtccaagatggatattggagtgccgttactagctatcggctgttatagccaggttaacccaataacactgaccgccgcactccttctgttggtggcccactacgctattatcggtcctgggctgcaggcaaaggccaccagagaagcgcagaaacgcgctgccgcaggcatcatgaagaatcccacagtcgacggaattactgtaatagatctcgacccaatcccctatgatcctaaattcgagaagcaactgggccaggtgatgcttttaattctgtgcgttacacaggtgctcatgatgaggaccacatgggccttgtgtgaagctctgactctagccaccgggccgatctcaacactgtgggagggaaaccccggccggttttggaataccactattgcagtcagtatggctaacatcttccgtggtagctacctcgccggggcgggacttctgttttccataatgaaaaatacgacaaacaccagaaggggcactggtaacatcggcgaaaccttgggggagaagtggaaatctcgcctgaatgccctcggaaagagcgagttccaaatttataagaaatccggcatccaggaagtggaccggacactggcaaaggaggggattaaacgaggagaaactgatcaccatgctgtctcaagaggctctgccaagttaaggtggtttgtggagcgcaacatggttaccccagagggtaaagtggtagaccttgggtgcggacggggcggttggagttactattgtggcgggctgaagaatgtgagagaagtcaagggactcacaaaaggcgggcctggacacgaggaacccatccctatgtcgacgtacggctggaacctagttcgtctgcagagcggtgtggatgtcttcttcataccacccgagaagtgcgacaccttgctgtgtgatattggggaatcctctcctaatccaactgtggaggcaggaaggacactccgggtacttaacctggtggagaattggttgaacaataacacccagttttgcatcaaagttctgaatccctacatgccgtcagtgatcgaaaagatggaggctctccaacgcaaatatggcggcgccttagtccgaaaccctctgagcagaaattccactcatgaaatgtactgggtgagtaacgcctctgggaatattgtcagctcagtgaacatgatatccaggatgcttatcaaccggttcacaatgcgccacaagaaggcgacctatgagccagacgttgacctgggaagtggtacgagaaatattggcatcgaaagcgagattcccaacctagatatcatagggaaaaggatcgagaagattaaacaggaacatgagacctcttggcactacgaccaggatcacccttataagacatgggcttaccatggatcctatgaaactaaacagaccggctcagcaagctcgatggtaaatggtgtggtccgactcctgacaaagccatgggacgtgttgcccactgttacccaaatggccatgacagataccactccgtttgggcagcagcgggtgttcaaggagaaagtcgacacgcgtacacaggaacctaaggagggaaccaaaaagctgatgaaaatcactgctgagtggctctggaaggaacttggcaaaaagaagacccccagaatgtgtacacgcgaggaatttacgaggaaagtgcggtctaacgccgcactgggcgccattttcaccgatgagaataagtggaaaagtgctagagaggcggtagaagactcccgcttttgggagttagtggataaggaaaggaacctgcacttggaggggaaatgcgaaacttgtgtttacaatatgatgggaaagcgagagaagaaactcggtgagttcggcaaggccaaagggagccgggcaatctggtacatgtggctgggagctagatttctagagttcgaggcccttggctttctgaacgaagaccattggttctcaagggaaaattccctctctggtgtcgaaggggagggactgcacaagttgggctatattctgcgcgatgtgagcaaaaaggagggcggggcaatgtacgccgacgacacagctggatgggatacccgtataactctcgaagaccttaagaacgaggaaatggtgacaaatcacatggagggtgaacataaaaagctggccgaggcgatctttaaattaacctatcaaaacaaggtcgttcgggtgcagagaccaacacctaggggcactgtaatggatattatcagtcgccgagaccagcgggggtccggacaagtgggcacctacggtctgaatacgttcaccaacatggaggcacagttgatcagacagatggaaggggagggagtcttcaaaaatattcagcacctcacagtgactgaagaggttgccgtgcaaaactggctggctagggtcggccgcgagagactaagccggatggccatatctggcgatgactgcgtggtaaagccccttgatgacaggtttgcaaacgctctgaccgccctcaatgatatggggaagatccgtaaagacattcagcagtgggaaccatcaaagggatggaacgattggacacaggttcccttctgcagtcatcactttcatgagctgatcatgaaagacggtcgagtgttggtcgtgccttgtcgcaatcaagatgaattaattggcagagctcggatctcccagggggccggatggagcctgagggagactgcatgcctcggcaagtcttatgcgcagatgtggtcgcttatgtacttccaccgcagagacctgcggctagccgctaacgtgatatgttcagccgtcccaagccactgggttccgacctccaggacgacatggagtatccatgcaaaacacgaatggatgaccactgaggacatgctgacagtgtggaatcgagtatggattcgtgagaacccctggatggaagataagacccctgtggagtcttgggaagagatcccatatctcggtaagagagaagaccagtggtgcgggagcttgattggactgacttcccgcgctacctgggccaaaaatatccaagcagccataaaccaggtccggtcacttattggcaatgaggagtacacagattacatgcccagtatgaagaggtttagacgcgaagaggaagaggcgggcgtgctgtggtga

SEQ ID NO: 14776 - RNA, 9876 nt, synthetic construct
  misc_feature 1..9876: note = derived and/or modified CDS sequence (opt3) from DENV-2__EU687249__SS-prME
  source 1..9876: mol_type = other RNA
agcgccggcatgatcattatgctgatacccaccgtgatggctttccacctcacaactagaaacggggagcctcatatgatcgtcggaattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagagcaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaagcttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggaaaaaagatacattctcgggaggctgataactgtgaacccgatcgtcaccgagaaggatagccctgtgaacattgaagctgagcccccatttggcgactcgtacatcatcattggagttgagcctggccagttaaagctgaattggttcaaaaaggggtcttccataggacaaatgtttgaaacgaccatgcggggtgccaaacgaatggctatcctaggcgatacagcctgggacttcgggtcactcggaggcgtgtttactagtattggtaaggcactgcatcaggtattcggggccatctatggcgctgcgtttagcggagtctcctggaccatgaaaattcttatcggcgtgataatcacatggattgggatgaactctcgcagcacttcattgagtgtttccctggtgctcgtcggaatcgtgaccctgtaccttggcgtaatggtgcaggcagatagcggttgtgttgtctcttggaagaataaggagctgaaatgcgggtcaggaattttcatcacggacaacgtgcacacatggaccgaacagtataagtttcaacccgagagtccaagcaaattggcctccgctatacagaaggccagagaagagggcatttgtggtatcaggtctgtgactcggctcgagaatctgatgtggaaacagattacacccgaattaaaccacatcctggcagagaatgaagtcaagctaaccataatgactggcgatatcaaagggattatgcaggccggaaagcgctcgctcagacctcaaccaaccgagctgaagtacagctggaaaacatggggcaaggctaaaatgctttccacggaatcatataaccagaccttcttgatcgacgggccggagactgccgagtgccccaatacaaacagggcatggaatagtctggaagttgaggattacggatttggcgtgttcaccacaaacatttggctcaagctgaaagaaaagcaggacgcgttttgtgactctaagttaatgagcgctgccatcaaagataatcgtgcagtgcatgccgacatgggttattggatagagtccgctctgaacgatacttggaagattgagaaagcctcattcatcgaagtaaagaattgccactggcctaaaagccataccctttggtctaacggggtcttggagtccgaaatgatcattccaaagaacctcgcaggacccgtgagtcagcacaattaccggcctggctaccacacgcaaatcgctggtccatggcatctgggcaagctagagatggacttcgatttttgtgacgggacaaccgttattgtgactgaagattgcggaaaccgaggccccagcctgagaaccacaactgcctctgggaaactcataaccgagtggtgctgtaggtcctgcacactgccgcctcttcgctatcggggagaggacggctgttggtacggtatggaaatcagaccattgaaggagaaagaagagaatctggtcaactcattagtgacggcggggcacggacaggttgataatttcagtctcggcgtgctgggtatggccctttttctggaagagatgttgaggacccgcgtaggcactaagcatgctattctcctggtcgcagtgagcttcatgacactaatcaccgggaacatgtcgtttaaagacctgggacgagtggtcgttatggtgggcgccactatggctgatgacattgggatgggagtaacatatctcgccctgcttgcagcgttcaaggtgcggcccacctttgccgctggcttgctgttacgtaagctcacgtccaaagagctgatgatgactaccatcggtatagtccttctgtctcagagcacaatccctgaaaccgtgctagagctcactgatgccctggcattggggatgatggttctgaagattgtgagaaatatggaaaaataccaattagctgtcacaatcatggccattctctgcgtgcccaacgcagttatcctgcagaatgcctggaaggtgtcatgtaccatacttgctgtcgtaagtgtgtccccactgttgctcacatctagccagcagaaaactgactggattcctctggcgctaaccatcaagggactgaaccccacggccatcttccttacaaccctctccaggactaataaaaagcgctcatggccactgaacgaggcaattatggctgttggcatggtgagcatattggccagttctctgttaaagaatgacatcccgatgaccggccctctcgtcgccgggggactgcttacagtgtgctatgtactgactggtcggtccgctgatttggaactcgagagagcaaccgacgtgaaatgggaggatcaagccgaaattagcggctcgtcacccatcctgtctattacgatcagtgaggacgggtccatgagcataaagaacgaagaggaggaacagacactaaccatcctgattaggactggacttctcgtcatctctggcctgtttccaattagcatccccataacagcggctgcctggtacttgtgggaggttaaaaagcagcgagcaggtgtgttatgggatgtgccttccccaccccctatggggaaagccgaactggaggacggagcttatcgcattaagcagaagggcatcctcggctactcacaaatcggggcaggagtctacaaagaaggtaccttccacactatgtggcatgtgacacggggcgccgttctgatgcacaaggggaaaagaattgagccgagttgggcggatgtaaagaaagaccttatcagctatggaggcggttggaagctggagggggaatggaaggagggagaagaggtgcaggtcttggctctagaaccaggcaaaaatcccagggccgtgcagaccaagcctggcctgtttaaaacgaacactgggaccataggagcagtttctctcgatttctccccaggtacatcaggcagtcccattatcgacaagaaagggaaggtggtcggactgtacggcaacggtgtggtaacccgtagcggggcctatgtctccgctattgcccagacagagaagtctatcgaggataatcctgaaatagaggacgatatttttcgcaaacggagacttactatcatggacttacacccgggagcaggcaagaccaaaaggtacctgcccgctatcgtgcgagaagccattaagcggggcctccgcacgttgatcctggcgccaacaagagttgtggccgcagagatggaagaggctctcagggggctgcctattcggtatcaaactcccgccatacgagctgagcataccggaagagaaatcgtcgaccttatgtgtcacgcaacattcaccatgcgcctgttgtcgccagtgagggttcctaactacaatctaattatcatggatgaggcccatttcactgaccccgccagcatcgctgcgcgtggttatatttcaacccgggtggaaatgggcgaggcagccgggatatttatgacagctacgccaccgggatccagagatcctttcccccagagtaacgccccaatcattgacgaggaaagggagatccccgaacgctcttggaatagcggccacgagtgggtcactgattttaaaggtaagaccgtgtggttcgtaccttccattaaggcagggaacgacatcgccgcttgcctgcgaaaaaatggaaagaaagtgatacagctctcaagaaagacatttgattctgaatacgttaaaacccggactaacgactgggatttcgtcgtgacaaccgacatcagcgagatgggcgcgaattttaaggccgagagggtgattgatccacgccgttgtatgaaacccgtcatcttaacggacggcgaagagagagtaattctggcagggcctatgccggtgactcatagttccgctgcccaacggaggggacgcatcggtcgaaacccaaagaatgaaaacgaccagtacatatatatgggcgagccccttgaaaatgatgaggactgcgcacactggaaggaggccaaaatgctgctcgataacattaatacacctgaagggatcattcccagcatgttcgagccagaaagagagaaggttgacgctatcgatggagaataccggttgaggggcgaggcccgcaaaacctttgtggacctgatgagaaggggtgatctccctgtctggctggcgtataaggtggcagccgaggggataaactacgctgaccggcgttggtgtttcgatggcatcaaaaacaatcagattcttgaagagaacgttgaagtggagatctggaccaaggagggagaacgcaagaaactaaagccccgatggctggacgccagaatttattctgatccattggctttaaaagagtttaaggaattcgcagccggcaggaaatcactgactctcaatctgatcacagagatggggcggcttcctaccttcatgacacagaagactcgcgacgctctggataacctcgccgtcttgcacacggcagaagcgggaggtagagcctacaatcatgctctgtccgagctaccggagaccctggaaacactccttctgttaactttgctggccaccgtgacaggcgggatatttctcttcctgatgagtggaaggggcattggtaagatgacccttgggatgtgctgcatcatcactgcaagcattctgctctggtatgctcaaatccagccccactggatagccgcatcgattatcttggagtttttcctgattgtattactaatcccagaacctgagaaacagcggacgccccaggacaaccaactgacctacgtggttatagccatcctcacagtcgtggctgcgactatggccaatgaaatgggctttcttgagaagaccaaaaaggacctgggattgggctctattgcaacacagcagccagagtccaacatcctggatattgacctccgacctgctagcgcctggaccctgtacgccgtggcaactacattcgtcacgcccatgcttagacattcaatcgaaaatagttctgttaacgtgtccctcaccgctattgccaatcaggcgactgtactgatggggttgggaaaaggttggccgctgagcaagatggatatcggcgtgccattactagctatagggtgttattcacaagtcaaccctattacactgaccgccgcactccttctgttggtggcccactacgctatcatcggacccggcctgcaggcaaaggccacccgcgaggcgcagaaaagggctgccgcaggtattatgaagaatccaacagttgacgggataactgtgatcgatctcgaccccattccttatgatccgaaatttgaaaagcagctgggccaagtcatgcttttaatcctgtgcgtaacgcaggtgctcatgatgcggaccacatgggccttgtgtgaggctctgactctagccaccggacccattagtacactgtgggaaggcaacccagggcgtttctggaataccactatcgcagttagcatggctaacatatttagaggatcctacctcgccggcgcgggtcttctgttctctatcatgaaaaatacgacaaacaccaggcgcgggactggaaacattggcgagaccttgggtgagaagtggaaaagccggctgaatgccctcggcaagtccgaatttcagatctataagaaatcagggattcaagaggtggaccgaacactggcaaaggaaggaatcaaaagaggcgagactgatcaccatgctgtctctagggggagtgccaagttacgctggttcgtggagcggaacatggtcacccctgaaggaagagtggttgaccttggctgcggtcgtgggggatggtcgtactattgtggcggtctgaaaaatgtgagggaggtaaagggcctcacaaaggggggacccggccacgaagagcctataccaatgagcacgtacgggtggaacctagtgcggctgcagtccggagtcgatgtttttttcattccccctgaaaaatgcgacaccttgctgtgtgatatcggcgagtcttcaccaaatcccactgtggaggcaggtcgcacactccgagtccttaacctggtggaaaattggttgaacaataacacccagttctgcatcaaggtactgaatccgtacatgcctagcgtgattgagaaaatggaagctctccagagaaagtatgggggagccttagttaggaacccactgtcccggaatagtactcatgagatgtactgggtgtctaacgccagcggcaatatagtctcatccgtgaacatgatcagtcgcatgcttattaacagatttacaatgaggcacaaaaaggcgacctatgaacccgacgtcgacctgggcagcgggacgcgaaatatcggaattgagtctgaggtgcctaacctagatatcataggtaagcggatcgaaaaaattaagcaagagcatgaaacctcctggcactacgaccaggatcacccatataaaacatgggcttaccatggctcatatgagactaagcagaccgggagcgcatcgtctatggttaatggagtagtgcgtctcctgacaaaaccctgggacgtcttgccgactgtgacccagatggccatgacagataccactcctttcggccaacagagagtttttaaggaaaaggtggacacgcgcacacaggagcccaaagagggtaccaagaaactgatgaagatcactgctgaatggctctggaaagagcttgggaagaaaaagaccccaaggatgtgtacacgggaagagttcacgagaaaggtccgcagtaacgccgcactgggagccatttttaccgatgagaataaatggaagtccgctagggaagcggtggaggacagccgattctgggaattagtagataaagagcggaacctgcacttggaaggcaagtgcgagacttgtgtgtacaatatgatgggcaaaagagagaagaagctcggggaatttggaaaagccaagggttcaagggcaatctggtacatgtggctgggcgctcgcttcctagagtttgaagcccttgggttcctgaacgaggaccattggttttcccgtgaaaattctctcagcggagttgagggcgagggtctgcacaaattggggtatattctgcgggatgtcagtaagaaagaaggaggcgcaatgtacgccgacgacacagctggctgggataccagaataactctcgaggaccttaagaacgaagagatggtgacaaatcacatggaaggggagcataagaaactggccgaggcgatcttcaagttaacctatcagaacaaagtggtcagggttcaacgccctacaccccgaggaactgtgatggatattatctcccggagagaccagaggggtagcggccaggtagggacctacggactgaatacgtttaccaacatggaagcacaattgatccgccagatggagggcgaaggtgtgttcaagaatattcagcacctcacagtcactgaggaggtggccgttcagaactggctggctagagtggggcgggaaaggctatctcgtatggccatatcaggagatgactgcgtcgtgaaaccacttgatgaccgattcgcaaacgctctgaccgccctcaatgatatgggcaagatccgcaaggacattcaacagtgggagcccagtaaaggctggtccgattggacacaggtacctttttgcagccatcacttccatgaactgatcatgaaggacgggagagttttggtggtcccatgtcggaaccaggatgagttaattggaagggctcgcatctctcaaggtgccggctggtcgctgagagaaactgcatgcctcgggaaatcatatgcgcagatgtggagccttatgtactttcaccggagggacctgcgactagccgctaatgccatatgttccgcagtgccgagtcactgggtgcccacctctcgtacgacatggagcatccatgctaagcacgagtggatgaccactgaggacatgctgacagtctggaacagagtttggattcgcgaaaatccttggatggaggataaaaccccagtggaatcctgggaggaaatcccctatctcggaaagcgggaggaccagtggtgcggctcattgattggtctgactagtagggccacctgggcaaagaacatccaggccgcgataaatcaagtaagatctcttattgggaacgaggaatacacagattacatgcctagcatgaaacgcttccggagggaggaagaggaagctggagtgctgtggtga

SEQ ID NO: 14777 - RNA, 9876 nt, synthetic construct
  misc_feature 1..9876: note = derived and/or modified CDS sequence (opt3) from DENV-2__EU660416__SS-prME
  source 1..9876: mol_type = other RNA
agcgccggcatgatcattatgctgatacccaccgtgatggctttccacctcacaactagaaacggggagcctcatatgatcgtcggaattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagagcaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaagcttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggaaagaaggtacgtgctcgggcggctgattactgtcaacccgatagtgaccgagaaagatagccctgttaacatcgaagctgagcccccatttggcgactcgtacattatcatcggagtggagcctggccagttaaagctgaattggttcaagaaagggtcttccattggacaaatgtttgaaacgaccatgcgaggtgccaagcgcatggctatactaggcgatacagcctgggacttcgggtcactcggaggcgtatttactagtatcggtaaagcactgcatcaggtcttcggggccatttatggcgctgcgtttagcggagtgtcctggaccatgaagatccttattggcgttatcataacatggatcgggatgaactctagaagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacagtataaatttcaacccgagagtccaagcaagttggcctccgctatccagaaagcccaggaagagggcatatgtggtattaggtctgtcactcggctcgagaatctgatgtggaagcagatcacacccgaattaaaccacattctggcagagaatgaagttaaactaaccatcatgactggcgatataaaggggatcatgcaagccggaaaacgctcgctcagacctcagccaaccgagctgaagtacagctggaagacatggggcaaagctaagatgctttccacggaatcatataaccagaccttcttgattgacgggccggagactgccgagtgccccaatacaaacagggcatggaatagtctggaagtggaggattacggatttggcgtgttcaccacaaacatctggctcaaactgaaggaaaaacaggacgcgttttgtgactctaagttaatgagcgctgccattaaggataatcgtgcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatcccaaaaaacctcgcaggacccgttagtcaacacaattaccggcctggctaccacacgcagattgctggtccatggcatctgggcaagctagagatggacttcgatttttgtgacgggacaaccgtgatcgtcactgaagattgcggaaaccgaggccccagcctgagaaccacaactgcctctgggaagctcattaccgagtggtgctgtaggtcctgcacactgccgcctcttcgctatcggggagaggacggctgttggtacggtatggaaataagaccattgaaagagaaggaagagaatctggtgaactcattagttacggcggggcacggacaggtggataatttcagtctcggcgtactgggtatggccctttttctggaagagatgttgaggacccgcgtcggcatgaaacatgctatcctcctggtggcagtgagcttcgtcactctaattacagggaacatgtcgtttaaggacctgggacgagttgtggtaatggtgggcgccaccatggctgatgacatcgggatgggagtcacttatctcgccctgcttgcagcgttcaaagtgcggcccacatttgccgctggcttgctgttacgtaagctcacctccaaggagctgatgatgacgactattggtatcgttcttctgtctcaaagcaccatacctgaaacagtgctagagctcaccgatgccctggcattggggatgatggtcctgaaaatcgtgagaaatatggaaaagtaccagttagctgttactattatgacaatcctctgcgtgcccaacgccgtcattctgcagaatgcatggaaagtatcatgtaccatccttgccgtggttagtgtgtccccactgttgctcacatctagcaggcagaagactgactggatacctctggctctaaccattaaaggactgaaccccacggcgatcttccttacaaccctctcccgcactaataagaaacggtcatggccactgaacgaggccatcatggcagtcggcatggtgagcattttggctagttctctgttaaagaatgacataccgatgaccggccctctcgtagccgggggactgcttacagtgtgctatgtcctgactggtagatccgccgatttggaactcgagagggctaccgacgttaagtgggaggatcaagcagaaatcagcggctcgtcacccattctgtctatcacgattagtgaggacgggtccatgagcatcaaaaacgaagaggaggaacagacactaaccatactgatccgaactggacttctcgtgatttctggcctgtttccaatcagcattcccatcacagccgcggcttggtacttgtgggaggtgaagaaacagcgcgccggtgtcttatgggatgtgccttccccaccccctatggggaaggcagaactggaggacggagcctatcggataaaacagaagggcattctcggctactcacaaatcggggctggagtttacaaggaaggtaccttccacactatgtggcatgtaacaagaggcgcagtgctgatgcacaaagggaagaggatcgagccgagttgggccgatgtcaaaaaggaccttattagctatggaggcggttggaaactggagggggaatggaaggagggagaagaggtgcaggttttggcgctagaaccaggcaagaatccccgtgctgtgcagaccaaacctggcctgtttaagacgaacactgggaccatcggagccgtctctctcgatttctccccaggtacatcaggcagtcccataattgacaaaaaggggaaagtggtaggactgtacggcaacggtgtcgtgacccgcagcggggcatatgtttccgccatcgctcagacagagaagtctattgaggataatcctgaaatcgaggacgatatatttcggaagagaaggcttactattatggacttacacccgggagccggcaaaaccaagcgatacctgcccgcaatcgtgcgggaagctatcaaacgcggcctcagaacgttgattctggccccaacaagggtcgtggcggccgagatggaagaggcactccgggggctgcctatccgatatcaaactcccgctattagagccgagcataccggacgcgaaatagttgaccttatgtgtcacgctacattcaccatgaggctgttgtcgccagtgcgtgtccctaactacaatctaatcattatggatgaggcacatttcactgaccccgccagcatcgccgctcggggttatatctcaaccagagtggaaatgggcgaggcggcagggatttttatgacagccacgccaccgggatccagggatcctttcccccagagtaacgctccaataatcgacgaggaacgcgagattcccgaacgatcttggaatagcggccacgagtgggtaactgattttaagggtaaaaccgtgtggttcgttccttccatcaaggccgggaacgacattgcagcctgcctgagaaagaatggaaaaaaggtcatccagctctcacggaaaacatttgattctgaatacgtgaagaccaggactaacgactgggatttcgtggtcacaaccgacataagcgagatgggcgctaattttaaagcggagcgcgtaatcgatccacgtagatgtatgaagcccgtgattttaacggacggcgaagagcgggttatcctggccgggcctatgccggtgactcatagttccgcagctcaaaggcgcggacgaattggtagaaacccaaaaaatgaaaacgaccagtacatctatatgggcgagccccttgaaaatgatgaggactgcgcccactggaaggaggcaaagatgctgctcgataacataaatacacctgaagggattatccccagcatgttcgagccagaacgggagaaagtcgacgccattgatggagaatacaggttgcgcggcgaggctagaaagacctttgtggacctgatgaggcggggtgatctccctgtttggctggcctataaagtggcggcagaggggatcaactacgccgaccgtcgctggtgtttcgatggcataaagaacaatcagatccttgaagagaacgtcgaagtggagatttggaccaaagagggagaacgaaagaagctaaaacccagatggctggacgctaggatctattctgatccattggccttaaaggagtttaaagaattcgctgcaggccggaagtcactgactctcaatctgattacagagatggggcgccttcctaccttcatgacacagaaaactagagacgccctggataacctcgctgtattgcacacggccgaagcaggaggtagggcgtacaatcatgccctgtccgagctaccggagaccctggaaacactccttctgttaactttgctggctaccgtgacaggcgggatctttctcttcctgatgagtggacggggcataggtaagatgacccttgggatgtgctgcattatcactgccagcatcctgctctggtatgcacaaattcagccccactggatcgctgcctcgataattttggagtttttcctgatcgttttactaattccagaacctgagaagcagcgaacgccccaggacaaccaactgacctacgtcgtgatcgcaatactcacagtggtcgccgctactatggcgaatgaaatgggctttcttgagaaaaccaagaaagacctgggattgggctctatcgccacacagcagccagagtccaacattctggatatcgacctcagacctgcaagcgcttggaccctgtacgccgttgccactacattcgtgacgcccatgcttcgccattcaattgaaaatagttctgtaaacgtgtccctcaccgcaatcgctaatcaggccactgtcctgatggggttgggaaagggttggccgctgagcaaaatggatattggcgtgccattactagcgatcgggtgttattcacaagttaaccctataacactgaccgctgccctccttctgttggtggcacactacgccattatcggacccggcctgcaggctaaggcaaccagggaggcccagaagcgggcggctgccggtatcatgaaaaatccaacagtcgacgggattactgtaatagatctcgaccccatcccttatgatccgaagtttgaaaaacagctgggccaagtgatgcttttaattctgtgcgttacgcaggtgctcatgatgcgtaccacatgggcattgtgtgaggccctgactctagctaccggacccatcagtacactgtgggaaggcaacccagggagattctggaataccactattgccgtcagcatggcaaacatctttaggggatcctacctcgctggcgccggtcttctgttctctataatgaagaatacgacaaacacccgccgggggactggaaacatgggcgagaccttgggtgagaaatggaagagccgactgaatgcgctcggcaaatccgaatttcagatctataagaagtcagggattcaagaggtggacagaacactggccaaagaaggaatcaagaggggcgagactgatcaccatgcagtctctcgcgggagtgctaaattacggtggttcgtggagagaaacatggttacccctgaaggaaaggtggtagaccttggctgcggtcgtgggggatggtcgtactattgtggcggtctgaaaaatgtgagggaggtcaagggcctcacaaaggggggacccggccacgaagagcctattccaatgagcacgtacgggtggaacctagttcggctgcagtccggagtggatgtctttttcatcccccctgaaaaatgcgacaccttgctgtgtgatataggcgagtcttcaccaaatcccactgtggaggccggtcgcacactccgagtacttaacctggtggaaaattggttgaacaataacacccagttctgcattaaggttctgaatccgtacatgcctagcgtgatcgagaaaatggaagcactccagagaaagtatgggggagctttagtcaggaacccactgtcccggaatagtactcatgagatgtactgggtgtctaacgccagcggcaatatcgtctcatccgtgaacatgattagtcgcatgcttataaacagatttacaatgaggcacaaaaaggccacctatgaacccgacgttgacctgggcagcgggacgcgaaatatcggaattgagtctgagatccctaacctagatattatcggtaagcggatagaaaaaatcaagcaagagcatgaaacctcctggcactacgaccaggatcacccatataaaacatgggcgtaccatggctcatatgagactaagcagaccgggagcgcttcgtctatggtaaatggagtggtccgtctcctgacaaaaccctgggacgtgttgccgactgttacccagatggcaatgacagataccactcctttcggccaacagagagtgtttaaggaaaaggtcgacacgcgcacacaggagcccaaagagggtaccaagaaactgatgaagattactgccgaatggctctggaaagagcttgggaagaaaaagaccccaaggatgtgtacacgggaagagttcacgagaaaggtgcgcagtaacgctgccctgggagcaatctttaccgatgagaataaatggaagtccgccagggaagctgtagaggacagccgattctgggaattagtggataaagagcggaacctgcacttggaaggcaagtgcgagacttgtgtttacaatatgatgggcaaaagagagaagaagctcggggaatttggaaaagcgaagggttcaagggccatttggtacatgtggctgggcgcacgcttcctagagtttgaagctcttgggttcctgaacgaggaccattggttttcccgtgaaaattctctcagcggagtcgagggcgagggtctgcacaaattggggtatatcctgcgggatgtgagtaagaaagaaggaggcgccatgtacgcagacgacacagccggctgggataccagaattactctcgaggaccttaagaacgaagagatggtgacaaatcacatggaaggggagcataagaaactggctgaggccatattcaagttaacctatcagaacaaagtcgttagggtgcaacgccctacaccccgaggaactgtaatggatatcatttcccggagagaccagaggggtagcggccaggtggggacctacggactgaatacgtttaccaacatggaagcgcaattgatccgccagatggagggcgaaggtgtcttcaagaatatccagcacctcacagtgactgaggaggttgcagtgcagaactggctggccagagtcgggcgggaaaggctatctcgtatggctatttcaggagatgactgcgtggtaaaaccacttgatgaccgattcgccaacgcactgaccgctctcaatgatatgggcaagatacgcaaggacatccaacagtgggagcccagtaaaggctggaacgattggacacaggttcctttttgctcccatcacttccatgaactgattatgaaggacgggagagtgttggtcgtgccatgtcggaatcaggatgagttaatcggaagggcccgcattagccaaggtgctggctggtctctgagagaaactgcctgcctcgggaaatcgtatgcacagatgtggtcacttatgtactttcaccggagggacctgcgactagcggccaacgctatctgtagcgccgtgccgtcccactgggtccccaccagtcgtacgacatggtctatacatgcaaagcacgagtggatgaccactgaggacatgctgacagtttggaataaagtgtggatcagagaaaacccttggatggaggataagaccccagtagaaagctgggaggaaattccctatctcggaaagcgcgaggaccagtggtgcggctccttgatcggtctgacttcacgggctacctgggccaaaaatattcaggcagccatcaaccaagtgaggagtcttatagggaatgaggaatacacagattacatgccttctatgaagagattccgccgggaggaagaggaagcgggagtcctgtggtga

SEQ ID NO: 14778 - RNA, 9876 nt, synthetic construct
  misc_feature 1..9876: note = derived and/or modified CDS sequence (opt3) from DENV-2__EU660417__SS-prME
  source 1..9876: mol_type = other RNA
agcgccggcatgatcattatgctgatacccaccgtgatggctttccacctcacaactagaaacggggagcctcatatgatcgtcggaattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagagcaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaagcttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggaaagaaggtacgtgctcgggcggctgattactgtcaacccgatagtgaccgagaaagatagccctgttaacatcgaagctgagcccccatttggcgactcgtacattatcatcggagtggagcctggccagttaaagctgaattggttcaagaaagggtcttccattggacaaatgtttgaaacgaccatgcgaggtgccaagcgcatggctatactaggcgatacagcctgggacttcgggtcactcggaggcgtatttactagtatcggtaaagcactgcatcaggtcttcggggccatttatggcgctgcgtttagcggagtgtcctggaccatgaagatccttattggcgttatcataacatggatcgggatgaactctagaagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacagtataaatttcaacccgagagtccaagcaagttggcctccgctatccagaaagcccaggaagagggcatatgtggtattaggtctgtcactcggctcgagaatctgatgtggaagcagatcacacccgaattaaaccacattctggcagagaatgaagttaaactaaccatcatgactggcgatataaaggggatcatgcaagccggaaaacgctcgctcagacctcagccaaccgagctgaagtacagctggaagacatggggcaaagctaagatgctttccacggaatcatataaccagaccttcttgattgacgggccggagactgccgagtgccccaatacaaacagggcatggaatagtctggaagtggaggattacggatttggcgtgttcaccacaaacatctggctcaaactgaaggaaaaacaggacgcgttttgtgactctaagttaatgagcgctgccattaaggataatcgtgcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatcccaaaaaacctcgcaggacccgttagtcaacacaattaccggcctggctaccacacgcagattgctggtccatggcatctgggcaagctagagatggacttcgatttttgtgacgggacaaccgtgatcgtcactgaagattgcggaaaccgaggccccagcctgagaaccacaactgcctctgggaagctcattaccgagtggtgctgtaggtcctgcacactgccgcctcttcgctatcggggagaggacggctgttggtacggtatggaaataagaccattgaaagagaaggaagagaatctggtgaactcattagttacggcggggcacggacaggtggataatttcagtctcggcgtactgggtatggccctttttctggaagagatgttgaggacccgcgtcggcactaaacatgctatcctcctggtggcagtgagcttcgtcacactaattaccgggaacatgtcgtttaaggacctgggacgagttgtggtaatggtgggcgccactatggctgatgacatcgggatgggagtcacatatctcgccctgcttgcagcgttcaaagtgcggcccacctttgccgctggcttgctgttacgtaagctcacgtccaaggagctgatgatgactaccattggtatcgttcttctgtctcaaagcacaatacctgaaaccgtgctagagctcactgatgccctggcattggggatgatggtcctgaaaatcgtgagaaatatggaaaagtaccagttagctgttacaattatgaccatcctctgcgtgcccaacgccgtcattctgcagaatgcatggaaagtatcatgtacaatccttgccgtggttagtgtgtccccactgttgctcacttctagcaggcagaagaccgactggatacctctggctctaacgattaaaggactgaaccccacagcgatcttccttaccactctctcccgcaccaataagaaacggtcatggccactgaacgaggccatcatggcagtcggcatggtgagcattttggctagttctctgttaaagaatgacataccgatgacaggccctctcgtagccgggggactgcttactgtgtgctatgtcctgaccggtagatccgccgatttggaactcgagagggctacggacgttaagtgggaggatcaagcagaaatcagcggctcgtcacccattctgtctatcacaattagtgaggacgggtccatgagcatcaaaaacgaagaggaggaacagaccctaactatactgatccgaacaggacttctcgtgatttctggcctgtttccaatcagcattcccatcaccgccgcggcttggtacttgtgggaggtgaagaaacagcgcgccggtgtcttatgggatgtgccttccccaccccctatggggaaggcagaactggaggacggagcctatcggataaaacagaagggcattctcggctactcacaaatcggggctggagtttacaaggaaggtactttccacacaatgtggcatgtaaccagaggcgcagtgctgatgcacaaagggaagaggatcgagccgagttgggccgatgtcaaaaaggaccttattagctatggaggcggttggaaactggagggggaatggaaggagggagaagaggtgcaggttttggcgctagaaccaggcaagaatccccgtgctgtgcagacgaaacctggcctgtttaagactaacaccgggacaatcggagccgtctctctcgatttctccccaggtacctcaggcagtcccataattgacaaaaaggggaaagtggtaggactgtacggcaacggtgtcgtgacacgcagcggggcatatgtttccgccatcgctcagactgagaagtctattgaggataatcctgaaatcgaggacgatatatttcggaagagaaggcttaccattatggacttacacccgggagccggcaaaacgaagcgatacctgcccgcaatcgtgcgggaagctatcaaacgcggcctcagaacattgattctggccccaactagggtcgtggcggccgagatggaagaggcactccgggggctgcctatccgatatcaaacccccgctattagagccgagcatacaggacgcgaaatagttgaccttatgtgtcacgctaccttcactatgaggctgttgtcgccagtgcgtgtccctaactacaatctaatcattatggatgaggcacatttcaccgaccccgccagcatcgccgctcggggttatatctcaacaagagtggaaatgggcgaggcggcagggatttttatgacggccactccaccgggatccagggatcctttcccccagagtaacgctccaataatcgacgaggaacgcgagattcccgaacgatcttggaatagcggccacgagtgggtaaccgattttaagggtaaaacagtgtggttcgttccttccatcaaggccgggaacgacattgcagcctgcctgagaaagaatggaaaaaaggtcatccagctctcacggaaaacctttgattctgaatacgtgaagactaggacaaacgactgggatttcgtggtcaccacggacataagcgagatgggcgctaattttaaagcggagcgcgtaatcgatccacgtagatgtatgaagcccgtgattttaactgacggcgaagagcgggttatcctggccgggcctatgccggtgacacatagttccgcagctcaaaggcgcggacgaattggtagaaacccaaaaaatgaaaacgaccagtacatctatatgggcgagccccttgaaaatgatgaggactgcgcccactggaaggaggcaaagatgctgctcgataacataaatacccctgaagggattatccccagcatgttcgagccagaacgggagaaagtcgacgccattgatggagaatacaggttgcgcggcgaggctagaaagacctttgtggacctgatgaggcggggtgatctccctgtttggctggcctataaagtggcggcagaggggatcaactacgccgaccgtcgctggtgtttcgatggcataaagaacaatcagatccttgaagagaacgtcgaagtggagatttggactaaagagggagaacgaaagaagctaaaacccagatggctggacgctaggatctattctgatccattggccttaaaggagtttaaagaattcgctgcaggccggaagtcactgacactcaatctgattaccgagatggggcgccttcctacattcatgactcagaaaacgagagacgccctggataacctcgctgtattgcacaccgccgaagcaggaggtagggcgtacaatcatgccctgtccgagctaccggagacactggaaactctccttctgttaaccttgctggctacagtgaccggcgggatctttctcttcctgatgagtggacggggcataggtaagatgactcttgggatgtgctgcattatcacggccagcatcctgctctggtatgcacaaattcagccccactggatcgctgcctcgataattttggagtttttcctgatcgttttactaattccagaacctgagaagcagcgaaccccccaggacaaccaactgacatacgtcgtgatcgcaatactcactgtggtcgccgctaccatggcgaatgaaatgggctttcttgagaaaacaaagaaagacctgggattgggctctatcgccacccagcagccagagtccaacattctggatatcgacctcagacctgcaagcgcttggactctgtacgccgttgccacaacgttcgtgacccccatgcttcgccattcaattgaaaatagttctgtaaacgtgtccctcactgcaatcgctaatcaggccacagtcctgatggggttgggaaagggttggccgctgagcaaaatggatattggcgtgccattactagcgatcgggtgttattcacaagttaaccctataaccctgaccgctgccctccttctgttggtggcacactacgccattatcggacccggcctgcaggctaaggcaacaagggaggcccagaagcgggcggctgccggtatcatgaaaaatccaactgtcgacgggattacggtaatagatctcgaccccatcccttatgatccgaagtttgaaaaacagctgggccaagtgatgcttttaattctgtgcgttacccaggtgctcatgatgcgtacaacttgggcattgtgtgaggccctgaccctagctacaggacccatcagtaccctgtgggaaggcagcccagggagattctggaacactacgattgccgtctccatggcaaatatctttaggggatcttacctcgctggcgccggtcttctgttcagcataatgaagaacacaaccaatactcgccgggggaccggaaacatgggcgagacattgggtgagaaatggaagtcccgactgaacgcgctcggcaaatcagaatttcagatctataagaagtctgggattcaagaggtggacagaactctggccaaagaaggaatcaagaggggcgagaccgatcaccatgcagtcagtcgcgggtcggctaaattacggtggttcgtggagagaaatatggttacacctgaaggaaaggtggtagaccttggctgcggtcgtgggggatggagctactattgtggcggtctgaaaaacgtgagggaggtcaagggcctcacgaaggggggacccggccacgaagagcctattccaatgtccacctacgggtggaatctagttcggctgcagtctggagtggatgtctttttcatcccccctgaaaaatgcgacactttgctgtgtgatataggcgagtcaagcccaaaccccacagtggaggccggtcgcaccctccgagtacttaatctggtggaaaactggttgaataacaatactcagttctgcattaaggttctgaacccgtacatgccttccgtgatcgagaaaatggaagcactccagagaaagtatgggggagctttagtcaggaatccactgagtcggaactctacacatgagatgtactgggtgagcaatgcctcaggcaacatcgtctccagtgtgaatatgattagccgcatgcttataaacagatttaccatgaggcacaaaaaggccacgtatgaacccgacgttgacctgggctctgggacccgaaacatcggaattgagtccgagatccctaatctagatattatcggtaagcggatagaaaaaatcaagcaagagcatgaaacatcatggcactacgaccaggatcacccatataaaacttgggcgtaccatggcagctatgagaccaagcagacagggtcggcttctagtatggtaaacggagtggtccgtctcctgactaaaccctgggacgtgttgccgaccgttacacagatggcaatgaccgatactacgcctttcggccaacagagagtgtttaaggaaaaggtcgacacacgcacccaggagcccaaagagggtactaagaaactgatgaagattaccgccgaatggctctggaaagagcttgggaagaaaaagacaccaaggatgtgtacgcgggaagagttcaccagaaaggtgcgctccaatgctgccctgggagcaatctttactgatgagaacaaatggaagagcgccagggaagctgtagaggactcacgattctgggaattagtggataaagagcggaatctgcacttggaaggcaagtgcgagacatgtgtttacaacatgatgggcaaaagagagaagaagctcggggaatttggaaaagcgaagggttccagggccatttggtacatgtggctgggcgcacgcttcctagagtttgaagctcttgggttcctgaatgaggaccattggttttctcgtgaaaacagcctcagtggagtcgagggcgagggtctgcacaaattggggtatatcctgcgggatgtgtccaagaaagaaggaggcgccatgtacgcagacgacaccgccggctgggatactagaattacactcgaggaccttaagaatgaagagatggtgaccaaccacatggaaggggagcataagaaactggctgaggccatattcaagttaacatatcagaataaagtcgttagggtgcaacgccctactccccgaggaaccgtaatggatatcattagccggagagaccagaggggttctggccaggtggggacgtacggactgaacacctttacaaatatggaagcgcaattgatccgccagatggagggcgaaggtgtcttcaagaacatccagcacctcactgtgaccgaggaggttgcagtgcagaattggctggccagagtcgggcgggaaaggctatcacgtatggctattagtggagatgactgcgtggtaaaaccacttgatgaccgattcgccaacgcactgacagctctcaacgatatgggcaagatacgcaaggacatccaacagtgggagccctccaaaggctggaatgattggactcaggttcctttttgcagccatcacttccatgaactgattatgaaggacgggagagtgttggtcgtgccatgtcggaaccaggatgagttaatcggaagggcccgcatttctcaaggtgctggctggtcgctgagagaaaccgcctgcctcgggaaatcatatgcacagatgtggagccttatgtactttcaccggagggacctgcgactagcggccaatgctatctgttccgccgtgccgagtcactgggtccccacgtctcgtacaacctggagcatacatgcaaagcacgagtggatgactacagaggacatgctgaccgtttggaacaaagtgtggatcagagaaaatccttggatggaggataagactccagtagaatcctgggaggaaattccctatctcggaaagcgcgaggaccagtggtgcggctcattgatcggtctgaccagtcgggctacatgggccaaaaacattcaggcagccatcaatcaagtgaggtctcttatagggaacgaggaatacacggattacatgcctagcatgaagagattccgccgggaggaagaggaagcgggagtcctgtggtga

SEQ ID NO: 14779 - RNA, 9876 nt, synthetic construct
  misc_feature 1..9876: note = derived and/or modified CDS sequence (opt3) from DENV-2__EU677137__SS-prME
  source 1..9876: mol_type = other RNA
agcgcaggaatgatcattatgctgatacccaccgtgatggctttccacctcactactcggaacggggagcctcatatgatcgtcggcattcaggaaaagggtaaatcccttctgtttaagacggaggacggagttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccaattaaagctgaattggttcaagaaagggtcttccattggacagatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacaatataaatttcagcccgagagtccaagcaagttggcctccgctatccagaaagcccaggaagagggcatatgtggtattagatctgtcactaggctcgagaatctgatgtggaagcaaatcacacccgaattaaaccacattctggcagagaatgaagttaaactaaccatcatgactggcgatataaaggggatcatgcaggccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaagacgcgttttgtgactctaagttaatgagcgctgccattaaggataatagggcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatccccaagaacctcgcaggacccgttagtcagcacaattaccgtcctggctaccacacgcagattgctggtccatggcatctgggcaagctagagatggacttcgatttttgtgacgggacaaccgtgactgtcaccgaagattgcggaagccggggcccctctctgcgaacaactaccgcctccgggaagctcatcacagagtggtgctgtagatcatgcacgctgccgcctcttaggtatcgcggagaggacggctgttggtacggtatggaaattcggccattgaaagagaaggaagagaacctggtgaatagtttagttaccgcggggcacggacaagtggataacttcagcctcggcgtactgggtatggccctttttctggaagagatgttgagaactagggtcggcacaaaacatgctatactcctggtggcagtgtcgttcgtcaccctaatcactgggaatatgtcctttaaggacctgggacgcgttgtggtaatggtgggcgccacaatggctgatgacattgggatgggagtcacctatctcgccctgcttgcagcgttcaaagtgcgacccacgtttgccgctggcttgctgttacggaagctcacttctaaggagctgatgatgaccacaatcggtattgttcttctgagccagtcaaccatccctgaaactgtgctagagctcacagatgccctggcattggggatgatggtcctgaaaatagtgcgtaacatggaaaagtaccagttagctgttaccatcatggccattctctgcgtgcccaatgcagtcatcctgcagaacgcctggaaagtaagttgtacaattcttgctgtggtttccgtgtctccactgttgctcactagctcccaacagaagaccgactggatccctctggcgctaacggtcaaaggactgaatcccacagccatattccttaccactctctcaagaaccaacaagaaaaggagctggccactgaatgaggcaattatggctgtgggcatggtaagtatcttggcctcttccctgttaaagaacgacatcccgatgacaggccctctcgtggccgggggactgcttactgtctgctatgttctgaccggtcgcagcgctgatttggaactcgagcgggcaacggacgtgaagtgggaggatcaggccgaaatttcgggctcatctcccatactgagtatcacaatttccgaggacgggagcatgtctatcaaaaatgaagaggaggaacagaccctaactattctgatcagaacaggacttctcgtgataagcggcctgtttccaatctccattcccatcaccgcggctgcctggtacttgtgggaggtcaagaaacaaagggccggtgtgttatgggatgttccttcaccaccccctatggggaaggccgaactggaggacggagcttatcgaattaaacagaagggcatcctcggctacagtcagataggggcaggagtatacaaggaaggtactttccacacaatgtggcatgtgacccgcggcgccgtcctgatgcacaaagggaagcggattgagccgagctgggcggatgtgaaaaaggaccttatctcttatggaggcggttggaaactggagggggaatggaaggagggagaagaggttcaggtgttggctctagaaccaggcaagaaccccagagccgtccaaacgaaacctggcctgtttaagactaataccgggacaatcggagcagtgtccctcgatttctcaccaggtaccagtggcagccccattatcgacaaaaaggggaaagtagtcggactgtacggcaacggtgtggttacaaggtccggggcctatgtgtctgctatagcccagactgagaagtcgattgaggataaccctgaaatcgaggacgatatttttcgtaagcgccggcttaccatcatggacttacacccgggagcaggcaaaacgaagagatacctgcccgctatagtcagggaagccattaaacgaggcctccggacattgatcctggcgccaactcgcgtggttgccgcagagatggaagaggctctcagagggctgcctatcaggtatcagacccccgccattcgggctgagcatacaggacgagaaatcgtggaccttatgtgtcacgcaaccttcactatgagactgttgagcccagtccgcgtgcctaattacaacctaattataatggatgaggcccatttcaccgaccccgcctcaatcgctgcgaggggttatatttccacacgtgtagaaatgggcgaggcagccgggatctttatgacggctactccaccgggaagtcgggatcctttcccccaatctaatgccccaatcattgacgaggaaagagagatacccgaaaggagctggaactccggccacgagtgggtgaccgattttaagggtaaaacagtttggttcgtcccttcaatcaaggcagggaatgacattgccgcttgcctgcgcaagaacggcaagaaggtgatccagctctctcgaaaaacctttgatagcgaatacgtgaagactagaacaaatgactgggatttcgtcgtaaccacggacattagtgagatgggcgcgaactttaaagccgagcgggtgatcgatccaaggcgctgtatgaagcccgttatattaactgacggcgaagaacgtgtgatcctggcagggcctatgccggtcacacattccagcgctgcccagagacggggaaggattggtcgcaatcccaaaaacgaaaatgaccagtacatctatatgggcgagccccttgaaaacgatgaggactgcgcacactggaaggaggccaagatgctgctcgataatattaacacccctgaagggatcataccctctatgttcgagccagaacgagagaaagtggacgctattgatggagaatacagattgcggggcgaggccaggaagacctttgttgacctgatgcgcagaggtgatctccctgtgtggctggcgtataaagtcgcagccgaggggatcaattacgctgacaggcggtggtgtttcgatggcattaagaacaaccaaatccttgaagagaatgtggaagtagagatatggactaaagagggagaacgtaagaagctaaaaccccgctggctggacgcccgaatctattcagatccattggctttaaaggagtttaaagagttcgcagccggcagaaagtccctgacactcaacctgattaccgagatggggaggcttcctacattcatgactcagaaaacgcgggacgctctggataatctcgccgtgttgcacaccgcagaagcgggaggtcgcgcctacaaccatgctctgagtgagctaccggagacactggaaactctccttctgttaaccttgctggccacagttaccggcgggatctttctcttcctgatgagcggaagaggcattggtaagatgactcttgggatgtgctgcatcataacggcatcgattctgctctggtatgctcagatccagccccactggatcgccgcatctattatcttggagtttttcctgatagtcttactaattccagaacctgagaagcaaaggaccccacaggacaatcagctgacatacgtggtgatcgccattctcactgtcgttgctgcgaccatggccaacgaaatgggctttcttgagaaaacaaagaaagacctgggattgggctccatcgcaacccagcaaccagagagcaatatactggatatcgacctccggcctgcttcagcctggactctgtacgccgtggcaacaacgttcgtaacccccatgcttcgacatagtattgaaaactcttccgtgaatgtcagcctcactgctatcgccaaccaggcgacagtgctgatggggttgggaaagggttggccgctgtcaaaaatggatattggcgttccattactagctatcgggtgttatagtcaggtgaatcctattaccctgaccgccgcactccttctgttggtcgcccactacgctatcataggacccggcctgcaggcaaaggccacaagagaggcgcaaaagcgcgctgccgcaggtattatgaaaaacccaactgtagacgggatcacggtgatcgatctcgaccccattccttatgatccgaagtttgaaaaacagctgggccaggttatgcttttaatactgtgcgtgacccaagtcctcatgatgaggacaacttgggccttgtgtgaggctctgaccctagccacaggacccatcagcaccctgtgggaaggcaatccagggcggttctggaacactacgattgcagtgtccatggctaatatctttcgtggatcttacctcgccggcgcgggtcttctgttcagcattatgaagaacacaaccaatactagaagggggaccggaaacatgggcgagacattgggtgagaaatggaagtcccgcctgaacgccctcggcaaatcagaatttcagatctataagaagtctgggatacaggaggtcgaccggactctggcaaaagaaggaatcaagcgaggcgagaccgatcaccatgctgtgagtagagggtcggccaaattaaggtggttcgttgagcgcaatatggtgacacctgaaggaaaggtagtggaccttggctgcggtagagggggatggagctactattgtggcggtctgaaaaacgtcagagaggttaagggcctcacgaaagggggacccggccacgaggaacctattccaatgtccacctacgggtggaatctagtgcgtctgcagtctggagtcgatgtgtttttcatcccacctgaaaaatgcgacactttgctgtgtgatattggcgagtcaagcccaaaccccacagtagaggcaggtaggaccctccgggtgcttaatctggttgaaaactggttgaataacaatactcaattctgcatcaaggtgctgaacccgtacatgccttccgtcatagagaaaatggaagctatgcagcgcaagtatgggggagccctcgtgcgaaatccattaagtagaaactctacacatgagatgtactgggtcagcaatgcctcaggcaacattgtgtccagtgttaatatgatcagcaggatgctgatcaaccggtttaccatgcgccacaaaaaggcgacgtatgaacccgacgtagaccttggctctgggaccagaaacattggaatagagtccgagatccctaatctggatattatcggtaagaggattgagaaaatcaagcaggagcatgaaacatcatggcactacgaccaggatcacccatataaaacttgggcttaccatggcagctatgagaccaagcaaacagggtcggcatctagtatggtgaacggagtcgtgcgactactcactaaaccctgggacgttctgccgaccgtgacacagatggccatgaccgatactacgcctttcggccagcagcgggtctttaaggaaaaggtggacacacgtacccaagagcccaaagagggtactaagaaattgatgaagataaccgctgaatggctgtggaaagagctcgggaagaaaaagacaccaagaatgtgtacgcgcgaagagttcaccaggaaggtacggtccaatgccgcacttggagccatctttactgatgagaacaaatggaaaagcgctagagaagcggtggaggactcacgcttctgggaactggttgataaagagaggaatttacacctggaaggcaagtgcgagacatgtgtctacaacatgatgggcaaacgagagaagaagttgggggaatttggaaaagccaagggttcccgggcaatttggtacatgtggctcggcgctagattcctggagtttgaagccctagggttccttaatgaggaccattggttttctagggaaaacagcctgagtggagtggagggcgagggtctccacaaactggggtatatcttgcgcgatgtgtccaagaaagaaggaggcgcaatgtacgccgacgacaccgctggctgggatactcgtattacactggaggacctcaagaatgaagagatggtcaccaaccacatggaaggggagcataagaaacttgccgaggcgatcttcaagctgacatatcagaataaagttgtgcgggtacagagacctactcccaggggaaccgtgatggatattataagccgccgagaccaacggggttctggccaggtcgggacgtacggattaaacacctttacaaatatggaagcacagctgatcagacagatggagggcgaaggtgtgttcaagaacattcaacacttgactgttaccgaggaggtggccgtccagaattggctcgctagggtggggcgcgaaagactgtcacggatggccatcagtggagatgactgcgtagttaaaccactagatgacaggttcgcaaacgctcttacagccctgaacgatatgggcaagatccgtaaggacattcagcagtgggagccctccaaaggctggaatgattggactcaagtgcctttttgcagccatcacttccatgaactcataatgaaggacgggcgagtcctggtggtgccatgtcgcaaccaggatgagttgatcggtagagctcggatttctcagggagccggctggtcgttaagggaaaccgcatgcctggggaaatcatatgcgcagatgtggagcctcatgtactttcaccgcagagaccttcggctggccgctaatgccatctgttccgcagtcccgagtcactgggttcccacgtctaggacaacctggagcattcatgctaagcacgagtggatgactacagaggacatgctaaccgtgtggaaccgagtatggatccgtgaaaatccttggatggaggataaaactccagtggaatcctgggaggaaataccctatctgggaaagagagaggaccaatggtgcggctcactcatcggtttgaccagtcgcgccacatgggcaaagaacattcaggccgcgatcaatcaggtccggtctctgattgggaacgaggaatacacggattacatgcctagcatgaaaaggttcagacgcgaggaagaggaagctggagtgctttggtga

SEQ ID NO: 14780 - RNA, 9876 nt, synthetic construct
  misc_feature 1..9876: note = derived and/or modified CDS sequence (opt3) from DENV-2__EU677138__SS-prME
  source 1..9876: mol_type = other RNA
agcgccggcatgatcattatgctgatacccaccgtgatggctttccacctcacaactagaaacggggagcctcatatgatcgtcggaattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagagcaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccaattaaagctgaattggttcaagaaagggtcttccattggacagatgtttgaaacgaccatgcggggtgccaagcgaatggctatactaggcgatacagcctgggacttcgggtcactcggaggcgtatttactagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacaatataaatttcagcccgagagtccaagcaagttggcctccgctatccagaaagcccaggaagagggcatatgtggtattagatctgtcactaggctcgagaatctgatgtggaagcaaatcacacccgaattaaaccacattctggcagagaatgaagttaaactaaccatcatgactggcgatataaaggggatcatgcaggccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaagacgcgttttgtgactctaagttaatgagcgctgccattaaggataatagggcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatcccaaaaaacctcgcaggacccgttagtcagcacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaagctcattaccgagtggtgctgtagatcctgcacactgccgcctcttaggtatcgcggagaggacggctgttggtacggtatggaaatacggccattgaaagagaaggaagagaatctggtgaactcattagttacggcggggcacggacaagtggataatttcagtctcggcgtactgggtatggccctttttctggaagagatgttgagaaccagggtcggcactaaacatgctatcctcctggtggcagtgagcttcgtcacactaattaccgggaacatgtcgtttaaggacctgggacgcgttgtggtaatggtgggcgccactatggctgatgacatcgggatgggagtcacatatctcgccctgcttgcagcgttcaaagtgcgacccacctttgccgctggcttgctgttacggaagctcacgtccaaggagctgatgatgactaccattggtatcgttcttctgtctcagagcacaatacctgaaaccgtgctagagctcactgatgccctggcattggggatgatggtcctgaaaatcgtgcgtaatatggaaaagtaccagttagctgttacaattatggccatcctctgcgtgcccaacgcagtcattctgcagaatgcctggaaagtatcatgtaccatccttgctgtggttagtgtgtccccactgttgctcacatctagccaacagaagactgactggatacctctggcgctaaccattaaaggactgaaccccacggccatcttccttacaaccctctccagaactaataagaaaaggtcatggccactgaacgaggcaatcatggctgtcggcatggtgagcattttggccagttctctgttaaagaatgacataccgatgaccggccctctcgtagccgggggactgcttacagtgtgctatgtcctgactggtcgctccgctgatttggaactcgagcgggcaaccgacgttaagtgggaggatcaggccgaaatcagcggctcgtcacccattctgtctatcacgattagtgaggacgggtccatgagcatcaaaaacgaagaggaggaacagacactaaccatactgatcagaactggacttctcgtgatttctggcctgtttccaatcagcattcccatcacagcggctgcctggtacttgtgggaggtgaagaaacaaagggcaggtgtcttatgggatgtgccttccccaccccctatggggcgagccgaactggaggacggagcttatcgcataaagcagaaaggcattctcggctactcacagatcggggcaggagtttacaaggaaggtaccttccacactatgtggcatgtaacacggggcgccgtgctgatgcacaaggggaaaagaatcgagccgagttgggcggatgtcaagaaagaccttattagctatggaggcggttggaagctggagggggaatggaaagagggagaagaggtgcaggttttggctctagaaccaggcaagaatcccagggccgtgcaaaccaagcctggcctgtttaaaacgaacactgggaccatcggagcagtctctctcgatttctccccaggtacatcaggcagtcccataattgacaagaaagggaaggtggtaggactgtacggcaacggtgtcgtgacccgtagcggggcctatgtttccgctatcgcccagacagagaaatctattgaggataatcctgaaatcgaggacgatatatttcgcaagcggagacttactattatggacttacacccgggagcaggcaagaccaaaaggtacctgcccgctatcgtgcgagaagccatcaagcggggcctccgcacgttgattctggcgccaacaagagtcgtggccgcagagatggaagaggctctcagggggctgcctatccggtatcagactcccgccattcgagctgagcataccggaagagaaatagttgaccttatgtgtcacgcaacattcaccatgcgcctgttgtcgccagtgagggtccctaactacaatctaatcattatggatgaggcccatttcactgaccccgccagcatcgctgcgcgtggttatatctcaacccgggtggaaatgggcgaggcagccgggatttttatgacagctacgccaccgggatccagagatcctttcccccaaagtaacgccccaataatcgacgaggaaagggagattcccgaacgctcttggaatagcggccacgagtgggtaactgattttaaaggtaagaccgtgtggttcgttccttccatcaaagcagggaacgacattgccgcttgcctgcgaaagaatggaaagaaagtcatccagctctcaagaaagacatttgattctgaatacgtgaaaacccggactaacgactgggatttcgtggtcacaaccgacataagcgagatgggcgcgaattttaaggccgagagggtaatcgatccacgccgttgtatgaaacccgtgattttaacggacggcgaagagagagttatcctggcagggcctatgccggtgactcatagttccgctgcccagcggaggggacgcattggtcgaaacccaaagaatgaaaacgaccagtacatctatatgggcgagccccttgaaaatgatgaggactgcgcacactggaaagaggccaagatgctgctcgataacataaatacacctgaagggattatccccagcatgttcgagccagaaagagagaaggtcgacgctattgatggagaataccggttgaggggcgaggcccgcaaaacctttgtggacctgatgagaaggggtgatctccctgtttggctggcgtataaggtggcagccgaggggatcaactacgctgaccggcgttggtgtttcgatggcataaaaaacaatcaaatccttgaagagaacgtcgaagtggagatttggaccaaggagggagaacgcaaaaagctaaagccccgatggctggacgccagaatctattctgatccattggctttaaaagagtttaaggaattcgcagccggcaggaaatcactgactctcaatctgattacagagatggggcggcttcctaccttcatgacacagaagactcgcgacgctctggataacctcgccgtattgcacacggcagaagcgggaggtagagcctacaatcatgctctgtccgagctaccggagaccctggaaacactccttctgttaactttgctggccaccgtgacaggcgggatctttctcttcctgatgagtggaaggggcataggtaaaatgacccttgggatgtgctgcattatcactgcaagcatcctgctctggtatgctcagattcagccccactggatcgccgcatcgataattttggagtttttcctgatcgttttactaattccagaacctgagaagcaacggacgccccaggacaaccagctgacctacgtcgtgatcgccatactcacagtggtcgctgcgactatggccaatgaaatgggctttcttgagaagaccaaaaaggacctgggattgggctctatcgcaacacagcaaccagagtccaacattctggatatcgacctccgacctgctagcgcctggaccctgtacgccgttgcaactacattcgtgacgcccatgcttagacattcaattgaaaatagttctgtaaacgtgtccctcaccgctatcgccaatcaggcgactgtcctgatggggttgggaaaaggttggccgctgagcaagatggatattggcgtgccattactagctatcgggtgttattcacaggttaaccctataacactgaccgccgcactccttctgttggtggcccactacgctattatcggacccggcctgcaggcaaaagccacccgcgaggcgcaaaagagggctgccgcaggtatcatgaagaatccaacagtcgacgggattactgtaatagatctcgaccccatcccttatgatccgaaatttgaaaagcagctgggccaggtgatgcttttaattctgtgcgttacgcaagtgctcatgatgcggaccacatgggccttgtgtgaggctctgactctagccaccggacccatcagtacactgtgggaaggcaacccagggcgtttctggaataccactattgcagtcagcatggctaacatctttagaggatcctacctcgccggcgcgggtcttctgttctctataatgaaaaatacgacaaacaccaggcgcgggactggaaacatgggcgagaccttgggtgagaagtggaaaagccggctgaatgccctcggcaagtccgaatttcagatctataaaaagtcagggattcaggaggtggaccgaacactggcaaaggaaggaatcaaaagaggcgagactgatcaccatgctgtctctagggggagtgccaagttacgctggttcgtggagcggaacatggttacccctgaaggaaaagtggtagaccttggctgcggtagagggggatggtcgtactattgtggcggtctgaagaatgtgcgtgaggtcaaaggcctcacaaaggggggacccggccacgaagagcctattccaatgagcacgtacgggtggaacctagttaggctgcagtccggagtggatgtctttttcatcccccctgaaaagtgcgacaccttgctgtgtgatataggcgagtcttcaccaaatcccactgtggaggcaggtcggacactccgcgtacttaacctggtggaaaattggttgaacaataacacccaattctgcattaaagttctgaatccgtacatgcctagcgtgatcgagaagatggaagctctccagcgaaaatatgggggagccttagtcagaaacccactgtccaggaatagtactcatgagatgtactgggtgtctaacgccagcggcaatatcgtctcatccgtgaacatgattagtcggatgcttataaaccgctttacaatgagacacaagaaagcgacctatgaacccgacgttgacctgggcagcgggacgaggaatatcggaattgagtctgagacccctaacctagatatcattggtaagcgaatcgaaaagataaaacaggagcatgaaacatcctggcactacgaccaggatcacccatataagacttgggcttaccatggctcatatgagaccaaacaaacagggagcgcatcgtctatggtaaatggagtggtccggctcctgactaagccctgggacgtgttgccgaccgttacacagatggccatgaccgatactacgcctttcggccagcagcgtgtgtttaaagaaaaggtcgacacaagaacccaagagcccaaggagggtactaaaaagctgatgaaaatcaccgctgaatggctctggaaggagcttgggaaaaagaaaacaccacgcatgtgtacgagggaagagttcacccggaaggtgagaagtaacgccgcactgggagccatttttactgatgagaataagtggaaatccgctcgcgaagcggtagaggacagcaggttctgggaattagtggataaggagcgaaacctgcacttggaaggcaaatgcgagacatgtgtttacaatatgatgggcaagcgggagaaaaagctcggggaatttggaaaggccaaaggttcaagagcaatctggtacatgtggctgggcgctaggttcctagagtttgaagcccttgggttcctgaacgaggaccattggttttcccgcgaaaattctctcagcggagtcgagggcgagggtctgcacaagttggggtatattctgcgtgatgtgagtaaaaaggaaggaggcgcaatgtacgccgacgacaccgctggctgggatactcggatcacactcgaggaccttaaaaacgaagagatggtgaccaatcacatggaaggggagcataagaagctggccgaggcgattttcaaattaacatatcagaacaaggtcgttagagtgcagaggcctactccccgcggaaccgtaatggatataatctcccgacgggaccaaagaggtagcggccaggtggggacgtacggactgaatacctttacaaacatggaagcacagttgattaggcagatggagggcgaaggtgtcttcaaaaatatccaacacctcactgccaccgaggaggtggctgttcagaactggctggcccgcgtggggagagaacggctatctaggatggcaatctcaggagatgactgcgtcgtgaagccacttgatgaccgtttcgctaacgccctgacagctctcaatgatatgggcaaaattcgaaaggacatacagcagtgggagcccagtaagggctggaacgattggactcaagtacctttttgctcccatcacttccatgaactgatcatgaaagacgggcgcgttttggtggtcccatgtagaaatcaggatgagttaattggacgggccaggatcagccagggtgcaggctggtctctgcgcgaaaccgcgtgcctcgggaagtcgtatgcccagatgtggtcacttatgtactttcacagacgggacctgaggctagctgccaacgcaatttgtagcgctgtgccgtcccactgggtgcccacgagtcgaacaacctggtctatccatgccaaacacgagtggatgactacagaggacatgctgaccgtctggaatcgtgtttggataagagaaaacccttggatggaggataagactccagtggaaagctgggaggaaatcccctatctcggaaaacgcgaggaccaatggtgcggctccttgattggtctgacctcacgggcaacatgggccaagaatatccaggtagcgattaaccaggtgaggagtcttatcgggaatgaggaatacacggattacatgccttctatgaagagattccgccgggaggaagaggaagctggagtcctgtggtga

SEQ ID NO: 14781 - RNA, 9876 nt, synthetic construct
  misc_feature 1..9876: note = derived and/or modified CDS sequence (opt3) from DENV-2__EU677149__SS-prME
  source 1..9876: mol_type = other RNA
agcgccggcatgatcattatgctgatacccaccgtgatggctttccacctcacaactagaaacggggagcctcatatgatcgtcggaattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagagcaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaagcttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggaaagaaggtacgtgctcgggcggctgattactgtcaacccgatagtgaccgagaaagatagccctgttaacatcgaagctgagcccccatttggcgactcgtacattatcatcggagtggagcctggccagttaaagctgaattggttcaagaaagggtcttccattggacaaatgtttgaaacgaccatgcgaggtgccaagcgcatggctatactaggcgatacagcctgggacttcgggtcactcggaggcgtatttactagtatcggtaaagcactgcatcaggtcttcggggccatttatggcgctgcgtttagcggagtgtcctggaccatgaagatccttattggcgttatcataacatggatcgggatgaactctagaagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacagtataaatttcaacccgagagtccaagcaagttggcctccgctatccagaaagcccaggaagagggcatatgtggtattaggtctgtcactcggctcgagaatctgatgtggaagcagatcacacccgaattaaaccacattctggcagagaatgaagttaaactaaccatcatgactggcgatataaaggggatcatgcaagccggaaaacgctcgctcagacctcagccaaccgagctgaagtacagctggaagacatggggcaaagctaagatgctttccacggaatcatataaccagaccttcttgattgacgggccggagactgccgagtgccccaatacaaacagggcatggaatagtctggaagtggaggattacggatttggcgtgttcaccacaaacatctggctcaaactgaaggaaaaacaggacgcgttttgtgactctaagttaatgagcgctgccattaaggataatcgtgcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatcccaaaaaacctcgcaggacccgttagtcaacacaattaccggcctggctaccacacgcagattgctggtccatggcatctgggcaagctagagatggacttcgatttttgtgacgggacaaccgtgatcgtcactgaagattgcggaaaccgaggccccagcctgagaaccacaactgcctctgggaagctcattaccgagtggtgctgtaggtcctgcacactgccgcctcttcgctatcggggagaggacggctgttggtacggtatggaaataagaccattgaaagagaaggaagagaatctggtgaactcattagttacggcggggcacggacaggtggataatttcagtctcggcgtactgggtatggccctttttctggaagagatgttgaggacccgcgtcggcactaaacatgctatcctcctggtggcagtgagcttcgtcacactaattaccgggaacatgtcgtttaaggacctgggacgagttgtggtaatggtgggcgccactatggctgatgacatcgggatgggagtcacatatctcgccctgcttgcagcgttcaaagtgcggcccacctttgccgctggcttgctgttacgtaagctcacgtccaaggagctgatgatgactaccattggtatcgttcttctgtctcaaagcacaatacctgaaaccgtgctagagctcactgatgccctggcattggggatgatggtcctgaaaatcgtgagaaatatggaaaagtaccagttagctgttacaattatgaccatcctctgcgtgcccaacgccgtcattctgcagaatgcatggaaagtatcatgtacaatccttgccgtggttagtgtgtccccactgttgctcacttctagcaggcagaagaccgactggatacctctggctctaacgattaaaggactgaaccccacagcgatcttccttaccactctctcccgcaccaataagaaacggtcatggccactgaacgaggccatcatggcagtcggcatggtgagcattttggctagttctctgttaaagaatgacataccgatgacaggccctctcgtagccgggggactgcttactgtgtgctatgtcctgaccggtagatccgccgatttggaactcgagagggctacggacgttaagtgggaggatcaagcagaaatcagcggctcgtcacccattctgtctatcacaattagtgaggacgggtccatgagcatcaaaaacgaagaggaggaacagaccctaactatactgatccgaacaggacttctcgtgatttctggcctgtttccaatcagcattcccatcaccgccgcggcttggtacttgtgggaggtgaagaaacagcgcgccggtgtcttatgggatgtgccttccccaccccctatggggaaggcagaactggaggacggagcctatcggataaaacagaagggcattctcggctactcacaaatcggggctggagtttacaaggaaggtactttccacacaatgtggcatgtaaccagaggcgcagtgctgatgcacaaagggaagaggatcgagccgagttgggccgatgtcaaaaaggaccttattagctatggaggcggttggaaactggagggggaatggaaggagggagaagaggtgcaggttttggcgctagaaccaggcaagaatccccgtgctgtgcagacgaaacctggcctgtttaagactaacaccgggacaatcggagccgtctctctcgatttctccccaggtacctcaggcagtcccataattgacaaaaaggggaaagtggtaggactgtacggcaacggtgtcgtgacacgcagcggggcatatgtttccgccatcgctcagactgagaagtctattgaggataatcctgaaatcgaggacgatatatttcggaagagaaggcttaccattatggacttacacccgggagccggcaaaacgaagcgatacctgcccgcaatcgtgcgggaagctatcaaacgcggcctcagaacattgattctggccccaactagggtcgtggcggccgagatggaagaggcactccgggggctgcctatccgatatcaaacccccgctattagagccgagcatacaggacgcgaaatagttgaccttatgtgtcacgctaccttcactatgaggctgttgtcgccagtgcgtgtccctaactacaatctaatcattatggatgaggcacatttcaccgaccccgccagcatcgccgctcggggttatatctcaacaagagtggaaatgggcgaggcggcagggatttttatgacggccactccaccgggatccagggatcctttcccccagagtaacgctccaataatcgacgaggaacgcgagattcccgaacgatcttggaatagcggccacgagtgggtaaccgattttaagggtaaaacagtgtggttcgttccttccatcaaggccgggaacgacattgcagcctgcctgagaaagaatggaaaaaaggtcatccagctctcacggaaaacctttgattctgaatacgtgaagactaggacaaacgactgggatttcgtggtcaccacggacataagcgagatgggcgctaattttaaagcggagcgcgtaatcgatccacgtagatgtatgaagcccgtgattttaactgacggcgaagagcgggttatcctggccgggcctatgccggtgacacatagttccgcagctcaaaggcgcggacgaattggtagaaacccaaaaaatgaaaacgaccagtacatctatatgggcgagccccttgaaaatgatgaggactgcgcccactggaaggaggcaaagatgctgctcgataacataaatacccctgaagggattatccccagcatgttcgagccagaacgggagaaagtcgacgccattgatggagaatacaggttgcgcggcgaggctagaaagacctttgtggacctgatgaggcggggtgatctccctgtttggctggcctataaagtggcggcagaggggatcaactacgccgaccgtcgctggtgtttcgatggcataaagaacaatcagatccttgaagagaacgtcgaagtggagatttggactaaagagggagaacgaaagaagctaaaacccagatggctggacgctaggatctattctgatccattggccttaaaggagtttaaagaattcgctgcaggccggaagtcactgacactcaatctgattaccgagatggggcgccttcctacattcatgactcagaaaacgagagacgccctggataacctcgctgtattgcacaccgccgaagcaggaggtagggcgtacaatcatgccctgtccgagctaccggagacactggaaactctccttctgttaaccttgctggctacagtgaccggcgggatctttctcttcctgatgagtggacggggcataggtaagatgactcttgggatgtgctgcattatcacggccagcatcctgctctggtatgcacaaattcagccccactggatcgctgcctcgataattttggagtttttcctgatcgttttactaattccagaacctgagaagcagcgaaccccccaggacaaccaactgacatacgtcgtgatcgcaatactcactgtggtcgccgctaccatggcgaatgaaatgggctttcttgagaaaacaaagaaagacctgggattgggctctatcgccacccagcagccagagtccaacattctggatatcgacctcagacctgcaagcgcttggactctgtacgccgttgccacaacgttcgtgacccccatgcttcgccattcaattgaaaatagttctgtaaacgtgtccctcactgcaatcgctaatcaggccacagtcctgatggggttgggaaagggttggccgctgagcaaaatggatattggcgtgccattactagcgatcgggtgttattcacaagttaaccctataaccctgaccgctgccctccttctgttggtggcacactacgccattatcggacccggcctgcaggctaaggcaacaagggaggcccagaagcgggcggctgccggtatcatgaaaaatccaactgtcgacgggattacggtaatagatctcgaccccatcccttatgatccgaagtttgaaaaacagctgggccaagtgatgcttttaattctgtgcgttacccaggtgctcatgatgcgtacaacttgggcattgtgtgaggccctgaccctagctacaggacccatcagtaccctgtgggaaggcaacccagggagattctggaatactacgattgccgtcagcatggcaaacatctttaggggatcctacctcgctggcgccggtcttctgttctctataatgaagaatacaaccaacactcgccgggggaccggaaacatgggcgagacattgggtgagaaatggaagagccgactgaatgcgctcggcaaatccgaatttcagatctataagaagtcagggattcaagaggtggacagaactctggccaaagaaggaatcaagaggggcgagaccgatcaccatgcagtctctcgcgggagtgctaaattacggtggttcgtggagagaaacatggttacacctgaaggaaaggtggtagaccttggctgcggtcgtgggggatggtcgtactattgtggcggtctgaaaaatgtgagggaggtcaagggcctcacgaaggggggacccggccacgaagagcctattccaatgagcacctacgggtggaacctagttcggctgcagtccggagtggatgtctttttcatcccccctgaaaaatgcgacactttgctgtgtgatataggcgagtcttcaccaaatcccacagtggaggccggtcgcaccctccgagtacttaacctggtggaaaattggttgaacaataacactcagttctgcattaaggttctgaatccgtacatgcctagcgtgatcgagaaaatggaagcactccagagaaagtatgggggagctttagtcaggaacccactgtcccggaatagtacacatgagatgtactgggtgtctaacgccagcggcaatatcgtctcatccgtgaacatgattagtcgcatgcttataaacagatttaccatgaggcacaaaaaggccacgtatgaacccgacgttgacctgggcagcgggacccgaaatatcggaattgagtctgagatccctaacctagatattatcggtaagcggatagaaaaaatcaagcaagagcatgaaacatcctggcactacgaccaggatcacccatataaaacttgggcgtaccatggctcatatgagaccaagcagacagggagcgcttcgtctatggtaaatggagtggtccgtctcctgactaaaccctgggacgtgttgccgaccgttacacagatggcaatgaccgatactacgcctttcggccaacagagagtgtttaaggaaaaggtcgacacacgcacccaggagcccaaagagggtactaagaaactgatgaagattaccgccgaatggctctggaaagagcttgggaagaaaaagacaccaaggatgtgtacgcgggaagagttcaccagaaaggtgcgcagtaacgctgccctgggagcaatctttactgatgagaataaatggaagtccgccagggaagctgtagaggacagccgattctgggaattagtggataaagagcggaacctgcacttggaaggcaagtgcgagacatgtgtttacaatatgatgggcaaaagagagaagaagctcggggaatttggaaaagcgaagggttcaagggccatttggtacatgtggctgggcgcacgcttcctagagtttgaagctcttgggttcctgaacgaggaccattggttttcccgtgaaaattctctcagcggagtcgagggcgagggtctgcacaaattggggtatatcctgcgggatgtgagtaagaaagaaggaggcgccatgtacgcagacgacaccgccggctgggatactagaattacactcgaggaccttaagaacgaagagatggtgaccaatcacatggaaggggagcataagaaactggctgaggccatattcaagttaacatatcagaacaaagtcgttagggtgcaacgccctactccccgaggaaccgtaatggatatcatttcccggagagaccagaggggtagcggccaggtggggacgtacggactgaatacctttacaaacatggaagcgcaattgatccgccagatggagggcgaaggtgtcttcaagaatatccagcacctcactgtgaccgaggaggttgcagtgcagaactggctggccagagtcgggcgggaaaggctatctcgtatggctatttcaggagatgactgcgtggtaaaaccacttgatgaccgattcgccaacgcactgacagctctcaatgatatgggcaagatacgcaaggacatccaacagtgggagcccagtaaaggctggaacgattggactcaggttcctttttgctcccatcacttccatgaactgattatgaaggacgggagagtgttggtcgtgccatgtcggaatcaggatgagttaatcggaagggcccgcattagccaaggtgctggctggtctctgagagaaaccgcctgcctcgggaaatcgtatgcacagatgtggtcacttatgtactttcaccggagggacctgcgactagcggccaacgctatctgtagcgccgtgccgtcccactgggtccccacgagtcgtacaacctggtctatacatgcaaagcacgagtggatgactacagaggacatgctgaccgtttggaataaagtgtggatcagagaaaacccttggatggaggataagactccagtagaaagctgggaggaaattccctatctcggaaagcgcgaggaccagtggtgcggctccttgatcggtctgacctcacgggctacatgggccaaaaatattcaggcagccatcaaccaagtgaggagtcttatagggaatgaggaatacacggattacatgccttctatgaagagattccgccgggaggaagaggaagcgggagtcctgtggtga

SEQ ID NO: 14782 - RNA, 9876 nt, synthetic construct
  misc_feature 1..9876: note = derived and/or modified CDS sequence (opt3) from DENV-2__FJ024452__SS-prME
  source 1..9876: mol_type = other RNA
agcgccggcatgatcattatgctgatccccaccgtgatggctttccacctcactactcggaacggggagcctcatatgatcgtcggtattcaagaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcggtcaccggcgcgagaagcgaagtgtagccctggtgccccatgtcgggatgggacttgaaactcgtaccgagacatggatgagctccgaaggcgcgtggaaacacgctcagagaatcgagacttggatactgaggcatcctggcttcaccatcatggccgcaattttggcctacacaatcgggaccacgcactttcagcgggtgctcattttcatcctgctgactgctgttgcaccatctatgacaatgcgctgcataggaatttcgaacagagattttgtggagggtgtctcaggcgggagctgggtggacatcgtactcgaacacggaagttgtgttaccactatggccaagaataagcccacattagatttcgagctgattaaaaccgaagctaagcagcctgccacgcttaggaaatattgcatcgaggcgaagttgaccaacacaactaccgaatcccggtgtccaacacaaggcgagccctctctgaaagaggaacaggacaagcgctttatctgcaagcatagcatggtggatcgaggttgggggaatggatgtggcctattcggcaaagggggaattgtcacttgcgcaatgtttacctgcaagaaaaacatggagggtaagatagtgcagcctgaaaatctcgagtacacaatcgtggtcaccccacactccggcgaagaacatgccgttgggaacgacactggaaaacacggcaaggagattaaagtgacgccgcagtcaagtatcacagaagctgagctgaccggttatgggactgtaaccatggaatgtagccccagaacaggccttgatttcaatgagatggtgctgttgcaaatggaaaacaaggcctggctcgtccacaggcagtggtttctggacttacctctgccatggctccccggagcagataagcaggagtctaattggatacagaaagagacccttgtgactttcaagaaccctcatgctaaaaagcaagacgttgtggtcctgggctcccaggaaggggccatgcacacagcgttgacgggagccaccgagattcagatgtcaagcggtaatctactgtttactggccatctcaaatgccggctgcgtatggacaaacttcaactgaaggggatgagttactctatgtgtacaggaaaattcaaggtggtaaaagaaatcgcagagacccagcacggcacaatcgttattcgcgtgcagtatgagggtgatgggtccccatgcaagatccccttcgaaattatggacttggagaaaagatacgtcctcggcaggctgataactgtgaacccgatcgtcaccgaaaaggatagccctgtgaacattgaggctgaacccccatttggagactcgtacatcatcattggcgttgagcctgggcagttaaagctgaattggttcaaaaagggatcttccataggtcaaatgtttgagacgaccatgcggggcgccaaacgaatggctatcctaggggatacagcctgggacttcggatcactcggcggtgtgtttacaagtattgggaaggcactgcatcaggtattcggcgccatctatggagctgcgtttagcggcgtctcctggaccatgaaaattcttatcggggtgataatcacatggattggaatgaactctcgcagcacttcattgagtgtttccctggtgctcgtcggcatcgtgaccctgtaccttggtgtaatggtgcaggcagatagcgggtgtgttgtctcttggaagaataaggaactgaaatgcggatcaggcattttcatcacggacaacgtgcacacatggaccgagcagtataagtttcaacccgaaagtccaagcaaattggcctccgctatacagaaggcccaggaggaaggtatttgtggcatcagatctgtgactaggctcgagaatctgatgtggaaacagattacacccgagttaaaccacatcctggcagaaaatgaggtcaagctaaccataatgactggggatatcaaaggaattatgcaagccggcaagcggtcgctccgccctcagccaaccgaactgaagtacagctggaaaacatgggggaaggctaaaatgctttccacggagtcatataaccagaccttcttgatcgacggaccggaaactgccgagtgccccaatacaaacagagcatggaatagtctggaggttgaagattacggctttggtgtgttcaccacaaacatttggctcaagctgaaagagaagcaggacgcgttttgtgactctaagttaatgagcgctgccatcaaagataatagggcagtgcatgccgacatggggtattggatagaatccgctctgaacgatacttggaagattgagaaagcctcattcatcgaggtaaagaattgccactggcctaaaagccataccctttggtctaacggagtcttggaatccgagatgatcattccaaagaacctcgcaggccccgtgagtcaacacaattaccgtcctggttaccacacgcagatcgctggcccatggcatctggggaagctagaaatggacttcgatttttgtgacggaacaaccgttattgtgactgaggattgcggcaaccgggggcccagcctgcgaaccacaactgcctctggaaaactcataaccgaatggtgctgtagatcctgcacactgccgcctcttaggtatcgcggcgaggacggttgttggtacgggatggagatccggccattgaaggaaaaagaggaaaatctggtcaactcattagtgacggcgggacacggccaggttgataatttcagtctcggtgtgctgggcatggccctttttctggaggaaatgttgagaaccagggtagggactaagcatgctattctcctggtcgcagtgagcttcgtgacactaatcaccggaaacatgtcgtttaaagacctgggccgcgtcgttgtgatggtaggggccactatggctgatgacattggaatgggcgtgacatatctcgccctgcttgcagcgttcaaggtccgacccacctttgccgctggtttgctgttacggaagctcacgtccaaagagctgatgatgactaccatcgggatagtgcttctgtctcaaagcacaatccctgagaccgttctagaactcactgatgccctggcattgggaatgatggtgctgaagattgtccgtaatatggagaaataccagttagctgtgacaatcatggccattctctgcgttcccaacgcagtgatcctgcagaatgcctggaaggtctcatgtaccatacttgctgtagtgagtgtttccccactgttgctcacatctagccagcagaagactgactggattcctctggcgctaaccatcaagggcctgaaccccacggccatcttccttacaaccctctccagaactaataaaaagaggtcatggccactgaacgaagcaattatggctgtgggcatggtcagcatattggccagttctctgttaaagaatgacatcccgatgaccgggcctctcgtggccggaggtctgcttacagtatgctatgtgctgactggccgctccgctgatttggagctcgaacgggcaaccgacgtcaaatgggaggatcaggccgagattagcgggtcgtcacccatcctgtctattacgatcagtgaagacggatccatgagcataaagaacgaggaagaggagcagacactaaccatcctgattagaactggccttctcgttatctctggtctgtttccaattagcatccccataacagcggctgcctggtacttgtgggaagtgaaaaagcagagggcaggggtgttatgggatgtcccttccccaccccctatgggaaaagccgagctggaagacggcgcttatcgaattaagcaaaagggcatcctcgggtactcacagatcggagcaggagtgtacaaagagggcaccttccacactatgtggcatgttacacgcggggccgtactgatgcacaagggaaaacggattgaaccgagttgggcggatgtgaagaaagaccttatcagctatggcggtgggtggaagctggagggagagtggaaggaaggcgaggaagtccaggtgttggctctagagccaggcaaaaatcccagagccgttcagaccaagcctgggctgtttaaaacgaacactggaaccataggtgcagtgtctctcgatttctccccaggcacatcagggagtcccattatcgacaagaaaggaaaggtcgtgggcctgtacggtaacggggtagtcaccaggagcggagcctatgtgtccgctattgcccaaacaggcaagtctatcgaagataatcctgagatagaggacgatatttttcgtaaacgccggcttactatcatggacttacacccgggcgcagggaagaccaaaagatacctgcccgctatcgttagggaagccattaagcgaggactccggacgttgatcctggcgccaacacgcgtggtcgccgcagagatggaagaggctctcagaggtctgcctattaggtatcagactcccgccatacgggctgaacataccggccgagagatcgtggaccttatgtgtcacgcaacattcaccatgagactgttgtcgccagttcgcgtgcctaactacaatctaattatcatggatgaggcccatttcactgaccccgccagcatcgctgcgagggggtatatttcaacccgtgtcgaaatgggagaggcagccggcatatttatgacagctacgccaccgggttcccgggatcctttcccccagagtaacgccccaatcattgacgaagagagagagatccccgaaaggtcttggaatagcgggcacgagtgggtgactgattttaaaggaaagaccgtatggttcgtgccttccattaaggcaggcaacgacatcgccgcttgcctgcgcaaaaatggcaagaaagttatacaactctcacgaaagacatttgattctgaatacgtcaaaaccagaatcaacgactgggatttcgtggtgactacagacattagcgagatgggggcgaattttaaggccgaacgggtcatcgatccaaggcgctgtatgaaacccgtaattttaaccgacggagaggagcgtgtgatcctggcaggtcctatgccggttacgcatagttccgctgcccagagacggggcaggatagggcgcaacccaaagaatgaaaacgaccagtacatttatatgggagagccccttgaaaatgatgaggactgcgcacactggaaggaagccaaaatgctgctcgataacatcaatactcctgagggcattatccccagcatgttcgagccagaacgagagaaggtggacgctatagatggtgaatacagattgagaggggaagccaggaaaacatttgtcgacctgatgcgcagaggcgatctccctgtgtggctggcgtataaggttgcagccgaaggaatcaactacgctgacaggcggtggtgtttcgatggcattaaaaacaatcagatccttgaggagaacgtggaagtcgagatttggaccaaggaaggggagcgtaagaaactaaagccccgctggctggacgcccgaatctattctgatccattggctttaaaagagtttaaggagttcgcagccggaagaaaatcactgaccctcaatctgataactgagatgggtaggcttcctacattcatgacccaaaagacacgggacgctctggataacctcgccgtgttgcacactgcagaagcgggcgggcgcgcctacaatcatgctctgtccgagctaccggaaacgctggagaccctccttctgttaacattgctggccactgtaaccggaggcatttttctcttcctgatgagtggtagagggatcggcaagatgacacttggaatgtgctgcatcattaccgcaagcatcctgctctggtatgctcagatacagccccactggattgccgcatcgatcattttggagtttttcctgatcgtgttactaataccagaacctgagaaacagaggactccccaagacaaccagctgacgtacgttgtcatcgccattctcaccgtggtggctgcgacaatggccaatgaaatgggctttcttgagaagactaaaaaggacctggggttgggatctatcgcaacccagcagccagaatccaacattctggatatcgacctccggcctgctagcgcctggacactgtacgccgtcgcaaccactttcgttacacccatgcttcgacattcaattgagaatagttctgtgaacgtatccctcacggctatcgccaatcaagcgaccgtgctgatgggtttgggcaaagggtggccgctgagcaagatggatataggagtcccattactagctattggctgttattcacaggtgaaccctatcactctgacagccgcactccttctgttggttgcccactacgctatcattggtcccgggctgcaggcaaaggccaccagagaggcgcagaaacgcgctgccgcaggcataatgaagaatccaaccgtggacggaatcacagtcattgatctcgaccccatcccttatgatccgaaatttgaaaagcaactgggccaggtaatgcttttaattctgtgcgtgactcaggttctcatgatgaggacgacctgggccttgtgtgaggctctgacactagccactgggcccatcagtaccctgtgggaaggaaacccaggccggttctggaatacaaccatagcagtgagcatggctaacatctttcgtggttcctacctcgccggggcgggacttctgttctctattatgaaaaatactacgaacacaagaaggggcaccggtaacatcggcgagactttgggggaaaagtggaaaagccgcctgaatgccctcggaaagtccgagtttcaaatttataagaaatcaggcatccaggaggtcgaccggaccctggcaaaggaagggataaaacgaggagagacagatcaccatgctgtgtctagaggcagtgccaagttaaggtggttcgtcgaacgcaacatggtgactcctgagggtaaagttgtggaccttgggtgcggacggggcggttggtcgtactattgtggcgggctgaagaatgtaagagaggtgaagggactcaccaaaggcgggcccggacacgaggagcctattccaatgagcacatacggctggaacctagtccgtctgcagtccggtgttgatgtgtttttcataccccctgaaaagtgcgacacgttgctgtgtgatatcggggagtcttcaccaaatcccaccgtcgaagcaggaaggactctccgggtgcttaacctggtagagaattggttgaacaataacacacagttctgcattaaagtgctgaatccgtacatgcctagcgttatagagaagatggaagctctccaacgcaaatatggcggcgccttagtgcgaaacccactgtccagaaatagtacccatgagatgtactgggtctctaacgccagcgggaatatcgtgtcatccgtcaacatgattagtaggatgcttatcaaccggtttactatgcgccacaagaaggcgacatatgaacccgacgtggacctgggaagcggtaccagaaatattggcatcgagtctgaaatacctaacctagatatcattgggaaaaggatcgagaagattaaacaggagcatgaaacgtcctggcactacgaccaggatcacccatataagacctgggcttaccatggatcatatgagacaaaacagactggcagcgcatcgtctatggttaatggtgtagtgcgactcctgaccaagccctgggacgtcttgccgacagtgactcaaatggccatgaccgatacaacccctttcgggcagcagcgggtttttaaggaaaaagtggacactcgtacgcaggagcccaaggaaggaactaaaaagctgatgaaaatcaccgctgagtggctctggaaggagcttggcaaaaagaagactccaagaatgtgtacccgcgaagagttcacaaggaaagtccggagtaacgccgcactgggcgccatttttacggatgaaaataagtggaaatccgctagagaggcggtggaggacagccgcttctgggaattaatagataaggagaggaacctgcacttggaagggaaatgcgagacctgtgtatacaatatgatgggaaagcgagaaaagaaactcggtgagtttggcaaggccaaagggtcacgggcaatctggtacatgtggctgggagctagattcctagagtttgaagcccttggcttcctgaacgaggaccattggttttccagggaaaattctctcagcggtgtggagggggaaggactgcacaagttgggctatattctgcgcgatgttagtaaaaaggagggcggggcaatgtacgccgacgacactgctggatgggatacacgtatcaccctcgaggaccttaagaacgaagagatggtcactaatcacatggaaggtgagcataaaaagctggccgaagcgatcttcaaattaacatatcaaaacaaggtggtgcgggtccagagacctacccccaggggcacagttatggatattatatcccgccgagaccagcgggggagcggacaagtgggcacttacggtctgaatacctttacgaacatggaggcacagttgatcagacagatggagggggaaggagtattcaaaaatattcagcacctcaccgtgacagaggaagtcgccgtgcaaaactggctggctagggttggccgcgagagactatctcggatggccatctcaggcgatgactgcgtggtcaagccacttgatgacaggttcgcaaacgctctgactgccctcaatgatatggggaaggtgcgtaaagacattcagcagtgggagcccagtaagggatggaacgattggacccaggtacctttttgctcccatcacttccatgaactgatcatgaaagacggtcgagttttggtggtcccatgtcgcaatcaagatgagttaatagctagagcccggatcagccagggcgcagggtggtctctgagggaaacagcgtgcctcggaaagtcgtatgcccagatgtggtcacttatgtactttcaccgcagagacctgcggctagctgccaacgcaatttgtagcgctgtgccgtcccactgggtgcccacaagtaggaccacgtggtctatccatgccaaacacgagtggatgacaaccgaagacatgctgactgtctggaatcgagtttggattcgtgagaacccttggatggaggataagacaccagtggaaagctgggaggaaatcccctatctcggcaagagagaggaccagtggtgcggttccttgatagggctgacctcacgcgcaacttgggccaaaaatattcaagcggctatcaaccaggtacggagtcttattggaaatgaagagtacaccgattacatgccttctatgaagaggttcagacgcgaggaagaggaagccggcgtgctgtggtga

SEQ ID NO: 14783 - RNA, 9876 nt, synthetic construct
  misc_feature 1..9876: note = derived and/or modified CDS sequence (opt3) from DENV-2__FJ205877__SS-prME
  source 1..9876: mol_type = other RNA
agcgcaggaatgatcattatgctgataccaaccgtgatggctttccacctcactactagaaacggggagcctcatatgatcgtcggcattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccacatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggaaagaaggtacgtgctcgggcggctgattactgtcaacccgatagtgaccgagaaagatagccctgttaacatcgaagctgagcccccatttggcgactcgtacattatcatcggagtggagcctggccagttaaagctgaattggttcaagaaagggtcttccattggacaaatgtttgaaacgaccatgcgaggtgccaagcgcatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctagaagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacagtataaatttcaacccgagagtccaagcaagttggcctccgctatccagaaagcccaggaagagggcatatgtggtattaggtctgtcactcggctcgagaatctgatgtggaagcagatcacacccgaattaaaccacattctggcagagaatgaagttaaactaaccatcatgactggcgatataaaggggatcatgcaagccggaaaacgctcgctcagacctcagccaaccgagctgaagtacagctggaagacatggggcaaagctaagatgctttccacggaatcatataaccagaccttcttgattgacgggccggagactgccgagtgccccaatacaaacagggcatggaatagtctggaagtggaggattacggatttggcgtgttcaccacaaacatctggctcaaactgaaggaaaaacaggacgcgttttgtgactctaagttaatgagcgctgccattaaggataatcgtgcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatccccaagaacctcgcaggacccgttagtcaacacaattaccggcctggctaccacacgcagattgctggtccatggcatctgggcaagctagagatggacttcgatttttgtgacgggacaaccgtgatcgtcactgaagattgcggaaaccgaggccccagcctgagaaccacaactgcctctgggaagctcattaccgagtggtgctgtaggtcctgcacactgccgcctcttcgctatcggggagaggacggctgttggtacggtatggaaataagaccattgaaagagaaggaagagaatctggtgaactcattagttacggcggggcacggacaggtggataatttcagtctcggcgtactgggtatggccctttttctggaagagatgttgaggacccgcgtcggcactaaacatgctatcctcctggtggcagtgagcttcgtcacactaattaccgggaacatgtcgtttaaggacctgggacgagttgtggtaatggtgggcgccactatggctgatgacatcgggatgggagtcacatatctcgccctgcttgcagcgttcaaagtgcggcccacctttgccgctggcttgctgttacgtaagctcacgtccaaggagctgatgatgactaccattggtatcgttcttctgtctcaaagcacaatacctgaaaccgtgctagagctcactgatgccctggcattggggatgatggtcctgaaaatcgtgagaaatatggaaaagtaccagttagctgttacaattatgaccatcctctgcgtgcccaacgccgtcattctgcagaatgcatggaaagtatcatgtacaatccttgccgtggttagtgtgtccccactgttgctcacttctagcaggcagaagaccgactggatacctctggctctaacgattaaaggactgaaccccacagcgatcttccttaccactctctcccgcaccaataagaaacggtcatggccactgaacgaggccatcatggcagtcggcatggtgagcattttggctagttctctgttaaagaatgacataccgatgacaggccctctcgtagccgggggactgcttactgtgtgctatgtcctgaccggtagatccgccgatttggaactcgagagggctacggacgttaagtgggaggatcaagcagaaatcagcggctcgtcacccattctgtctatcacaattagtgaggacgggtccatgagcatcaaaaacgaagaggaggaacagaccctaactatactgatccgaacaggacttctcgtgatttctggcctgtttccaatcagcattcccatcaccgccgcggcttggtacttgtgggaggtgaagaaacagcgcgccggtgtcttatgggatgtgccttccccaccccctatggggaaggcagaactggaggacggagcctatcggataaaacagaagggcattctcggctactcacaaatcggggctggagtttacaaggaaggtactttccacacaatgtggcatgtaaccagaggcgcagtgctgatgcacaaagggaagaggatcgagccgagttgggccgatgtcaaaaaggaccttattagctatggaggcggttggaaactggagggggaatggaaggagggagaagaggtgcaggttttggcgctagaaccaggcaagaatccccgtgctgtgcagacgaaacctggcctgtttaagactaacaccgggacaatcggagccgtctctctcgatttctccccaggtacctcaggcagtcccataattgacaaaaaggggaaagtggtaggactgtacggcaacggtgtcgtgacacgcagcggggcatatgtttccgccatcgctcagactgagaagtctattgaggataatcctgaaatcgaggacgatatatttcggaagagaaggcttaccattatggacttacacccgggagccggcaaaacgaagcgatacctgcccgcaatcgtgcgggaagctatcaaacgcggcctcagaacattgattctggccccaactagggtcgtggcggccgagatggaagaggcactccgggggctgcctatccgatatcaaacccccgctattagagccgagcatacaggacgcgaaatagttgaccttatgtgtcacgctaccttcactatgaggctgttgtcgccagtgcgtgtccctaactacaatctaatcattatggatgaggcacatttcaccgaccccgccagcatcgccgctcggggttatatctcaacaagagtggaaatgggcgaggcggcagggatttttatgacggccactccaccgggatccagggatcctttcccccagagtaacgctccaataatcgacgaggaacgcgagattcccgaacgatcttggaatagcggccacgagtgggtaaccgattttaagggtaaaacagtgtggttcgttccttccatcaaggccgggaacgacattgcagcctgcctgagaaagaatggcaaaaaggtcatccagctctcacggaaaacctttgattctgaatacgtgaagactaggacaaacgactgggatttcgtggtcaccacggacataagcgagatgggcgctaattttaaagcggagcgcgtaatcgatccacgtagatgtatgaagcccgtgattttaactgacggcgaagaacgggttatcctggccgggcctatgccggtgacacatagttccgcagctcaaaggcgcggacgaattggtagaaaccccaaaaatgaaaacgaccagtacatctatatgggcgagccccttgaaaatgatgaggactgcgcccactggaaggaggcaaagatgctgctcgataacataaatacccctgaagggattatccccagcatgttcgagccagaacgggagaaagtcgacgccattgatggagaatacaggttgcgcggcgaggctagaaagacctttgtggacctgatgaggcggggtgatctccctgtttggctggcctataaagtggcggcagaggggatcaactaccccgaccgtcgctggtgtttcgatggcataaagaacaatcagatccttgaagagaacgtcgaagtggagatttggccaaaagagggagaacgaaagaagctaaaacctagatggctggacccgaggatctattctgagccccgggccttgaaggaatttaaagagttcccacctggccgcaagtcattaactctgaatctcattacagaaatggggagactgcccaccttcatgacacagaaaactagggatgctcttgacaacctggccggactccacacggctgaggccggtggacgggcagataatcatgctttgtccgagctggccgaaaccctagagacactgctccttctgactttattggcaaccgggacaggaggcatctttctgttcctcatgagtggtcgagggataggcaagatgaccctgggaatgtgctgcattatcactgcgagcatccttctgtgggacgcccaaattcagccacactggatcgctgcctcgataattctcgaatttttcttgatcgtactgttaattcctgagcccgaaaagcagagaacgccgcaggacaaccaactaacctacgtggttatcgcaatactgacagtcgtgggcgctactatgccaaatgagatggggtttctcgagaaaaccaagaaagatcttggactgggttctatcgccacacagcagcctgaatccaacattttggacatcgatctgcgccccgcaagcgcctggaccctctatgctgtggcgactacattcgtcacgccaatgctgaggcattcaattgagaatagttctgttaacgtgtcccttaccgccatcgcaaatcaggctactgtactcatgggcctggggaagggatgggccttggccaaaatggacattggcgtgcccctgttaggtatcgggtgttacagccaagtcaaccctataacactaaccggcgcactgctccttctgggaggccactacgctattatcgggccgggattgcaggccaaggcgacccgggaagctcagaagcgtgccgcacccggcatcatgaaaaatccaacagtggatggtattactgttatagacctggatcctatcccctatgaccctaagtttgagaaacagctcgggcaagtgatgctgcttattttatgcgtcacgcaggtactgatgatgagaaccacatgggccctctgtgaggctttgactctggcaaccggaccaatctcaacactatgggagggcaaccccggtaggttctggaataccactattgccgtgagtatggcgaacatctttcgcggcagctacctggctggggccggactccttttctccataatgaagaatacgacaaacacccggcgaggcactgggaacatgggagagaccctgggcgaaaaatggaagtctagattgaatgcactgggtaaaagcgagtttcagatctataagaagtccgggattcaagaagttgataggacactcgccaaagagggaatcaagcgcggcgagactgaccaccatgctgtgtcacggggttctgccaaactgagatggttcgtcgaacgtaacatggtgacccctgagggcaaggtcgtggatttagggtgcgcaaggggaggctggagttactattgtgggggacttaaaaatgttcgggaagtgaagggcctgacaaagggtgggccaggacacgaggaacccattccgatgtcgacgtacggctggaacctcgtacgcctacagagcggcgtggacgtctttttcatccctccagagaaatgcgataccctgttgtgtgacataggggagtcctctcccaatcctactgttgaagctggacgaacactgagagtgctcaaccttgtcgagaattggctgaacaataacacccagttctgcattaaggtgttgaatccatatatgccctcagtaatcgagaaaatggaggccctgcagaggaagtacggtggcgcgctcgtgcggaacccgttaagccgcaattccactcatgaaatgtactgggttagtaacgcctctgggaatatcgtgagctcagtcaacatgatttccagaatgctgataaacaggtttacaatgcgacacaaaaaggcaacctatgagcctgacgtggatcttggaagtggcacgcggaatatcggtattgagagcgaaatccccaacctggacattatcgggaagcgtatagagaaaatcaagcaagaacatgagacctcttggcactacgatcaggaccacccatataaaacatgggcttaccatggatcctatgaaactaagcagaccggctcagccagctcgatggtcaatggcgtggttagactactcacaaaaccttgggatgtactgcccactgtgacccagatggcaatgacagacaccactccattcgggcaacagcgcgtctttaaggagaaggtggatacgaggacacaggaccccaaagagggaaccaagaaattgatgaagattactgctgaatggctgtggaaagagctcggtaagaaaaagacccctcggatgtgtacaagagaagagttcacgcgcaaggttaggtctaacgccgcccttggcgcgatctttaccgatgagaataaatggaagagtgctcgagaagcagtggaggactcccggttctgggaactggtcgataaagagagaaacttacacctggaagggaagtgcgagacttgtgtgtacaatatgatgggaaaaagggagaagaagttgggcgaatttggtaaagccaaggctagccgcgccatttggtatatgtggctcggggcacgtttcctggagtttgaagccctaggattccttaacgaggaccattggttttcacgggaaaattccctgtctggcgtagagggcgaggggctccacaaactgggatacatcttgagagacgtgagcaagaaagaaggtggcgctatgtacgcggatgacacagccgggtgggataccaggattactctggaggacctcaagaacgaagagatggttacaaatcacatggaaggagagcataagaaacttgcagaggctatattcaagctgacctatcagaacaaagtcgtgcgcgtgcaacgaccaacaccgcggggcactgtcatggatatcattagtagaagggaccagcgcggttccgggcaggttgccacctacggattaaatacgtttaccaacatggaagcacaactgatcagacagatggagggcgaaggcgtgttcaagaatatccagcacttgacagtaactgaggaggtggccgtccagaactggctcgctcgggtggggagggaacgtctgccccgaatggccattagcggagatgactgcgttgtgaaacctctagatgcgcgcttcgcaaacgcccttaccgctctgaatgccatgggtaagataagaaaggacatccaacagtgggagccatctaaaggctggaacgattggacacaggtccccttttgctcacatcacttccatgaactcattatgaaggacgggcgggtgctggtagttccttgtaggaatcaggatgagttgatcggacgcgcaagaattagtcaaggcgctggttggtccttacgggaaactgcctgcctggggaaaagctatgctcagatgtggtctctcatgtactttcacaggcgagaccttcgtctggccgcaaacgcgatctgttcggccgtgccatcacactgggtccccaccagcagaacgacatggtccatacatgctaagcacgagtggatgaccactgaggacatgctaacagtgtggaataaagtgtggatccgcgaaaacccttggatggaggataagaccccggtcgaaagttgggaggaaattccatatctgggaaagcgggaggaccagtggtgcggctctctcatcggcttgactagcagggccacctgggccaaaaatattcaggctgccatcaaccaagttagatccctgatagggaatgaggaatacacagattatatgccctcaatgaagcgcttccggagggaggaagaggaagcaggagtgctttggtga

SEQ ID NO: 14784 - RNA, 9876 nt, synthetic construct
  misc_feature 1..9876: note = derived and/or modified CDS sequence (opt3) from DENV-2__FJ024454__SS-prME
  source 1..9876: mol_type = other RNA
tccgcaggaatgatcattatgctgatacccaccgtgatggctttccacctcacaactagaaacggggagcctcatatgatcgtcggcattcaggaaaagggtaaatcccttctgtttaagacggaggacggagttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagcggatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaggaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtcccgtgactatggagtgtagccctagaaccgggcttgatttcaatgaaatggtcctgttgcagatggagaacaaagcctggctcgtgcacaggcagtggtttctggacttaccactgccctggctccctggcgcagataagcaggagtctaattggatccaaaaggaaacacttgttaccttcaaaaacccacatgctaagaaacaggacgtggtcgtgctgggatcccaggagggcgccatgcacactgcgttgacaggggccacggaaatacaaatgtcaagcggaaatctactgtttaccggtcatctcaagtgccggctgcgtatggacaaacttcagctgaagggcatgagttactctatgtgtactgggaagttcaaagtagttaaggagattgcagagacacagcacggaaccatcgtgatccgcgtccagtatgaaggcgatggttccccctgcaaaattccgttcgagatcatggacttggaaaagagatacgtgctcgggaggctgattacagtcaaccctatagtgactgagaaagatagccccgttaacatcgaagctgagccaccttttggcgactcgtacattatcatcggagtggagcccggccaattaaagctgaattggttcaagaaagggtcttccattggacagatgtttgaaaccacgatgcggggtgccaagcgaatggctatactaggcgataccgcctgggacttcgggtcactcggaggcgtatttacaagtatcggtaaagcactgcatcaggtcttcggggccatttatggcgctgcgtttagcggagtgtcctggactatgaagatccttattggcgttatcataacctggatcgggatgaactctcgcagcacatcattgagtgtgtccctggtcctcgtgggaattgtaactctgtaccttggcgtgatggttcaggcagatagcggttgtgtcgtgtcttggaaaaataaggagctgaagtgcgggtcaggaatcttcattaccgacaacgtgcacacgtggacagaacaatataaatttcagccagagagtcccagcaagttggcctccgctatccagaaagcccaggaagagggcatatgtggtattagatctgtcaccaggctcgagaatctgatgtggaagcaaatcactcctgaattaaaccacattctggcagagaatgaagttaaactaacaatcatgaccggcgatataaaggggatcatgcaggccggaaaacggtcgctccgcccacagccgactgagctgaagtacagctggaagacctggggcaaagctaagatgctttccacagaatcatataaccagacgttcttgattgacgggcccgagaccgccgagtgccctaatactaacagagcatggaatagtctggaagtggaggattacggatttggcgtgttcacaaccaacatctggctcaaactgaaggaaaaacaagacgcgttttgtgactctaagttaatgagcgctgccattaaggataatagggcagtacatgccgacatgggttattggatcgagtccgctctgaacgatacatggaaaatagagaaggcctcattcattgaagtcaaaaattgccactggccaaagagccatactctttggtctaacggggtgttggagtccgaaatgatcatccccaaaaacctcgcaggacctgttagtcagcacaattaccgtccaggctaccacacccagattgctggtccctggcatctgggcaagctagagatggacttcgatttttgtgacgggacgacagtgatcgtcaccgaagattgcggaaaccggggcccgagcctgcgaactaccacagcctctgggaagctcattactgagtggtgctgtagatcctgcaccctgcctccacttaggtatcgcggagaggacggctgttggtacggtatggaaatacggcccttgaaagagaaggaagagaatctggtgaactcattagttacagcggggcacggacaagtggataatttcagtctcggcgtactgggtatggccctttttctggaagagatgttgagaacgagggtcggcaccaaacatgctatcctcctggtggcagtgagcttcgtcactctaattacagggaacatgtcgtttaaggacctgggacgcgttgtggtaatggtgggcgccaccatggctgatgacatcgggatgggagtcacttatctcgccctgcttgcagcgttcaaagtgcgacctacatttgccgctggcttgctgttacggaagctcacctccaaggagctgatgatgacgactattggtatcgttcttctgtctcagagcaccatacccgaaacagtgctagagctcaccgatgccctggcattggggatgatggtcctgaaaatcgtgcgtaatatggaaaagtaccagttagctgttactattatggccatcctctgcgtgccaaacgcagtcattctgcagaatgcctggaaagtatcatgtacaatccttgctgtggttagtgtgtcccctctgttgctcacctctagccaacagaagacagactggatacccctggcgctaactattaaaggactgaacccaaccgccatcttccttacgacactctccagaaccaataagaaaaggtcatggccgctgaacgaggcaatcatggctgtcggcatggtgagcattttggccagttctctgttaaagaatgacatacctatgactggccccctcgtagccgggggactgcttaccgtgtgctatgtcctgacaggtcgctccgctgatttggaactcgagcgggcaactgacgttaagtgggaggatcaggccgaaatcagcggctcgtcaccaattctgtctatcaccattagtgaggacgggtccatgagcatcaaaaacgaagaggaggaacagacgctaacaatactgatcagaaccggacttctcgtgatttctggcctgtttcccatcagcattcctatcactgcggctgcctggtacttgtgggaggtgaagaaacaaagggccggtgtcttatgggatgtgccatcaccccctccgatggggaaggccgaactggaggacggagcttatcgaataaaacagaagggcattctcggctacagccagatcggggcaggagtttacaaggaaggtacattccacaccatgtggcatgtaactcgcggcgccgtgctgatgcacaaagggaagcggatcgagccaagttgggcggatgtcaaaaaggaccttattagctatggaggcggttggaaactggagggggaatggaaggagggagaagaggtgcaggttttggctctagaacccggcaagaatcctagagccgtgcaaacaaaaccaggcctgtttaagaccaacacggggactatcggagcagtctctctcgatttctcccccggtacctcaggcagtcctataattgacaaaaaggggaaagtggtaggactgtacggcaacggtgtcgtgacaaggagcggggcctatgtttccgctatcgcccagaccgagaagtctattgagaataacccggaaatcgaggatgacatatttcgtaagcgccggcttacaattatggatttacaccccggagcaggcaaaactaagagatacctgccagctatcgtgagggaagccatcaaacgaggcctccggaccttgattctggcgcctacgcgcgtcgtggccgcagagatggaagaggctctcagagggctgcccatcaggtatcagacaccagccattcgggctgagcatactggacgagaaatagttgaccttatgtgtcacgcaaccttcacaatgagactgttgtcgcctgtgcgcgtccccaattacaacctaatcattatggacgaggcccatttcaccgatccagccagcatcgctgcgaggggttatatctcaactcgtgtggaaatgggcgaggcagccgggatttttatgaccgctacaccgcctggatcccgggaccccttcccacaaagtaatgcccccataatcgatgaggaaagagagattcctgaaaggtcttggaacagcggccacgagtgggtaacggactttaagggtaaaactgtgtggttcgttccatccatcaaggcagggaatgatattgccgcttgcctgcgcaagaacggcaagaaggtcatccagctctcacgaaaaacctttgactctgaatacgtgaagacaagaaccaatgattgggacttcgtggtcactacagatataagcgagatgggcgcgaactttaaagccgagcgggtaatcgaccccaggcgctgtatgaagcctgtgattttaaccgatggcgaggaacgtgttatcctggcagggccgatgccagtgacgcatagttccgctgcccagagacggggaaggattggtcgcaatcccaaaaacgaaaatgaccagtacatctatatgggcgagcctcttgaaaacgacgaggattgcgcacactggaaggaggccaagatgctgctcgacaatataaacactcccgaagggattatcccaagcatgttcgagcctgaacgagagaaagtcgatgctattgacggagaatacagattgcggggcgaggccaggaagacatttgtggatctgatgcgcagaggtgacctccccgtttggctggcgtataaagtggcagccgaggggatcaactacgctgataggcggtggtgtttcgacggcataaagaataaccaaatccttgaagagaatgtcgaagtggagatttggccaaaagagggagaacgtaagaagctaaaacctcgctggctggatgcccgaatctattctgacccgttggctttaaaggagtttaaagagttcgcagccggcagaaagtcactgaccctcaacctgattaccgagatggggaggcttcccactttcatgacacagaaaacccgggatgctctggacaatctcgccgtattgcacacagcagaagcgggaggtcgcgcctacaaccatgctctgtccgagctaccagagactctggaaacgctccttctgttaaccttgctggccacagtgactggcgggatctttctcttcctgatgagtggaagaggcataggtaagatgacccttgggatgtgctgcattatcacagcaagcatcctgctctggtatgctcagattcagcctcactggatcgccgcatcgataattttggagtttttcctgatcgttttactaattcccgaaccagagaagcaaaggacccctcaggataatcagctgacttacgtcgtgatcgccatactcacggtggtcgctgcgaccatggccaacgaaatgggctttcttgagaaaacaaagaaagacctgggattgggctctatcgcaactcagcaacccgagtccaatattctggacatcgatctccggccggctagcgcctggaccctgtacgccgttgcaacaaccttcgtgactccaatgcttcgacattcaattgaaaacagttctgtaaatgtgtccctcacagctatcgccaaccaggcgacggtcctgatggggttgggaaagggttggcctctgagcaaaatggacattggcgtgcccttactagctatcgggtgttattcacaggttaatccaataaccctgactgccgcactccttctgttggtggcccactacgctattatcggacccggcctgcaggcaaaggccacaagagaggcgcaaaagcgcgctgccgcaggtatcatgaaaaaccctaccgtcgatgggattaccgtaatagacctcgatccgatcccctatgacccaaagtttgaaaaacagctgggccaggtgatgcttttaattctgtgcgttacacaagtgctcatgatgaggactacgtgggccttgtgtgaggctctgaccctagccacaggacctatcagtactctgtgggaaggcaatcccgggcggttctggaacaccacaattgcagtcagcatggctaatatctttcgtggatcctacctcgccggcgcgggtcttctgttctctataatgaagaacaccactaacacgagaagggggacaggaaatatgggcgagaccttgggtgagaaatggaaaagccgcctgaacgccctcggcaagtccgaatttcagatctataagaagtcagggattcaggaggtggatcggactctggcaaaagaaggaatcaagcgaggcgagaccgaccaccatgctgtctctagagggagtgccaaattaaggtggttcgtggagcgcaatatggttacacctgaaggaaaggtggtagatcttggctgcggtagagggggatggtcgtactattgtggcggtctgaaaaacgtgagagaggtcaagggcctcactaaagggggaccaggccacgaagaacccattcctatgagcacctacgggtggaatctagttcgtctgcagtccggagtggacgtctttttcatcccacccgaaaaatgcgatacattgctgtgtgacataggcgagtcttcaccgaaccctacggtggaggcaggtaggaccctccgggtacttaatctggtggaaaactggttgaataacaatactcaattctgcattaaggttctgaacccatacatgcccagcgtgatcgagaaaatggaagctctccagcgcaagtatgggggagccttagtccgaaatcctctgtccagaaacagtacacatgagatgtactgggtgtctaatgccagcggcaacatcgtctcatccgtgaacatgattagtaggatgcttataaatcggtttaccatgcgccacaaaaaggcgacttatgaaccagatgttgacctgggcagcgggacaagaaacatcggaattgagtctgagacccccaatctagacatcattggtaagaggatcgagaaaataaagcaggagcatgaaacgtcctggcactacgatcaggaccacccgtataaaacctgggcttaccatggctcatatgagacaaagcaaactgggagcgcatcgtctatggtaaccggagtggtccgactcctgacaaaaccttgggatgtgttgcccactgttacccagatggccatgacagacaccactccattcggccagcagcgggtgtttaaggaaaaggtcgatacgcgtacacaagaccctaaagaggctaccaagaaactgatgaagatcactgccgagtggctctggaaagaacttggtaagaaaaagacccccagaatgtgtacacgcgaggagttcacgaggaaggtgcggagtaacgcagccctgggggctatttttaccgatgagaataaatggaagtccgcgagagaggccgtagaagacagccgcttctgggagttagtggataaagaaaggaacctgcacttggagggaaagtgcgaaacttgtgtttacaatatgatgggcaaacgagagaagaagctcggcgagtttgggaaagcaaagggatcacgggctatctggtacatgtggctgggtgccagattcctagaatttgaggcacttggcttcctgaacgaagaccattggttttccagggaaaattctctcagcggggtcgaaggagagggcctgcacaaattgggttatattctgcgcgatgtgagtaagaaagaagggggagccatgtacgctgacgacacagccggctgggatacccgtatcactctcgaagaccttaagaacgaggaaatggtgacaaatcacatggagggcgaacataagaaactggcggaggcaattttcaagttaacctatcagaacaaagtcgttcgggtgcagagaccaacacccagggggactgtaatggatataatctcccgccgagaccaacggggaagcggtcaggtgggcacctacgggctgaatacgtttaccaacatggaggcccagttgattagacagatggaaggagagggcgtcttcaagaatatccaacacctccctgtgacagaagaggttgctgtgcagaactggctggccagggtcggtcgcgagagactatctcggatgccaatctcaggggatgactgcgtggtaaaaccgcttgatgcaaggttccccactgctctgacccctctcaacgacatgggaaagattcgtaaggatatacatcagtgggacccaagtaaaggctggaatgattggacacaggttcccttttgctcccaccatttccacgaactgatcatgaaggacggccgagtgttggtcgtgccttgtcgcaaccaagatgacttaattgccagagctcggatcagccaggggccaggatggtctctgagggagactgcctgcctcggtaaatcgtatgcacagatgtggtcacttatgtactttcaccgcagagacctgcggctagcggccaatgctatttgtagcgccgtgccctcccattgggtccctaccagtaggacgacatggtctatccacgcaaagcatgaatggatgaccactgaggatatgctgacagtttggaaccgagtgtggatacgtgaaaatccgtggatggaggacaaaaccccagtagagagctgggaagagatcccctatctcggcaagagagaagatcagtggtgcgggtccttgattggactgacttcacgcgctacctgggccaagaacatccaagtggcaattaatcaggtccggagtcttatcggcaacgaggaatacacagactacatgccttctatgaaaaggttcagacgcgaggaggaagaggccggtgtgctgtggtga

SEQ ID NO: 14785 - RNA, 9876 nt, synthetic construct
  misc_feature 1..9876: note = derived and/or modified CDS sequence (opt3) from DENV-2__FJ205878__SS-prME
  source 1..9876: mol_type = other RNA
agcgccggcatgatcattatgctgatacccaccgtgacagctttccacctcactacgagaaacggggagcctcatatgatcgtcggaattcaggaaaagggtaaatcccttctgtttaagaccgaggacggcgttaatatgtgcacattgatggcaatggatttaggggaactgtgtgaggacactatcacctacaaatgcccactactcaggcaaaacgaaccggaggatattgactgttggtgcaattctacatcaacctgggtgacttatggaacatgtaccacgactggcgagcaccggcgcgaaaagcgaagtgtagccctggtgccccatgtcggtatggggcttgagacccgtacagaaacttggatgagctccgagggagcgtggaaacacgctcagagaatcgagacctggatactgaggcatcctggcttcacaatcatggccgcaattttggcctacaccatcggcacgactcactttcagcgggtgctcattttcatcctgctgacagctgttgcaccatctatgaccatgcgctgcatagggatttcgaacagagattttgtggaaggagtctcaggtggcagctgggtggacatcgtactcgagcacgggagttgtgttactacaatggccaagaataagcccaccttagatttcgaactgattaaaacggaggctaagcagcctgccacccttaggaaatattgcatcgaagcgaagttgacaaacactaccacagagtcccggtgtccaactcaaggagagccctctctgaaagaagagcaggacaagcgctttgtgtgcaagcatagcatggtcgatcgaggctggggtaatgggtgtggactattcggcaaaggcgggatcgtgacctgcgcaatgtttacatgcaagaaaaacatggaaggaaagattgtgcagcctgagaatctcgaatacaccatagtcgttactccacactccggtgaggagcatgccgtgggcaacgacacggggaaacacggacaggaaatcaaggtaacaccgcaatcaagtattaccgaggctgaactgactggctatggtaccgtgacaatggagtgtagccccagaaccgggcttgatttcaatgaaatggtcctgttgcagatggagaacaaagcctggctcgtgcacaggcagtggtttctggacttacctctgccatggctccccggcgcagataagcaggagtctaattggatccaaaaggaaactcttgttacattcaaaaaccctcatgctaagaaacaggacgtggtcgtgctgggatcccaggagggcgccatgcacacggcgttgaccggggccactgaaatacaaatgtcaagcggaaatctactgtttacaggtcatctcaagtgccggctgcgtatggacaaacttcagctgaagggcatgagttactctatgtgtaccgggaagttcaaagtagttaaggagattgcagagacacagcacggaactatcgtgatccgcgtccagtatgaaggcgatggttccccatgcaaaattcccttcgagatcatggacttggaaaagagatacgtgctcgggaggctgattaccgtcaacccgatagtgacggagaaagatagccctgttaacatcgaagctgagcccccatttggcgactcgtacattatcatcggagtggagcctggccaattaaagctgaattggttcaagaaagggtcttccattggacagatgtttgaaaccacaatgcggggtgccaagcgaatggctatactaggcgatactgcctgggacttcgggtcactcggaggcgtatttaccagtatcggtaaagcactgcatcaggtcttcggggccatttatggcgctgcgtttagcggagtgtcctggacaatgaagatccttattggcgttatcataacttggatcgggatgaactctcgcagcacctcattgagtgtgtccctggtcctcgtgggaattgtaacgctgtaccttggcgtgatggttcaggcagatagcggttgtgtcgtgtcttggaaaaataaggagctgaagtgcgggtcaggaatcttcattacagacaacgtgcacacctggactgaacaatataaatttcagcccgagagtccaagcaagttggcctccgctatccagaaagcccaggaagagggcatatgtggtattagatctgtcacaaggctcgagaatctgatgtggaagcaaatcacccccgaattaaaccacattctggcagagaatgaagttaaactaactatcatgaccggcgatataaaggggatcatgcaggccggaaaacggtcgctccgccctcagccaacagagctgaagtacagctggaagacgtggggcaaagctaagatgctttccaccgaatcatataaccagactttcttgattgacgggccggagacagccgagtgccccaataccaacagagcatggaatagtctggaagtggaggattacggatttggcgtgttcacaactaacatctggctcaaactgaaggaaaaacaagacgcgttttgtgactctaagttaatgagcgctgccattaaggataatagggcagtacatgccgacatgggttattggatcgagtccgctctgaacgatacctggaaaatagagaaggcctcattcattgaagtcaaaaattgccactggcctaagagccatacgctttggtctaacggggtgttggagtccgaaatgatcatcccaaaaaacctcgcaggacccgttagtcagcacaattaccgtcctggctaccacacacagattgctggtccatggcatctgggcaagctagagatggacttcgatttttgtgacgggaccactgtgatcgtcaccgaagattgcggaaaccggggccccagcctgcgaacaactaccgcctctgggaagctcattacagagtggtgctgtagatcctgcacgctgccgcctcttaggtatcgcggagaggacggctgttggtacggtatggaaatacggccattgaaagagaaggaagagaatctggtgaactcattagttaccgcggggcacggacaagtggataatttcagtctcggcgtactgggtatggccctttttctggaagagatgttgagaactagggtcggcacaaaacatgctatcctcctggtggcagtgagcttcgtcaccctaattactgggaacatgtcgtttaaggacctgggacgcgttgtggtaatggtgggcgccacaatgaccgatgacatcgggatgggagtcacgtatctcgctctgcttgccgcattcaaagtgcgacccacttttgcggccggcttgctgttacggaagctcacctccaaggagctgatgatgacaaccattggtatcgttcttctgtctcagagcactatacctgaaacagtgctagagctcaccgatgctctggccttggggatgatggtcctgaaaatcgtgcgtaatatggaaaagtaccagttagcagttacaattatggctatcctctgcgtgcccaacgccgtcattctgcagaatgcatggaaagtatcatgtactatccttgccgtggttagtgtgtccccactgttgctcacctctagccaacagaagacggactggatacctctggctctaacaattaaaggactgaaccccaccgcgatcttccttactaccctctccagaacaaataagaaaaggtcatggccactgaacgaggccatcatggcagtcggcatggtgagcattttggctagttctctgttaaagaatgacataccgatgactggccctctcgtagccgggggactgcttaccgtgtgctatgtcctgacgggtcgctccgccgatttggaactcgagcgggctacagacgttaagtgggaggatcaggcagaaatcagcggctcgtcacccattctgtctatcaccattagtgaggacgggtccatgagcatcaaaaacgaagaggaggaacagactctaacaatactgatcagaaccggacttctcgtgatttctggcctgtttccaatcagcattcccatcactgccgcggcttggtacttgtgggaggtgaagaaacaaagggccggtgtcttatgggatgtgccttccccaccccctatggggaaggcagaactggaggacggagcctatcgaataaaacagaagggcattctcggctactcacagatcggggctggagtttaccgcgaaggtacattccacaccatgtggcatgtaacgcggggcgcagtgctgatgcacaaggggaaaagaatcgagccgagttgggccgatgtcaagaaagaccttattagctatggaggcggttggaagctggagggggaatggaaagagggagaagaggtgcaggttttggcgctagaaccaggcaagaatcccagggctgtgcaaactaagcctggcctgtttaaaaccaacacagggaccatcggagccgtctctctcgatttctccccaggtacatcaggcagtcccataattgacaagaaagggaaggtggtaggactgtacggcaacggtgtcgtgactcgtagcggggcatatgtttccgccatcgctcagaccgagaaatctattgaggataatcctgaaatcgaggacgatatatttcgcaagcggagacttacgattatggacttacacccgggagccggcaagacaaaaaggtacctgcccgcaatcgtgcgagaagctatcaagcggggcctccgcactttgattctggccccaaccagagtcgtggcggccgagatggaagaggcactcagggggctgcctatccggtatcagacacccgctattcgagccgagcataccggaagagaaatagttgaccttatgtgtcacgctactttcaccatgcgcctgttgtcgccagtgagggtccctaactacaatctaatcattatggatgaggcacatttcacagaccccgccagcatcgccgctcgtggttatatctcaacgcgggtggaaatgggcgaggcggcagggatttttatgactgccaccccaccgggatccagagatcctttcccccaaagtaacgctccaataatcgacgaggaaagggagattcccgaacgctcttggaatagcggccacgagtgggtaacagattttaaaggtaagaccgtgtggttcgttccttccatcaaagccgggaacgacattgcagcctgcctgcgaaagaatggaaagaaagtcatccagctctcaagaaagacttttgattctgaatacgtgaaaacacggaccaacgactgggatttcgtggtcacgactgacataagcgagatgggcgctaattttaaggcggagagggtaatcgatccacgccgttgtatgaaacccgtgattttaacagacggcgaagagagagttatcctggccgggcctatgccggtgacccatagttccgcagctcagcggaggggacgcattggtcgaaacccaaagaatgaaaacgaccagtacatctatatgggcgagccccttgaaaatgatgaggactgcgcccactggaaagaggcaaagatgctgctcgataacataaatacccctgaagggattatccccagcatgttcgagccagaaagagagaaggtcgacgccattgatggagaataccggttgaggggcgaggctcgcaaaacttttgtggacctgatgagaaggggtgatctccctgtttggctggcctataaggtggcggcagaggggatcaactacgccgaccggcgttggtgtttcgatggcataaaaaacaatcaaatccttgaagagaacgtcgaagtggagatttggacaaaggagggagaacgcaaaaagctaaagccccgatggctggacgctagaatctattctgatccattggccttaaaagagtttaaggaattcgctgcaggcaggaaatcactgaccctcaatctgattacagagatggggcggcttcctactttcatgacgcagaagacccgcgacgccctggataacctcgctgtattgcacacagccgaagcaggaggtagagcgtacaatcatgccctgtccgagctaccggagactctggaaaccctccttctgttaacattgctggctaccgtgactggcgggatctttctcttcctgatgagtggaaggggcataggtaaaatgacgcttgggatgtgctgcattatcaccgccagcatcctgctctggtatgcacagattcagccccactggatcgctgcctcgataattttggagtttttcctgatcgttttactaattccagaacctgagaagcaacggacaccccaggacaaccagctgacttacgtcgtgatcgcaatactcaccgtggtcgccgctacaatggcgaatgaaatgggctttcttgagaagaccaaaaaggacctgggattgggctctatcgccactcagcaaccagagtccaacattctggatatcgacctccgacctgcaagcgcttggacactgtacgccgttgccacgaccttcgtgactcccatgcttagacattcaattgaaaatagttctgtaaacgtgtccctcacagcaatcgctaatcaggccaccgtcctgatggggttgggaaaaggttggccgctgagcaagatggatattggcgtgccattactagcgatcgggtgttattcacaggttaaccctataaccctgacagctgccctccttctgttggtggcacactacgccattatcggacccggcctgcaggctaaagcaactcgcgaggcccaaaagagggcggctgccggtatcatgaagaatccaacggtcgacgggattaccgtaatagatctcgaccccatcccttatgatccgaaatttgaaaagcagctgggccaggtgatgcttttaattctgtgcgttacacaagtgctcatgatgcggactacctgggcattgtgtgaggccctgacactagctaccggacccatcagtactctgtgggaaggcaacccagggcgtttctggaatacgacaattgccgtcagcatggcaaacatctttagaggatcctacctcgctggcgccggtcttctgttctctataatgaaaaataccactaacaccaggcgcgggacaggaaacatgggcgagactttgggtgagaagtggaaaagccggctgaatgcgctcggcaagtccgaatttcagatctataaaaagtcagggattcaggaggtggaccgaaccctggccaaggaaggaatcaaaagaggcgagacagatcaccatgcagtctctagggggagtgctaagttacgctggttcgtggagcggaacatggttacgcctgaaggaaaagtggtagaccttggctgcggtagagggggatggtcgtactattgtggcggtctgaagaatgtgcgtgaggtcaaaggcctcaccaaggggggacccggccacgaagagcctattccaatgagcacttacgggtggaacctagttaggctgcagtccggagtggatgtctttttcatcccccctgaaaagtgcgacacattgctgtgtgatataggcgagtcttcaccaaatcccaccgtggaggccggtcggactctccgcgtacttaacctggtggaaaattggttgaacaataacacacaattctgcattaaagttctgaatccgtacatgcctagcgtgatcgagaagatggaagcactccagcgaaaatatgggggagctttagtcagaaacccactgtccaggaatagtacccatgagatgtactgggtgtctaacgccagcggcaatatcgtctcatccgtgaacatgattagtcggatgcttataaaccgctttacgatgagacacaagaaagccacctatgaacccgacgttgacctgggcagcgggacaaggaatatcggaactgagtctgagattcctaacctagatatcattggtaagcgaatcgaaaagataaaacaggagcatgaaacctcctggcactacgaccaggatcacccatataagacatgggcgtaccatggctcatatgagactaaacaaaccgggagcgcttcgtctatggtaaatggagtggtccggctcctgacaaagccctgggacgtgttgccgatggttacccagatggcaatgactgatacgacacctttcggccagcagcgtgtgtttaaagaaaaggtcgacaccagaactcaagagcccaaggagggtaccaaaaagctgatgaaaatcacagccgaatggctctggaaggagcttgggaaaaagaaaacgccacgcatgtgtaccagggaagagttcactcggaaggtgagaagtaacgctgccctgggagcaatttttacagatgagaataagtggaaatccgcccgcgaagctgtagaggacagcaggttctgggaattagtggataaggagcgaaacctgcacttggaaggcaaatgcgagacctgtgtttacaatatgatgggcaagcgggagaaaaagctcggggaatttggaaaggcgaaaggttcaagagccatctggtacatgtggctgggcgcaaggttcctagagtttgaagctcttgggttcctgaacgaggaccattggttttcccgcgaaaattctctcagcggagtcgagggcgagggtctgcacaagttggggtatattctgcgtgatgtgagtaaaaaggaaggaggcgccatgtacgcagacgacactgccggctgggatacacggatcaccctcgaggaccttaaaaacgaagagatggtgacaaatcacatggaaggggagcataagaagctggctgaggccattttcaaattaacttatcagaacaaggtcgttagagtgcagaggcctaccccccgcggaacggtaatggatataatctcccgacgggaccaaagaggtagcggccaggtggggacctacggactgaatacatttactaacatggaagcgcagttgattaggcagatggagggcgaaggtgtcttcaaaaatatccaacacctcaccgtgacagaggaggttgcagtgaagaactggctggcccgcgtcgggagagaacggctatctaggatggctatctcaggagatgactgcgtggtaaaaccacttgatgaccgtttcgccaacgcactgactgctctcaatgatatgggcaagattcgaaaggacatacagcagtgggagcccagtaaaggctggaacgattggacccaggttcctttttgctcccatcacttccatgaactgatcatgaaggacgggcgcgtgttggtcgtgccatgtagaaatcaagatgagttaattggacgggccaggatcagccagggtgctggctggtctctgcgcgaaacggcctgcctcgggaaatcgtatgcacagatgtggtcacttatgtactttcacagacgggacctgaggctagcggccaacgctatttgtagcgccgtgccgtcccactgggtccccacaagtcgaaccacttggtctatccatgcaaagcacgagtggatgacaaccgaggacatgctgactgtttggaatcgtgtgtggataagagaaaacccttggatggaggataaaaccccagtagaaagctgggaggaaatcccctatctcggaaagcgcgaggaccagtggtgcggctccttgattggtctgacatcacgggctacgtgggccaagaatatccaagcagccattaaccaggtgaggagtcttatcgggaatgaggaatacaccgattacatgccttctatgaaaagattccgccgggaggaagaggaagcgggagtcctgtggtga

SEQ ID NO: 14786 - RNA, 9876 nt, synthetic construct
  misc_feature 1..9876: note = derived and/or modified CDS sequence (opt3) from DENV-2__FJ205879__SS-prME
  source 1..9876: mol_type = other RNA
agcgcaggcatgataattatgctgatacccaccgtgatggctttccacctcaccactagaaacggggagcctcatatgatcgtcggtattcaagaaaagggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttatctgcaagcatagcatggtggatcgaggctggggtaatgggtgtggactattcggcaaaggcgggattgtcacttgcgcaatgtttacctgcaagaaaaacatggaaggaaagatagtgcagcctgagaatctcgaatacacaatcgtggtcaccccacactccggtgaggagcatgccgttggcaacgacactgggaaacacggaaaggaaattaaagtgacgccgcagtcaagtatcacagaggctgaactgaccggctatggtactgtaaccatggagtgtagccccagaacagggcttgatttcaatgaaatggtgctgttgcaaatggagaacaaggcctggctcgtccacaggcagtggtttctggacttacctctgccatggctccccggcgcagataagcaggagtctaattggatacagaaagaaacccttgtgactttcaagaaccctcatgctaaaaagcaagacgttgtggtcctgggatcccaggagggcgccatgcacacagcgttgacgggggccaccgaaattcagatgtcaagcggaaatctactgtttactggtcatctcaaatgccggctgcgtatggacaaacttcaactgaagggcatgagttactctatgtgtacagggaaattcaaggtggtaaaagagatcgcagagacccagcacggaacaatcgttattcgcgtgcagtatgaaggcgatggttccccatgcaagatccccttcgagattatggacttggagaagagatacgtcctcgggaggctgataactgtgaacccgatcgtcaccgagaaggatagccctgtgaacattgaagctgagcccccatttggcgactcgtacatcatcattggagttgagcctggccagttaaagctgaattggttcaaaaaggggtcttccataggacaaatgtttgaaacgaccatgcggggtgccaaacgaatggctatcctaggcgatacagcctgggacttcgggtcactcggaggcgtgtttacaagtattggtaaggcactgcatcaggtattcggggccatctatggcgctgcgtttagcggagtctcctggaccatgaaaattcttatcggcgtgataatcacatggattgggatgaactctcgcagcacttcattgagtgtttccctggtgctcgtcggaatcgtgaccctgtaccttggcgtaatggtgcaggcagatagcggttgtgttgtctcttggaagaataaggagctgaaatgcgggtcaggaattttcatcacggacaacgtgcacacatggaccgaacagtataagtttcaacccgagagtccaagcaaattggcctccgctatacagaaggcccaggaagagggcatttgtggtatcagatctgtgactaggctcgagaatctgatgtggaaacagattacacccgaattaaaccacatcctggcagagaatgaagtcaagctaaccataatgactggcgatatcaaagggattatgcaagccggaaagcggtcgctccgccctcagccaaccgagctgaagtacagctggaaaacatggggcaaggctaaaatgctttccacggaatcatataaccagaccttcttgatcgacgggccggagactgccgagtgccccaatacaaacagagcatggaatagtctggaagttgaggattacggatttggcgtgttcaccacaaacatttggctcaagctgaaagaaaagcaggacgcgttttgtgactctaagttaatgagcgctgccatcaaagataatagggcagtgcatgccgacatgggttattggatagagtccgctctgaacgatacttggaagattgagaaagcctcattcatcgaagtaaagaattgccactggcctaaaagccataccctttggtctaacggggtcttggagtccgaaatgatcattccaaagaacctcgcaggacccgtgagtcaacacaattaccgtcctggctaccacacgcagatcgctggtccatggcatctgggcaagctagagatggacttcgatttttgtgacgggacaaccgttgtggtcactgaagattgcggaaaccggggccccagcctgcgaaccacaactgcctctgggaaactcattaccgagtggtgctgtagatcctgcacactgccgcctcttaggtatcgcggagaggacggctgttggtacggtatggaaatacggccattgaaggagaaagaagagaatctggtgaactcattagttacggcggggcacggacaggtggataatttcagtctcggcgtactgggtatggccctttttctggaagagatgttgagaaccagggtcggcactaagcatgctatcctcctggtggcagtgagcttcgtcacactaattaccgggaacatgtcgtttaaagacctgggacgcgttgtggtaatggtgggcgccactatggctgatgacatcgggatgggagtcacatatctcgccctgcttgcagcgttcaaggtgcgacccacctttgccgctggcttgctgttacggaagctcacgtccaaagagctgatgatgactaccattggtatcgttcttctgtctcaaagcacaatacctgaaaccgtgctagagctcactgatgccctggcattggggatgatggtcctgaagatcgtgcgtaatatggaaaaataccagttagctgttacaattatggccatcctctgcgtgcccaacgcagtcattctgcagaatgcctggaaggtatcatgtaccatccttgctgtggttagtgtgtccccactgttgctcacatctagccagcagaagactgactggatacctctggcgctaaccattaagggactgaaccccacggccatcttccttacaaccctctccagaactaataaaaagaggtcatggccactgaacgaggcaatcatggctgtcggcatggtgagcattttggccagttctctgttaaagaatgacataccgatgaccggccctctcgtagccgggggactgcttacagtgtgctatgtcctgactggtcgctccgctgatttggaactcgagcgggcaaccgacgttaaatgggaggatcaggccgaaatcagcggctcgtcacccattctgtctatcacgattagtgaggacgggtccatgagcatcaagaacgaagaggaggaacagacactaaccatactgatcagaactggacttctcgtgatttctggcctgtttccaatcagcattcccatcacagcggctgcctggtacttgtgggaggtgaaaaagcagagggccggtgtcttatgggatgtgccttccccaccccctatggggaaagccgaactggaggacggagcttatcgaataaagcaaaagggcattctcggctactcacagatcggggcaggagtttacaaagaaggtaccttccacactatgtggcatgtaacacgcggcgccgtgctgatgcacaaggggaaacggatcgagccgagttgggcggatgtcaagaaagaccttattagctatggaggcggttggaagctggagggggaatggaaggagggagaagaggtgcaggttttggctctagaaccaggcaaaaatcccagagccgtgcagaccaagcctggcctgtttaaaacgaacactgggaccatcggagcagtctctctcgatttctccccaggtacatcaggcagtcccataattgacaagaaagggaaggtggtaggactgtacggcaacggtgtcgtgaccaggagcggggcctatgtttccgctatcgcccaaacagagaagtctattgaggataatcctgaaatcgaggacgatatatttcgtaaacgccggcttactattatggacttacacccgggagcaggcaagaccaaaagatacctgcccgctatcgtgagggaagccatcaagcgaggcctccggacgttgattctggcgccaacacgcgtcgtggccgcagagatggaagaggctctcagagggctgcctatcaggtatcagactcccgccattcgggctgagcataccggacgagaaatagttgaccttatgtgtcacgcaacattcaccatgagactgttgtcgccagtgcgcgtccctaactacaatctaatcattatggatgaggcccatttcactgaccccgccagcatcgctgcgaggggttatatctcaacccgtgtggaaatgggcgaggcagccgggatttttatgacagctacgccaccgggatcccgggatcctttcccccagagtaacgccccaataatcgacgaggaaagagagattcccgaaaggtcttggaatagcggccacgagtgggtaactgattttaaaggtaagaccgtgtggttcgttccttccatcaaggcagggaacgacattgccgcttgcctgcgcaaaaatggaaagaaagtcatccaactctcacgaaagacatttgattctgaatacgtgaaaaccagaactaacgactgggatttcgtggtcacaaccgacataagcgagatgggcgcgaattttaaggccgagcgggtaatcgatccaaggcgctgtatgaaacccgtgattttaacggacggcgaagaacgtgttatcctggcagggcctatgccggtgactcatagttccgctgcccagagacggggaaggattggtcgcaacccaaagaatgaaaacgaccagtacatctatatgggcgagccccttgaaaatgatgaggactgcgcacactggaaggaggccaaaatgctgctcgataacataaatacacctgaagggattatccccagcatgttcgagccagaacgagagaaggtcgacgctattgatggagaatacagattgcggggcgaggccaggaaaacctttgtggacctgatgcgcagaggtgatctccctgtttggctggcgtataaggtggcagccgaggggatcaactacgctgacaggcggtggtgtttcgatggcatcaaaaacaatcagatccttgaagagaacgtcgaagtggagatttggaccaaggagggagaacgtaagaaactaaagccccgctggctggacgcccgaatctattctgatccattggctttaaaagagtttaaggagttcgcagccggcagaaaatcactgactctcaatctgattacagagatggggaggcttcctaccttcatgacacaaaagactcgggacgctctggataacctcgccgtattgcacacggcagaagcgggaggtcgcgcctacaatcatgctctgtccgagctaccggagaccctggaaacactccttctgttaactttgctggccaccgtgacaggcgggatctttctcttcctgatgagtggaagaggcataggtaagatgacccttgggatgtgctgcattactacggcaagcatcctgctctggtatgctcagatccagccccactggattgccgcatcgatcatattggagtttttcctgattgttttactaatcccagaacctgagaaacagaggacaccccaagacaaccagctgacatacgtcgtgattgccatcctcactgtggtcgctgcgaccatggccaatgaaatgggctttcttgagaagactaaaaaggacctgggattgggctctatagcaacccagcagccagagtccaacatcctggatattgacctccggcctgctagcgcctggactctgtacgccgttgcaacaacgttcgtgacccccatgcttcgacattcaatcgaaaatagttctgtaaacgtgtccctcactgctattgccaatcaagcgacagtcctgatggggttgggaaaaggttggccgctgagcaagatggatatcggcgtgccattactagctattgggtgttattcacaggttaaccctatcaccctgaccgccgcactccttctgttggtggcccactacgctataattggacccggcctgcaggcaaaggccacaagagaggcgcagaaacgcgctgccgcaggtatcatgaagaatccaactgtcgacgggatcacggtaattgatctcgaccccataccttatgatccgaaatttgaaaagcaactgggccaggtgatgcttttaatcctgtgcgttacccaggtgctcatgatgaggacaacttgggccttgtgtgaggctctgaccctagccacaggacccattagtaccctgtgggaaggcaacccagggcggttctggaatactacgatcgcagtcagcatggctaacatttttcgtggatcctacctcgccggcgcgggtcttctgttctctatcatgaaaaatacaaccaaccctagaagggggactggaaacatgggcgagaccttgggtgagaagtggaaaagccgcctgaatgccctcggcaagtccgaatttcaaatatataagcggtcagggatccaggaggtggaccgaacactggcaaaagaaggaattaagagaggcgagactgatcaccatgctgtctctagggggagtgccaaattacgctggttcgtggagcggaacatggttacccccgaaggaaaggtggtagaccttggctgcggtagagggggatggtcgtactattgtggcggtctgaaaaatgtgcgtgaggtcaagggcctcacaaaagggggacctggccacgaagaaccaatccccatgagcacgtacgggtggaacctagttaggctgcagtccggagtggatgtctttttcattcctccagaaaaatgcgacaccttgctgtgtgatatcggcgagtcttcacccaatccgactgtggaggcaggtcggacactccgcgtacttaacctggtggaaaattggttgaacaataacacccagttctgcataaaggttctgaatccttacatgccaagcgtgattgagaaaatggaagctctccaacgaaagtatgggggagccttagtcagaaaccccctgtccaggaatagtactcatgagatgtactgggtgtctaacgccagcggcaatatcgtctcatccgtgaacatgatcagtcggatgcttattaaccgctttacaatgagacacaaaaaggcgacctatgaacctgacgttgacctgggcagcgggacgaggaatataggaatcgagtctgagattccaaacctagatatcattggtaagcgaatcgagaaaataaagcaggagcatgaaacctcctggcactacgaccaggatcacccctataaaacatgggcttaccatggctcatatgagactaagcagaccgggagcgcatcgtctatggtaaatggagtggtccggctcctgacaaaaccgtgggacgtgttgcctactgttacccaaatggccatgacagataccactcccttcggccagcagcgtgtgtttaaggaaaaggtcgacacgagaacacaggagccaaaagagggtaccaagaaactgatgaagatcactgctgaatggctctggaaagagcttgggaagaaaaagacccctcgcatgtgtacaagggaagagttcacgcggaaggtgagaagtaacgccgcactgggagccatttttaccgatgagaataaatggaagtccgctcgcgaagcggtagaggacagcaggttctgggaattagtggataaagagcgaaacctgcacttggaaggcaagtgcgagacttgtgtttacaatatgatgggcaaacgggagaagaagctcggggaatttggaaaagccaagggttcaagagcaatctggtacatgtggctgggcgctaggttcctagagtttgaagcccttgggttcctgaacgaggaccattggttttcccgcgaaaattctctcagcggagtcgagggcgagggtctgcacaaattggggtatattctgcgtgatgtgagtaagaaagaaggaggcgcaatgtacgccgacgacacagctggctgggatacccggatcactctcgaggaccttaagaacgaagagatggtgacaaatcacatggaaggggagcataagaaactggccgaggcgattttcaagttaacctatcaaaacaaagtcgttagagtgcagaggcccacaccacgcggaactgtaatggatataatctcccgacgggaccagagaggtagcggccaagtggggacctacggactgaatacgtttaccaacatggaagcacagttgattaggcagatggagggcgaaggtgtcttcaagaatatccagcacctcacagtgactgaggaggttgccgtgcaaaactggctggctcgcgtcgggagagaacggctatctaggatggccatctcaggagatgactgcgtggtaaaaccccttgatgaccgtttcgcaaacgctctgaccgccctcaatgatatgggcaagattcgaaaggacatacagcagtgggagcctagtaaaggctggaacgattggacacaggttccattttgctcccatcacttccatgaactgatcatgaaggacgggcgcgtgttggtcgtgccgtgtagaaatcaagatgagttaattggacgggctaggatcagccagggtgccggctggtctctgcgcgaaactgcatgcctcgggaaatcgtatgcgcagatgtggtcacttatgtactttcacagacgggacctgaggctagccgctaacgccatttgtagcgcagtgccctcccactgggtccctaccagtcgaacgacatggtctatccatgctaagcacgagtggatgaccactgaggacatgctgacagtttggaatcgtgtgtggataagagaaaacccatggatggaggataaaacccccgtagaaagctgggaggaaatcccttatctcggaaagcgcgaggaccagtggtgcggctccttgattggtctgacttcacgggccacctgggcaaagaatatccaagccgcgattaaccaggtgaggagtcttatcgggaatgaggaatacacagattacatgccatctatgaaaagattccgccgggaggaagaggaagctggagtcctgtggtga

SEQ ID NO: 14787 - RNA, 9876 nt, synthetic construct
  misc_feature 1..9876: note = derived and/or modified CDS sequence (opt3) from DENV-2__FJ390385__SS-prME
  source 1..9876: mol_type = other RNA
agcgcaggaatgatcattatgctgatacccaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagctaccgagaaggatagccctgtgaacatcgaagccgagcccccatttggcgactcgtacattatcatcggagttgagcctggccagttaaagctgaattggttcaaaaaggggtcttccattggacaaatgtttgaaacgaccatgcggggtgctaaacgaatggccatactaggcgatacagcatgggacttcgggtcactcggaggcgtgtttacaagtatcggtaaggccctgcatcaggtattcggggctatttatggcgcggcatttagcggagtctcctggaccatgaaaatccttattggcgtgatcataacatggatcgggatgaactctcgcagcacttcattgagtgtttccctggtgctcgtcggaattgtgaccctgtaccttggcgtaatggtgcaggccgatagcggttgtgttgtctcttggaagaataaggagctgaaatgcgggtcaggaatcttcattacggacaacgtgcacacatggaccgaacagtataagtttcaacccgagagtccaagcaaattggcttccgccatccagaaggcacaggaagagggcatatgtggtattagatctgtgactaggctcgagaatctgatgtggaaacagatcacacccgaattaaaccacattctggccgagaatgaagtcaagctaaccatcatgactggcgatataaaagggatcatgcaagctggaaagcggtcgctccgccctcagccaaccgagctgaagtacagctggaaaacatggggcaaggccaaaatgctttccacggaatcatataaccagaccttcttgattgacgggccggagactgcagagtgccccaatacaaacagagcgtggaatagtctggaagttgaggattacggatttggcgtgttcaccacaaacatctggctcaagctgaaagaaaagcaggacgctttttgtgactctaagttaatgagcgccgcaattaaagataatagggccgtgcatgctgacatgggttattggatcgagtccgccctgaacgatacttggaagatagagaaagcatcattcattgaagtaaagaattgccactggcctaaaagccataccctttggtctaacggggtcttggagtccgaaatgatcatcccaaagaacctcgctggacccgtgagtcaacacaattaccgtcctggctaccacacgcagattgccggtccatggcatctgggcaagctagagatggacttcgatttttgtgacgggacaaccgttatcgtgactgaagattgcggaaaccggggccccagcctgcgaaccacaactgcgtctgggaaactcattaccgagtggtgctgtagatcctgcacactgccgcctcttaggtatcgcggagaggacggctgttggtacggtatggaaatacggccattgaaggagaaagaagagaatctggtcaactcattagtgacggccgggcacggacaggttgataatttcagtctcggcgtgctgggtatggctctttttctggaagagatgttgagaaccagggtaggcactaagcatgcaatcctcctggtcgccgtgagcttcgtgacactaattaccgggaacatgtcgtttaaagacctgggacgcgtcgttgtgatggtaggcgctactatggccgatgacatcgggatgggagtgacatatctcgcactgcttgcggccttcaaggtccgacccacctttgctgccggcttgctgttacggaagctcacgtccaaagagctgatgatgactaccattggtatcgtgcttctgtctcaaagcacaatacctgaaaccgttctagagctcactgatgcactggctttggggatgatggtgctgaagatcgtccgtaatatggaaaaataccagttagccgtgacaattatggcaatcctctgcgttcccaacgccgtgattctgcagaatgcttggaaggtcggatgtaccatccttgcggtagtgtcagttagtccactgttgctcacatcctctcagcagaaaactgactggatacctctggccctaaccattaagggcctgaaccccacggcaatcttccttacaaccctcagcagaactaataaaaagaggtcctggccactgaacgaggctatcatggccgtgggcatggtctcaattttggccagcagtctgttaaagaatgacataccgatgaccgggcctctcgtggctggaggtctgcttacagtatgctatgtgctgactggccgctctgcagatttggaactcgagcgggccaccgacgtcaaatgggaggatcaggcggaaatctccgggagctcgcccattctgtcaatcacgatttctgaggacggaagtatgtccatcaagaacgaagaggaggaacagacactaaccatactgatcagaactggccttctcgttattagcggtctgtttccaatctctattcccatcacagctgccgcatggtacttgtgggaggtgaaaaagcagagggccggggtgttatgggatgtccctagcccaccccctatgggaaaagctgaactggaggacggcgcatatcgaataaagcaaaagggcattctcgggtactcccagatcggagccggtgtgtacaaagaaggcaccttccacactatgtggcatgttacacgcggggcggtactgatgcacaagggaaaacggatcgagccgtcatgggctgatgtgaagaaagaccttattagttatggcggtgggtggaagctggagggagaatggaaggagggcgaagaggtccaggtgttggccctagaaccaggcaaaaatcccagagcagttcagaccaagcctgggctgtttaaaacgaacactggaaccatcggtgccgtgagcctcgatttctctccaggcacatccgggtcacccataattgacaagaaaggaaaggtcgtgggcctgtacggtaacggggtagtcaccaggagtggagcttatgtgagcgccatcgcacaaacagagaagtccattgaggataatcctgaaatcgaggacgatatatttcgtaaacgccggcttactattatggacttacacccgggcgctggcaagaccaaaagatacctgcccgccatcgttagggaagcgatcaagcgagggctccggacgttgattctggccccaacacgcgtggtcgcagctgagatggaagaggccctcagaggactgcctatcaggtatcagactcccgctattcggtctgagcataccggtcgagaaatagtggaccttatgtgtcacgcaacattcaccatgagactgttgtcgccagttcgcgtgcctaactacaatctaatcattatggatgaggcccatttcactgaccccgccagcatcgctgcgaggggctatatctcaacccgtgtcgaaatgggggaggcagccggaatttttatgacagctacgccaccgggctcccgggatcctttcccccagagtaacgccccaataatcgacgaggaaagagagattcccgaaaggtcttggaatagcggtcacgagtgggtgactgattttaaagggaagaccgtatggttcgtgccttccatcaaggcaggaaacgacattgccgcttgcctgcgcaaaaatggcaagaaagttatccaactctcacgaaagacatttgattctgaatacgtcaaaaccagaactaacgactgggatttcgtggtgacaaccgacataagcgagatgggcgcgaattttaaggccgagcgggtcatcgatccaaggcgctgtatgaaacccgtaattttaacggacggggaagaacgtgtgatcctggcaggacctatgccggttactcatagttccgctgcccagagacggggtaggattggccgcaacccaaagaatgaaaacgaccagtacatctatatgggggagccccttgaaaatgatgaggactgcgcacactggaaggaggccaaaatgctgctcgataacataaatacacctgaaggaattatccccagcatgttcgagccagaacgagagaaggtggacgctattgatggcgaatacagattgcggggtgaggccaggaaaacctttgtcgacctgatgcgcagaggggatctccctgtgtggctggcgtataaggttgcagccgagggcatcaactacgctgacaggcggtggtgtttcgatggaatcaaaaacaatcagatccttgaagagaacgtggaagtcgagatttggaccaaggagggcgaacgtaagaaactaaagccccgctggctggacgcccgaatctattctgatccattggctttaaaagagtttaaggagttcgcagccgggagaaaatcactgactctcaatctgattacagagatgggaaggcttcctaccttcatgacacaaaagactcgggacgctctggataacctcgccgtgttgcacacggcagaagcgggtggccgcgcctacaatcatgctctgtccgagctaccggagaccctggaaacactccttctgttaactttgctggccaccgtaacagggggaatctttctcttcctgatgagtggcagaggtatagggaagatgacccttggcatgtgctgcattatcactgcaagcatcctgctctggtatgctcagattcagccccactggatcgccgcatcgataattttggagtttttcctgatcgtgttactaattccagaacctgagaaacagaggacgccccaagacaaccagctgacctacgttgtcatcgccatactcacagtggtggctgcgactatggccaatgaaatgggatttcttgagaagaccaaaaaggacctgggcttggggtctatcgcaacacagcagccagagtccaacattctggatatcgacctccggcctgctagcgcctggaccctgtacgccgtcgcaactacattcgttacgcccatgcttcgacattcaattgaaaatagttctgtgaacgtatccctcaccgctatcgccaatcaagcgactgtgctgatgggattgggtaaaggctggccgctgagcaagatggatattggggtcccattactagctatcggatgttattcacaggtgaaccctataacactgaccgccgcactccttctgttggttgcccactacgctattatcggccccggtctgcaggcaaaggccaccagagaggcgcagaaacgcgctgccgcagggatcatgaagaatccaacagtggacggcattactgtcatagatctcgaccccatcccttatgatccgaaatttgaaaagcaactgggacaggtaatgcttttaattctgtgcgtgacgcaggttctcatgatgaggaccacatgggccttgtgtgaggctctgactctagccaccggccccatcagtacactgtgggaagggaacccaggacggttctggaataccactattgcagtgagcatggctaacatctttcgtggctcctacctcgccggtgcggggcttctgttctctataatgaaaaatacgacaaacaccagaaggggaactggcaacatgggtgagaccttgggcgagaagtggaaaagccgcctgaatgccctcgggaagtccgaatttcaaatctataagcggtcaggcattcaggaggtcgaccgaacactggcaaaagaaggcatcaagagaggggagactgatcaccatgctgtgtctaggggaagtgccaaattacgctggttcgtcgagcggaacatggtgacccctgaaggcaaggttgtggaccttggttgcgggagaggaggctggtcgtactattgtggtggcctgaaaaatgtacgtgaggtgaaggggctcacaaagggaggccccgggcacgaagaacctattccaatgagcacgtacggatggaacctagtcaggctgcagtccggcgttgatgtgtttttcataccccctgaaaaatgcgacaccttgctgtgtgatataggtgagtcttcaccaaatcccactgtcgaggcagggcggacactccgcgtgcttaacctggtagaaaattggttgaacaataacacccagttctgcattaaggtgctgaatccgtacatgcctagcgttatcgagaaaatggaagctctccaacgaaagtatggaggcgccttagtgagaaacccactgtccaggaatagtactcatgagatgtactgggtctctaacgccagcggcaatatcgtgtcatccgtcaacatgattagtcggatgcttataaaccgctttacaatgagacacaaaaaggcgacctatgaacccgacgtggacctggggagcggaacgaggaatatcggtaccgagtctgagattcctaacctagatatcattggcaagcgaatcgagaaaataaagcaggagcatgaaacatcctggcactacgaccaggatcacccatataaaacttgggcttaccatgggtcatatgagaccaagcagacaggaagcgcatcgtctatggttaatggcgtagtgcggctcctgactaaaccctgggacgtcttgccgaccgtgacacaaatggccatgaccgatactacgcctttcggtcagcagcgtgtttttaaggaaaaggtggacacaagaacccaggagcccaaagaggggactaagaaactgatgaagatcaccgctgaatggctctggaaagagcttggaaagaaaaagacaccacgcatgtgtacgagggaagagttcacccggaaggtcagaagtaacgccgcactgggcgccatttttactgatgagaataaatggaagtccgctcgcgaagcggtggaggacagcaggttctgggaattagtagataaagagcgaaacctgcacttggaaggcaagtgcgagacatgtgtgtacaatatgatggggaaacgggagaagaagctcggagaatttggtaaagccaagggctcaagagcaatctggtacatgtggctgggggctaggttcctagagtttgaagcccttggattcctgaacgaggaccattggttttcccgcgaaaattctctcagcggcgttgagggtgaggggctgcacaaattgggatatattctgcgtgatgtcagtaagaaagaaggcggcgcaatgtacgccgacgacaccgctgggtgggatactcggatcacactcgaggaccttaagaacgaagagatggtgaccaatcacatgaagggagaacataaaaagctggccgaggcgattttcaaattaacatatcaaaacaaggtggtcagagttcagaggcctactccccgcggtaccgtgatggatataatctcccgacgggaccagagaggcagcgggcaagtaggaacgtacggcctgaatacctttacaaacatggaggcacagttgattaggcagatggaaggtgagggggtgttcaaaaatatccagcacctcactgtcaccgaagaggtggccgttcaaaactggctggctcgcgtgggaagagagcggctatctaggatggccatctcaggcgatgactgcgtcgtgaagccacttgatgaccgtttcgcaaacgctctgacagccctcaatgatatgggcaagattcgaaaagacatacagcagtgggaacccagtaaggggtggaacgattggactcaggtacctttttgctcccatcacttccatgagctgatcatgaaagacggacgcgttttggtggtcccatgtagaaatcaagatgaattaattggtcgggctaggatcagccagggcgccgggtggtctctgcgcgagaccgcatgcctcggaaagtcgtatgcgcagatgtggtcacttatgtactttcacagacgggacctgaggctagccgctaacgccatttgtagcgcagtgccgtcccactgggtgcccacgagtcgaacaacctggtctatccatgctaaacacgaatggatgactacagaggacatgctgaccgtctggaatcgtgtttggataagagagaacccttggatggaagataagactccagtggagagctgggaagagatcccctatctcggcaagcgcgaagaccagtggtgcggttccttgattgggctgacctcacgggccacatgggccaaaaatatccaagccgcgattaaccaggtaaggagtcttatcggaaatgaggagtacacggattacatgccttctatgaagagattccgccgggaagaggaagaggctggcgtgctgtggtga

SEQ ID NO: 14788 - RNA, 9876 nt, synthetic construct
  misc_feature 1..9876: note = derived and/or modified CDS sequence (opt3) from DENV-2__FJ024458__SS-prME
  source 1..9876: mol_type = other RNA
tccgccggaatgatcattatgctgatacccaccgtgatggctttccacctcactactagaaacggggaacctcatatgatcgtcgggattcaagaaaagggtaaatcccttctgtttaagacggaagacggcgttaatatgtgcaccttgatggcaatggatttaggggaactgtgtgaggacacgatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggggcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggacggcgctcgctcagacctcagccaaccgagctgaagtacagctggaagacatggggcaaagctaagatgctttccacggaatcatataaccagaccttcttgattgacgggccggagactgccgagtgccccaatacaaacagggcatggaatagtctggaagtggaggattacggatttggcgtgttcaccacaaacatctggctcaaactgaaggaaaaacaggacgcgttttgtgactctaagttaatgagcgctgccattaaggataatcgtgcagtacatgccgacatggattattggatcgagtccgctctgaacgacacttggaaaatagagaaggcctcattcattgaagtcaaaaattgccactgggcaaagagccataccctttggtctaacggtgtgttggagtccgaaatgatcatccctaaaaacctcgctgggccagttagtcaacacaattaccggctgggataccacacgcagattgccggcccctggcatctaggtaagctggagatggatttcgacttttgtgatggcacaaccgtgatcgtcactgaagactgcgggaaccgaggacctagcctcagaaccacaactgcgtctggcaagctgattaccgagtggtgctgtaggtcctgcacacttccacccttgcgctatcggggagaagatggatgttggtacggcatggaaataagaccgctgaaagagaaggaagagaatttagtgaactcactcgttacggccggtcacggacaggtggacaatttcagtctgggagtacttggcatggctctgtttttggaagagatgctcaggacccgcgtcggtactaaacatgcaatcctgctagtggccgtgagcttcgtcacactgattaccggcaacatgtcgtttaaggatctcgggcgagttgtggtaatggtgggagctactatggccgacgatatcggcatgggggtcacatatctggcacttttggcggccttcaaagtgcggcctacctttgctgccggactgttactccgtaagctgacgtccaaggagcttatgatgactaccattggcatcgttctgctatctcaaagcacaataccagaaaccgtgctcgagctgactgacgcattggctctgggtatgatggtcttaaaaatcgtgagaaatatggaaaagtaccagctcgccgttacaattatggcaatcctgtgcgtgcccaacgccgtcattcttcagaatgcttggaaagtatcatgtaccatcctggcggtggttagtgtgtcccctttgctcctgacatctagccagcaaaagactgactggatacccctagccctgaccattaaagggcttaacccaacggcaatcttcctcacaaccctgtccaggactaataagaaacgctcatggcctttgaacgaggctatcatggccgtcggaatggtgagcattctggccagttctttactcaagaatgatatacccatgaccggcccactggtagctggcgggcttctgacagtgtgctatgtcttgactggacggtccgcagacctcgaactggagagagccaccgatgttaagtgggaggaccaggcggaaatcagcggttcgtcaccgattctatctatcacgattagtgaggatggctccatgagcatcaaaaacgaagaggaggaacagacactgaccatacttatcaggactgggctcctggtgatttctggattgtttcctatcagcattcccatcacagctgccgcatggtacttatgggaggtgaagaaacagcgagccggcgtcctgtgggacgtgccatcaccccctccaatgggtaaggctgaactcgaggatggggcatatcgcataaaacaaaaggggattctgggctacagccagatcggcgccggggtttacaaggaaggaaccttccacactatgtggcatgtaacacggggtgcggtgcttatgcacaaaggcaagagaatcgagcccagttgggctgacgtcaaaaaggatctgattagctatgggggaggctggaaattggagggtgaatggaaggagggggaagaggtgcaggttctagccctggaacctggaaagaatccgagggcagtgcagaccaaaccaggcctctttaagacgaacactggcaccatcggggccgtctctctggacttctcccccggaacatcaggtagtcctataattgataaaaagggcaaagtggtagggctttacggaaacggcgtcgtgacccgtagcggtgcttatgtttccgccatcgcacaaacagagaagtctattgaggacaatccagaaatcgaggatgacatatttcgcaagcggagattaactattatggacctgcaccccggggctggaaaaaccaagaggtacctccctgccatcgtgcgagaagcgatcaaacggggcttgcgcacgctgattctcgccccgacaagagtcgtggcagctgagatggaagaggccctgaggggccttcccatccggtatcagactccagctattcgagcagagcataccgggagagaaatagttgatctgatgtgtcacgccacattcaccatgcgcttgctatcgcctgtgagggtccccaactacaatctgatcattatggacgaggcccatttcactgatccagctagcatcgcggcacgtggatatatctcaacccgggtggaaatgggtgaggccgctggcatttttatgacagccacgcctcccgggtccagagacccattcccgcagagtaacgcacctataatcgatgaggaaagggagattcccgaacgctcttggaatagcggacacgagtgggtaactgactttaagggcaaaaccgtgtggttcgttccatccatcaaggccggtaacgatattgctgcgtgcctccgaaagaatgggaaaaaggtcatccaattatcaagaaaaacatttgactctgaatacgtgaagacccggactaacgattgggacttcgtggtcacaaccgatataagcgagatgggagccaattttaaagcagagagggtaatcgacccccgccgttgtatgaagcctgtgattctgacggacggcgaagagagagttatccttgctggcccaatgcccgtgactcatagttccgccgcacagcggagggggcgcattggacgaaaccctaaaaatgaaaacgatcagtacatctatatgggtgagccgctggaaaatgacgaggattgcgcccactggaaggaggctaagatgctcttggacaacataaatacaccagaaggcattatccccagcatgttcgagcctgaaagagagaaagtcgatgccattgacggggaataccggctgaggggagaggcgcgcaagacctttgtggatctcatgagaaggggcgacctgcccgtttggcttgcatataaagtggccgctgagggtatcaactacgccgatcggcgttggtgtttcgacgggataaagaacaatcagatcctagaagagaacgtcgaagtggagatttggaccaaagagggcgaacgcaagaagctgaaaccacgatggttggatgctagaatctattctgaccctttagcactgaaggagtttaaagagttcgccgctggaaggaagtcactcactctgaatcttattacagagatgggccggctgcccaccttcatgacacagaaaactcgcgatgccctcgacaacttggcagtactgcacacggcggaagccgggggcagagcttacaatcatgccctatccgagctgccagagaccctcgaaacacttctgttattgactctgctcgcaaccgtgacaggtggcatctttctgttccttatgagtgggaggggaataggcaagatgaccctgggtatgtgctgcattatcactgctagcatcctcttgtggtatgcccagattcagcctcactggatcgcagcctcgataattctggagtttttcttaatcgttctactgattccggaacccgagaagcagcggacgccacaagacaaccagctcacctacgtcgtgatcgctatacttacagtggtcgcggccactatggcaaatgaaatggggtttctggagaaaaccaagaaagatttcggcttgggatctatcgctacacagcagcctgagtccaacattctggacatcgatctccgacccgccagcgcctggaccctgtacgcagttgctactacatttgtgacgccaatgcttagacattcaattgaaaatagttctgtaaacgtgtccctcaccgccatcgcgaatcaagctactgtcctgatgggcttggggaagggatggcctctgagcaaaatggacattggtgtgcccttactagccatcggctgttattcacaggttaacccgataacactgaccgcagccctccttctgttggtggctcactacgcaattatcgggccaggactgcaggccaaggcgacccgcgaggctcagaagagggccgcagccggcatcatgaaaaatcctacagtcgatggtattactgtaatagacctcgatcccatcccatatgaccccaagttcgaaaaacaactgggacaggtgatgcttttaattctgtgcgttacacaggtgctcatgatgcggaccacatgggctttgtgtgaggccctgactctagcaaccggccctatcagtacactgtgggaaggaaacccgggccgtttttggaataccactattgctgtcagcatggccaacatcttcagagggtcctacctcgcgggagccggccttctgttttctataatgaagaatacgacaaacaccaggcgcggtactgggaacatcggagagaccttgggcgagaaatggaaaagccggctgaatgcactcggtaagtccgagttccaaatttataagaagtcaggcatccaggaggtggatcgaacactggctaaagaagggattaagagaggagagactgaccaccatgccgtctctaggggcagtgcaaaattacgctggtttgtggagcggaacatggttacccccgaagggaaggtggtagatcttggatgcggcagaggtgggtggtcgtactattgtggaggcctgaaaaatgtgcgtgaggtcaagggtctcacaaagggcgggccaggacacgaagaacctatccccatgagcacgtacggctggaacctagttaggctgcagtccggggtggacgtcttcttcatacctccagaaaaatgcgataccttgctgtgtgacattggagagtcttcacccaatcctactgtggaggctggccggacactccgcgtacttaacctggtggaaaattggttgaacaataacacccagttttgcatcaaggttctgaatccatacatgcccagcgtgatcgagaaaatggaagccctccaacgaaagtatggtggggccttagtcagaaacccgctgtccaggaatagtactcatgagatgtactgggtgtctaacgcgagcggaaatattgtctcatccgtgaacatgataagtcggatgcttatcaaccgcttcacaatgagacacaaaaaggctacctatgaacctgacgttgatctgggcagcggcacgaggaatattgggatcgagtctgagattccaaacctagacatcataggaaagcgaatcgagaaaattaagcaggagcatgaaacctcctggcactacgatcaggaccacccctataaaacatgggcataccatggttcatatgagactaagcagaccggcagcgcctcgtctatggtaaatggggtggtccggctcctgacaaaaccttgggatgtgttgccaactgttacccaaatggctatgacagacaccactccctttggacagcagcgtgtgttcaaggaaaaggtcgatacgagaacacaggagccgaaagagggcaccaagaaactgatgaagatcactgccgaatggctctggaaagagcttggtaagaaaaagacccctcgcatgtgtacaagggaagagtttacgcggaaggtgagaagtaacgcagccctgggggctattttcaccgacgagaataaatggaagtccgcgcgcgaagccgtagaggatagcaggttttgggaattagtggacaaagagcgaaacctgcacttggaaggaaagtgcgagacttgtgtttacaatatgatgggcaaacgggagaagaagctcggcgagttcgggaaagcaaagggatcaagagctatctggtacatgtggctgggtgccaggtttctagagttcgaagcacttggctttctgaacgaggatcattggttctcccgcgaaaattctctcagcggggtcgagggagagggcctgcacaaattgggttatattctgcgtgacgtgagtaagaaagaagggggagccatgtacgctgacgatacagccggctgggacacccggataactctcgaggatcttaagaacgaagagatggtgacaaatcacatggaaggcgagcataagaaactggcggaggcaatctttaagttaacctatcaaaacaaagtcgttagagtgcagaggcccacaccacgcgggactgtaatggacattatctcccgacgggatcagagaggaagcggtcaagtgggcacctacgggctgaatacgttcaccaacatggaagcccagttgatcaggcagatggagggagaaggcgtcttcaagaatattcagcacctcacagtgactgaggaggttgctgtgcaaaactggctggcccgcgtcggtagagaacggctatctaggatggcaatatcaggggacgattgcgtggtaaaacctcttgacgatcgttttgctaacgccctgaccgctctcaatgacatgggaaagatccgaaaggatattcagcagtgggagcccagtaaaggctggaacgactggacacaggttccattctgctcccatcactttcatgaactgatcatgaaggatggccgcgtgttggtcgtgccctgtagaaatcaagacgagttaattgggcgggccaggatcagccagggagcaggttggtctctgcgcgaaactgcgtgcctcggcaaatcgtatgcccagatgtggtcacttatgtacttccacagacgggacctgaggctagctgccaacgcaatatgtagcgctgtgccttcccactgggtcccaaccagtcgaacgacatggtctatccatgccaagcacgagtggatgaccactgaggatatgctgacagtttggaatcgtgtgtggattagagaaaacccgtggatggaggacaaaacccccgtagaaagctgggaggaaatcccttatctcgggaagcgcgaggatcagtggtgcggatccttgattggcctgacttcacgggcaacctgggccaagaatatccaagcggctataaaccaggtgaggagtcttattggtaatgaggaatacacagactacatgccatctatgaaaagatttcgccgggaggaagaggaagccggggtcctgtggtga

SEQ ID NO: 14789 - RNA, 9876 nt, synthetic construct
  misc_feature 1..9876: note = derived and/or modified CDS sequence (opt3) from DENV-2__FJ205880__SS-prME
  source 1..9876: mol_type = other RNA
agcgcaggcatgatcattatgctgatacccaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacactatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagcactggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccaattaaagctgaattggttcaagaaagggtcttccattggacagatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacaatataaatttcagcccgagagtccaagcaagttggcctccgctatccagaaagcccaggaagagggcatatgtggtattagatctgtcactaggctcgagaatctgatgtggaagcaaatcacacccgaattaaaccacattctggcagagaatgaagttaaactaaccatcatgactggcgatataaaggggatcatgcaggccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaagacgcgtcttgtgacagcaagttaatgtccgctgccattaaggataatagggcagtacatgccgacatgggttattggatcgagtcagctctgaacgatacttggaaaatagagaaggccagctttattgaagtcaaaaattgccactggcctaagtctcataccctttggtccaacggggtgttggagagtgaaatgatcatccccaaaaatctcgcaggacccgttagccagcacaattaccgtcctggctaccacacgcagattgctggtccatggcatctgggcaagctagagatggacttcgatttctgtgacgggacaaccgtgatcgtcactgaagattgcggaaaccggggcccctctctgcgaaccacaactgcctccgggaagctcattaccgagtggtgctgtagatcatgcacactgccgcctcttaggtatcgcggagaggacggctgttggtacggtatggaaatacggccattgaaagagaaggaagagaatctggtgaacagtttagttacggcggggcacggacaagtggataattttagcctcggcgtactgggtatggcccttttcctggaagagatgttgaaaaccagagtcggcactaagcatgctatcctcctggtggcagtgtcgtttgtcacactaattaccgggaacatgtccttcaaagacctgggaagggttgtggtaatggtgggcgccactatggctgatgacatcgggatgggagtcacatatctcgccctgcttgcagcgtttaaggtgcgccccaccttcgccgctggcttgctgttacgaaagctcacgtctaaagagctgatgatgactaccattggtatcgttcttctgagccagtcaacaatacctgaaaccgtgctagagctcactgatgccctggcattggggatgatggtcctgaagatcgtgcggaatatggaaaaataccagttagctgttacaattatggccatcctctgcgtgcccaacgcagtcattctgcagaatgcctggaaggtaagttgtaccatccttgctgtggtttccgtgtctccactgttgctcacaagctcccaacagaaaactgactggatacctctggcgctaaccattaagggactgaaccccacggccatctttcttacaaccctctcacgtactaataaaaagagaagctggccactgaacgaggcaatcatggctgtcggcatggtgagtattttggcctcttccctgttaaagaatgacataccgatgaccggccctctcgtagccgggggactgcttacagtgtgctatgtcctgactggtaggagcgctgatttggaactcgagcgcgcaaccgacgttaaatgggaggatcaggccgaaatctcgggctcatctcccattctgagtatcacgatttccgaggacgggagcatgtctatcaagaacgaagaggaggaacagacactaaccatactgatccggactggacttctcgtgattagcggcctgttcccaatctccattcccatcacagcggctgcctggtacttgtgggaggtgaaaaagcaaagagccggtgtcttatgggatgtgccttcaccaccccctatggggaaagccgaactggaggacggagcttataggataaagcagaagggcattctcggctacagtcagatcggggcaggagtttacaaagaaggtacctttcacactatgtggcatgtaacacgaggcgccgtgctgatgcacaaggggaaacgcatcgagccgagctgggcggatgtcaagaaagaccttatttcttatggaggcggttggaagctggagggggaatggaaggagggagaagaggtgcaggttttggctctagaaccaggcaaaaatccccgggccgtgcaaaccaagcctggcctgttcaaaacgaacactgggaccatcggagcagtctccctcgatttttcaccaggtacaagtggcagccccataattgacaagaaagggaaggtggtaggactgtacggcaacggtgtcgtgaccagatccggggcctatgtttctgctatcgcccagacagagaagtcgattgaggataatcctgaaatcgaggacgatatattcaggaaacgtcgccttactattatggacttacacccgggagcaggcaagaccaaacggtacctgcccgctatcgtgagagaagccatcaagaggggcctccgaacgttgattctggcgccaacacgggtcgtggccgcagagatggaagaggctctccgcgggctgcctatcagatatcagactcccgccattagggctgagcataccggacgggaaatagttgaccttatgtgtcacgcaacatttaccatgcgactgttgagcccagtgagagtccctaactacaatctaatcattatggatgaggcccatttcactgaccccgcctcaatcgctgcgcgcggttatatctccaccagggtggaaatgggcgaggcagccgggattttcatgacagctacgccaccgggaagtcgtgatccttttccccaatctaacgccccaataatcgacgaggaacgggagattcccgaaagaagctggaactccggccacgagtgggtaactgatttcaaaggtaagaccgtgtggtttgttccttcaatcaaggcagggaacgacattgccgcttgcctgaggaaaaatggaaagaaagtcatccagctctctcgcaagacattcgatagcgaatacgtgaaaacccgaactaacgactgggattttgtggtcacaaccgacataagtgagatgggcgcgaatttcaaggccgagagagtaatcgatccacggaggtgtatgaaacccgtgattttaacggacggcgaagaacgcgttatcctggcagggcctatgccggtgactcattccagcgctgcccagcgtagaggacggattggtaggaacccaaagaatgaaaacgaccagtacatctatatgggcgagccccttgaaaatgatgaggactgcgcacactggaaggaggccaaaatgctgctcgataacataaatacacctgaagggattatcccctctatgtttgagccagaacgcgagaaggtcgacgctattgatggagaataccgattgagaggcgaggcccggaaaaccttcgtggacctgatgaggcgcggtgatctccctgtttggctggcgtataaggtggcagccgaggggatcaactacgctgacagaaggtggtgttttgatggcatcaaaaacaatcaaatccttgaagagaacgtcgaagtggagatttggaccaaggagggagaacggaagaaactaaagccccgttggctggacgcccgcatctattcagatccattggctttaaaagagttcaaggaatttgcagccggccgaaaatccctgactctcaatctgattacagagatggggagacttcctaccttcatgacacagaagactagggacgctctggataacctcgccgtattgcacacggcagaagcgggaggtcgggcctacaatcatgctctgagtgagctaccggagaccctggaaacactccttctgttaactttgctggccaccgtgacaggcgggatcttcctctttctgatgagcggacgcggcataggtaagatgacccttgggatgtgctgcattatcactgcatcgatcctgctctggtatgctcagattcagccccactggatcgccgcatctataattttggagttctttctgatcgttttactaattccagaacctgagaaacaaagaacgccccaggacaaccagctgacctacgtcgtgatcgccatactcacagtggtcgctgcgactatggccaatgaaatgggcttccttgagaagaccaaaaaggacctgggattgggctccatcgcaacacagcaaccagagagcaacattctggatatcgacctcaggcctgcttcagcctggaccctgtacgccgttgcaactacatttgtgacgcccatgcttcggcatagtattgaaaattcttccgtaaacgtgagcctcaccgctatcgccaatcaggcgactgtcctgatggggttgggaaaaggttggccgctgtcaaagatggatattggcgtgccattactagctatcgggtgttatagtcaggttaaccctataacactgaccgccgcactccttctgttggtggcccactacgctattatcggacccggcctgcaggcaaaggccacccgagaggcgcagaaaagagctgccgcaggtatcatgaagaatccaacagtcgacgggattactgtaatagatctcgaccccatcccttatgatccgaaattcgaaaagcagctgggccaggtgatgcttttaattctgtgcgttacgcaagtgctcatgatgcgcaccacatgggccttgtgtgaggctctgactctagccaccggacccatcagcacactgtgggaaggcaacccagggaggttttggaataccactattgcagtctccatggctaacatcttccggggatcttacctcgccggcgcgggtcttctgtttagcataatgaaaaatacgacaaacacccgtagagggactggaaacatgggcgagaccttgggtgagaagtggaaatccaggctgaatgccctcggcaagtcagagttccagatctataagaaatctgggattcaggaggtggaccgcacactggcaaaggaaggaatcaaacggggcgagactgatcaccatgctgtcagtcgagggtcggccaagttaagatggtttgtggagaggaacatggttacccctgaaggaaaagtggtagaccttggctgcggtcgcgggggatggagctactattgtggcggtctgaagaatgtgcgggaggtcaagggcctcacaaaagggggacccggccacgaggaacctattccaatgtccacgtacgggtggaacctagttagactgcagtctggagtggatgtcttctttataccacctgaaaagtgcgacaccttgctgtgtgatataggcgagtcaagcccaaatcccactgtggaggcaggtcgtacactcagggtacttaacctggtggaaaattggttgaacaataacacccaattctgcattaaagttctgaatccgtacatgccttccgtgatcgagaagatggaagctctccagcggaaatatgggggagccttagtccgcaacccactgagtcgaaattctactcatgagatgtactgggtgagcaacgcctcaggcaatatcgtctccagtgtgaacatgattagcagaatgcttataaacaggttcacaatgcggcacaagaaggcgacctatgaacccgacgttgacctgggctctgggacgcgcaatatcggaattgagtccgagatccctaacctagatattatcggtaaaagaatagaaaagatcaaacaggagcatgaaacctcatggcactacgaccaggatcacccatataagacatgggcttaccatggcagctatgagactaaacaaaccgggtcggcatctagtatggtaaatggagtggtcaggctcctgacaaagccctgggacgtgttgccgactgttacccagatggccatgacagataccactccttttggccagcagcgagtgttcaaggaaaaagtcgacacgcggacacaagagcccaaggagggtaccaaaaagctgatgaaaattactgctgaatggctctggaaggagcttgggaaaaagaagaccccacgtatgtgtacaagagaagagtttacgcgcaaagtgaggtccaacgccgcactgggagccatcttcaccgatgagaataagtggaaaagcgctcgggaagcggtagaggactcaagattttgggaattagtggataaggagcgcaacctgcacttggaaggcaaatgcgagacttgtgtttacaatatgatgggcaagagggagaagaaactcggggagttcggaaaggccaaaggttcccgagcaatttggtacatgtggctgggcgctcggtttctagagttcgaagcccttgggtttctgaacgaggaccattggttctctagagaaaatagcctcagtggagtcgagggcgagggtctgcacaagttggggtatatcctgagggatgtgtccaaaaaggaaggaggcgcaatgtacgccgacgacacagctggctgggatacccgcattactctcgaggaccttaagaacgaagagatggtgacaaatcacatggaaggggagcataaaaagctggccgaggcgatatttaaattaacctatcagaacaaggtcgttcgtgtgcagcggcctacacccagaggaactgtaatggatatcattagcaggcgcgaccaacgaggttctggccaggtggggacctacggactgaatacgttcaccaacatggaagcacagttgatccggcagatggagggcgaaggtgtctttaaaaatatccaacacctcacagtgactgaggaggttgccgtgcagaactggctggctagagtcgggagggaacgcctatcaagaatggccattagtggagatgactgcgtggtaaagccacttgatgaccggttcgcaaacgctctgaccgccctcaatgatatgggcaagataaggaaagacatccagcagtgggagccctccaagggctggaacgattggacacaagttcctttctgcagccatcactttcatgaactgattatgaaagacgggcgtgtgttggtcgtgccatgtcgaaatcaggatgagttaatcggacgcgctagaatttctcagggtgccggctggtcgctgcgggaaactgcatgcctcgggaagtcatatgcgcagatgtggagccttatgtacttccacaggcgcgacctgagactagccgctaacgccatctgttccgcagtgccgagtcactgggtccccacctctcggacgacatggagcatacatgctaaacacgagtggatgaccactgaggacatgctgacagtttggaatagggtgtggatccgagaaaacccttggatggaggataagaccccagtagaatcctgggaggaaattccctatctcggaaagcgtgaggaccaatggtgcggctcattgatcggtctgacaagtagagccacctgggccaaaaatattcaggccgcgatcaaccaggtgcgctctcttatagggaatgaggaatacacagattacatgcctagcatgaagcggtttaggagagaggaagaggaagctggagtcctgtggtga

SEQ ID NO: 14790 - RNA, 9876 nt, synthetic construct
  misc_feature 1..9876: note = derived and/or modified CDS sequence (opt3) from DENV-2__FJ390387__SS-prME
  source 1..9876: mol_type = other RNA
agcgccggaatgatcattatgctgataccaaccgtgatggctttccacctcactactcggaacggggagcctcatatgatcgtcggcattcaggaaaagggtaaatcccttctgtttaagacggaggacggagttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctatgtgtacagggaagttcaaagtagttaaggagattgcagagacccagcacggaacaatcgtgatccgcgtccagtatgaaggcgatggttccccatgcaaagtgcccttcgagattatggacttggaaaagagatacgtcctcgggaggctgatcactgtgaacccgattgttaccgagaaagatagccctgtgaacatagaagctgagcccccatttggcgactcgtacatcattatcggagtagagcctggccaattaaagctgaattggttcaagaaagggtcttccatcggacagatgtttgaaacgaccatgcggggtgccaagcgaatggctattctaggcgatacagcctgggacttcgggtcactcggaggcgtctttacaagtataggtaaagcactgcatcaggtgttcggggccatctatggcgctgcgtttagcggagtttcctggaccatgaagattcttatcggcgtgattatcacatggatagggatgaactctcgcagcacttcattgagtgtctccctggtgctcgtaggaatcgtgaccctgtaccttggcgttatggtccaggcagatagcggttgtgtggtgtcttggaaaaataaggagctgaagtgcgggtcaggaattttcatcacggacaacgtccacacatggaccgaacaatataaatttcagcccgagagtccaagcaagttggcctccgctattcagaaagcccaggaagagggcatctgtggtataagatctgttactaggctcgagaatctgatgtggaagcaaattacacccgaattaaaccacatcctggcagagaatgaagtgaaactaaccattatgactggcgatatcaaggggataatgcaggccggaaaacggtcgctccgccctcagccaaccgagctgaagtacagctggaagacatggggcaaagctaagatgctttccacggaatcatataaccagaccttcttgatcgacgggccggagactgccgagtgccccaatacaaacagagcatggaatagtctggaagtggaggattacggatttggcgtattcaccacaaacatttggctcaaactgaaggaaaaacaagacgcgttttgtgactctaagttaatgagcgctgccatcaaggataatagggcagtccatgccgacatgggttattggattgagtccgctctgaacgatacttggaaaatcgagaaggcctcattcatagaagtgaaaaattgccactggcctaagagccataccctttggtctaacggggttttggagtccgaaatgattatccccaagaacctcgcaggacccgtgagtcagcacaattaccgtcctggctaccacacgcagatcgctggtccatggcatctgggcaagctagagatggacttcgatttttgtgacgggacaaccgtcattgtgactgaagattgcggaaaccggggccccagcctgcgaaccacaactgcctctgggaagctcatcaccgagtggtgctgtagatcctgcacactgccgcctcttaggtatcgcggagaggacggctgttggtacggtatggaaattcggccattgaaagagaaggaagagaatctggttaactcattagtgacggcggggcacggacaagtagataatttcagtctcggcgtcctgggtatggccctttttctggaagagatgttgagaaccagggtgggcactaaacatgctatactcctggtggcagtcagcttcgttacactaatcaccgggaacatgtcgtttaaggacctgggacgcgtggtagtgatggtcggcgccactatgacagatgacattgggatgggagtgacctatctcgctctgcttgccgcattcaaagttcgacccacgtttgcggccggcttgctgttacggaagctcacttccaaggagctgatgatgaccacaatcggtattgtgcttctgtctcagagcaccatccctgaaactgtcctagagctcacagatgctctggccttggggatgatggtgctgaaaatagttcgtaatatggaaaagtaccagttagcagtgaccatcatggctattctctgcgtccccaacgccgtaatcctgcagaatgcatggaaagtgtcatgtacaattcttgccgttgtgagtgtctccccactgttgctcacttctagccaacagaagaccgactggatccctctggctctaacgataaaaggactgaaccccacagcgattttccttaccactctctccagaaccaataagaaaaggtcatggccactgaacgaggccatcatggcagtgggcatggtaagcatcttggctagttctctgttaaagaatgacattccgatgacaggccctctcgtggccgggggactgcttactgtctgctatgttctgaccggtcgctccgccgatttggaactcgagcgggctacggacgtgaagtgggaggatcaggcagaaataagcggctcgtcacccatcctgtctattacaatcagtgaggacgggtccatgagcattaaaaacgaagaggaggaacagaccctaactatcctgataagaacaggacttctcgtgatctctggcctgtttccaattagcatccccattaccgccgcggcttggtacttgtgggaggtcaagaaacaaagggccggtgtgttatgggatgttccttccccaccccctatggggaaggcagaactggaggacggagcctatcgaatcaaacagaagggcatactcggctactcacagattggggctggagtatacaaggaaggtactttccacacaatgtggcatgtgacccgcggcgcagtcctgatgcacaaagggaagcggatcgagccgagttgggccgatgtgaaaaaggaccttatcagctatggaggcggttggaaactggagggggaatggaaggagggagaagaggttcaggtgttggcgctagaaccaggcaagaatcccagagctgtccaaacgaaacctggcctgtttaagactaacaccgggacaattggagccgtgtctctcgatttctccccaggtacctcaggcagtcccatcatagacaaaaaggggaaagtagtcggactgtacggcaacggtgtggttacaaggagcggggcatatgtgtccgccattgctcagactgagaagtctatcgaggataatcctgaaattgaggacgatatctttcgtaagcgccggcttaccataatggacttacacccgggagccggcaaaacgaagagatacctgcccgcaattgtcagggaagctatcaaacgaggcctccggacattgatcctggccccaactcgcgtggttgcggccgagatggaagaggcactcagagggctgcctattaggtatcagacccccgctatccgggccgagcatacaggacgagaaattgtggaccttatgtgtcacgctaccttcactatgagactgttgtcgccagtccgcgtgcctaactacaatctaataatcatggatgaggcacatttcaccgaccccgccagcattgccgctaggggttatatctcaacacgtgtagaaatgggcgaggcggcagggatctttatgacggccactccaccgggatcccgggatcctttcccccaaagtaacgctccaattatagacgaggaaagagagatccccgaaaggtcttggaatagcggccacgagtgggtgaccgattttaagggtaaaacagtttggttcgtcccttccattaaggccgggaacgacatcgcagcctgcctgcgcaagaatggcaagaaggtgattcagctctcacgaaaaacctttgattctgaatacgtgaagactagaacaaacgactgggatttcgtcgtaaccacggacatcagcgagatgggcgctaattttaaagcggagcgggtgatagatccaaggcgctgtatgaagcccgttatcttaactgacggcgaagaacgtgtgattctggccgggcctatgccggtcacacatagttccgcagctcagagacggggaaggatcggtcgcaaccccaaaaatgaaaacgaccagtacatttatatgggcgagccccttgaaaatgatgaggactgcgcccactggaaggaggcaaagatgctgctcgataacatcaatacccctgaagggataattcccagcatgttcgagccagaacgagagaaagtggacgccatcgatggagaatacagattgcggggcgaggctaggaagacctttgttgacctgatgcgcagaggtgatctccctgtgtggctggcctataaagtcgcggcagaggggattaactacgccgacaggcggtggtgtttcgatggcatcaagaacaatcaaatacttgaagagaacgtggaagtagagatctggactaaagagggagaacgtaagaagctaaaaccccgctggctggacgctcgaatttattctgatccattggccttaaaggagtttaaagagttcgctgcaggcagaaagtcactgacactcaatctgatcaccgagatggggaggcttcctacattcatgactcagaaaacgcgggacgccctggataacctcgctgtgttgcacaccgccgaagcaggaggtcgcgcgtacaatcatgccctgtccgagctaccggagacactggaaactctccttctgttaaccttgctggctacagttaccggcgggatttttctcttcctgatgagtggaagaggcatcggtaagatgactcttgggatgtgctgcataattacggccagcatcctgctctggtatgcacagatccagccccactggattgctgcctcgatcatattggagtttttcctgattgtcttactaatcccagaacctgagaagcaaaggaccccacaggacaaccagctgacatacgtggtgattgcaatcctcactgtcgttgccgctaccatggcgaatgaaatgggctttcttgagaaaacaaagaaagacctgggattgggctctatagccacccagcaaccagagtccaacatcctggatattgacctccggcctgcaagcgcttggactctgtacgccgtggccacaacgttcgtaacccccatgcttcgacattcaatcgaaaatagttctgtgaacgtctccctcactgcaattgctaatcaggccacagtgctgatggggttgggaaagggttggccgctgagcaaaatggatatcggcgttccattactagcgattgggtgttattcacaggtgaaccctatcaccctgaccgctgccctccttctgttggtcgcacactacgccataattggacccggcctgcaggctaaggcaacaagagaggcccaaaagcgcgcggctgccggtatcatgaaaaatccaactgtagacgggatcacggtgattgatctcgaccccataccttatgatccgaagtttgaaaaacagctgggccaggttatgcttttaatcctgtgcgtgacccaagtcctcatgatgaggacaacttgggcattgtgtgaggccctgaccctagctacaggacccattagtaccctgtgggaaggcaacccagggcggttctggaatactacgatcgccgtgagcatggcaaacatttttcgtggatcctacctcgctggcgccggtcttctgttctctatcatgaagaatacaaccaacactagaagggggaccggaaacatgggcgagacattgggtgagaaatggaaaagccgcctgaatgcgctcggcaaatccgaatttcagatatataagaagtcagggatccaggaggtcgaccggactctggccaaagaaggaattaagcgaggcgagaccgatcaccatgcagtgtctagagggagtgctaaattaaggtggttcgttgagcgcaacatggtgacacctgaaggaaaggtagtggaccttggctgcggtagagggggatggtcgtactattgtggcggtctgaaaaatgtcagagaggttaagggcctcacgaaagggggacccggccacgaggaacctatcccaatgagcacctacgggtggaacctagtgcgtctgcagtccggagtcgatgtgtttttcattccccctgaaaaatgcgacactttgctgtgtgatatcggcgagtcttcaccaaatcccacagtagaggccggtaggaccctccgggtgcttaacctggttgaaaattggttgaacaataacactcaattctgcataaaggtgctgaatccgtacatgcctagcgtcattgagaaaatggaagcactccagcgcaagtatgggggagctttagtgcgaaacccactgtccagaaatagtacacatgagatgtactgggtctctaacgccagcggcaatatcgtgtcatccgttaacatgatcagtaggatgcttattaaccggtttaccatgcgccacaaaaaggccacgtatgaacccgacgtagacctgggcagcgggaccagaaatataggaatcgagtctgagattcctaacctagatatcattggtaagaggatcgagaaaataaagcaggagcatgaaacatcctggcactacgaccaggatcacccatataaaacttgggcgtaccatggctcatatgagaccaagcaaacagggagcgcttcgtctatggtgaatggagtcgtgcgactcctgactaaaccctgggacgttttgccgaccgtgacacagatggcaatgaccgatactacgcctttcggccagcagcgggtctttaaggaaaaggtggacacacgtacccaagagcccaaagagggtactaagaaactgatgaagatcaccgccgaatggctctggaaagagcttgggaagaaaaagacaccaagaatgtgtacgcgcgaagagttcaccaggaaggtacggagtaacgctgccctgggagcaatttttactgatgagaataaatggaagtccgccagagaagctgtggaggacagccgcttctgggaattagttgataaagagaggaacctgcacttggaaggcaagtgcgagacatgtgtctacaatatgatgggcaaacgagagaagaagctcggggaatttggaaaagcgaagggttcacgggccatctggtacatgtggctgggcgcaagattcctagagtttgaagctcttgggttcctgaacgaggaccattggttttccagggaaaattctctcagcggagtggagggcgagggtctgcacaaattggggtatattctgcgcgatgtgagtaagaaagaaggaggcgccatgtacgcagacgacaccgccggctgggatactcgtatcacactcgaggaccttaagaacgaagagatggtcaccaatcacatggaaggggagcataagaaactggctgaggccattttcaagttaacatatcagaacaaagttgtgcgggtacagagacctactcccaggggaaccgtgatggatataatctcccgccgagaccaacggggtagcggccaggtcgggacgtacggactgaatacctttacaaacatggaagcgcagttgattagacagatggagggcgaaggtgtgttcaagaatatccaacacctcactgttaccgaggaggtggcagtcaaaaactggctggccagggtggggcgcgaaagactatctcggatggctatctcaggagatgactgcgtagttaagccacttgatgacaggttcgccaacgcactgacagctctcaatgatatgggcaagattcgtaaagacatacagcagtgggagcccagtaagggctggaacgattggactcaggtgcctttttgctcccatcacttccatgaactgatcatgaaagacgggcgagtcttggtggtgccatgtcgcaatcaagatgagttagtcggtagagcccggattagccagggagctggctggtctctgagggaaaccgcctgcctcgggaagtcgtatgcacagatgtggtcacttatgtactttcaccgcagagacctgcggctagcggccaacgctatctgtagcgccgttccgtcccactgggtgcccacgagtaggacaacctggtctattcatgcaaaacacgagtggatgactacagaggacatgctgaccgtatggaatcgagtgtggatccgtgaaaacccttggatggaggataagactccagtcgaaagctgggaggaaataccctatctcggaaagagagaggaccagtggtgcggctccttgatcggtctgacctcacgcgctacatgggccaaaaatattcaagcagccatcaaccaggtgcggagtcttattgggaatgaggaatacacggattacatgccttctatgaagaggttcagacgcgaggaagaggaagcgggagttctgtggtga

SEQ ID NO: 14791 - RNA, 9876 nt, synthetic construct
  misc_feature 1..9876: note = derived and/or modified CDS sequence (opt3) from DENV-2__FJ024461__SS-prME
  source 1..9876: mol_type = other RNA
agcgccggcatgatcattatgctgatacccaccgtgatggctttccacctcacaactagaaacggggagcctcatatgatcgtcggaattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagagcaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaagcttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggaaaaaagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttactagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactgccgagtgccccaatacaaacagagcatggaatagtctggaagtggaggattacggatttggcgtgttcaccacaaacatctggctcaagctgaaagaaaagcaggacgcgttttgtgactctaagttaatgagcgctgccattaaagataatagggcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcaacacaattaccgtctgggctaccacacgcagattgctggtccttggcatctaggcaagctggagatggacttcgatttttgtgacgggacaaccgtgatcgtcactgaagattgcggaaaccggggcccaagcctccgaaccacaactgcctctgggaaactgattaccgagtggtgctgtagatcctgcacacttcccccgttgaggtatcgcggagaggacggctgttggtacggtatggaaatacggcctctgaaggagaaagaagagaatttagtgaactcactcgttacggcggggcacggacaggtggataatttcagtctgggcgtacttggtatggccctgtttttggaagagatgctcagaaccagggtcggcactaagcatgctatcctgctagtggcagtgagcttcgtcacactgattaccgggaacatgtcgtttaaagacctcggacgcgttgtggtaatggtgggcgccactatggctgatgacatcgggatgggagtcacatatctggcccttttggcagcgttcaaggtgcgaccaacctttgccgctggcctgttactccggaagctgacgtccaaagagcttatgatgactaccattggtatcgttctgctatctcaaagcacaatacccgaaaccgtgctcgagctgactgatgccttggcactggggatgatggtcttaaagatcgtgcgtaatatggaaaaataccagctcgctgttacaattatggccatcctgtgcgtgcctaacgcagtcattcttcagaatgcctggaaggtatcatgtaccatcctggctgtggttagtgtgtcccccttgctcctgacatctagccagcaaaaaactgactggataccactagcgctgaccattaagggacttaaccctacggccatcttcctcacaaccctgtccagaactaataaaaagaggtcatggcccttgaacgaggcaatcatggctgtcggcatggtgagcattctggccagttctttactcaagaatgacataccaatgaccggcccgctggtagccgggggacttctgacagtgtgctatgtcttgactggtcgctccgctgatctcgaactggagcgggcaaccgacgttaaatgggaggatcaggccgaaatcagcggctcgtcacctattctatctatcacgattagtgaggacgggtccatgagcatcaagaacgaagaggaggaacagacactgaccatacttatcagaactggactcctggtgatttctggcttgtttcccatcagcattccaatcacagcggctgcctggtacttatgggaggtgaaaaagcagagggcaggtgtcctgtgggatgtgccctcccctccacccatggggaaagccgaactcgaggacggagcttatcgaataaagcaaaagggcattctgggctactcacagatcggggcaggagtttacaaagaaggtaccttccacactatgtggcatgtaacacgcggcgccgtgcttatgcacaaggggaaacggatcgagcctagttgggcggatgtcaagaaagacctgattagctatggaggcggttggaagttggagggggaatggaaggagggagaagaggtgcaggttctagctctggaaccgggcaaaaatccaagagccgtgcagaccaagcccggcctctttaaaacgaacactgggaccatcggagcagtctctctggatttctcccctggtacatcaggcagtccaataattgacaagaaagggaaggtggtaggactttacggcaacggtgtcgtgaccaggagcggggcctatgtttccgctatcgcccaaacagagaagggaattgaggataatcccgaaatcgaggacgatatatttcgtaaacgccggttaactattatggacctgcaccctggcgcaggcaagaccaaaagatacctcccggctatcgtgagggaagccatcaagcgagggttgcggacgctgattctcgcgcccacacgcgtcgtggccgcagagatggaagaggctctgagaggacttccaatcaggtatcagactcctgccattcgggctgagcataccggtcgagaaatagttgacctgatgtgtcacgcaacattcaccatgagattgctatctcccgtgcgcgtcccaaactacaatctgatcattatggatgaggcccatttcactgaccctgcctcgatcgctgcgaggggctatatcagcacccgtgtggaaatgggggaggcagccggaatttttatgacagctacgcccccaggctcacgggatccgttccctcagtccaacgcccccataatcgacgaggaaagagagattccagaaaggagttggaattctggtcacgagtgggtaactgattttaaagggaagaccgtgtggttcgttcccagcatcaaggcaggaaacgacattgccgcttgcctccgcaaaaatggcaagaaagtcatccaattatcccgaaagacatttgattcagaatacgtgaaaaccagaactaacgactgggatttcgtggtcacaaccgacatatctgagatgggcgcgaattttaaggccgagcgggtaatcgatcctaggcgctgtatgaaaccagtgattctgacggacggggaagagcgtgttatccttgcaggacccatgcctgtgactcatagcagtgctgcccagagacggggtaggattggccgcaacccgaagaatgaaaacgaccagtacatctatatgggggagccactggaaaatgatgaggactgcgcacactggaaggaggccaaaatgctcttggataacataaatacacccgaaggaattatcccttccatgttcgagcccgaacgagagaaggtcgacgctattgatggcgaatacagactgcggggtgaggccaggaaaacctttgtggacctcatgcgcagaggggatctgccagtttggcttgcgtataaggtggcagccgagggcatcaactacgctgacaggcggtggtgtttcgatggaataaaaaacaatcagatcctagaagagaacgtcgaagtggagatttggaccaaggagggcgaacgtaagaaactgaagcctcgctggttggacgcccgaatctatagcgatcccttagctctgaaagagtttaaggaattcgcagccgggagaaaatctctcactctgaatcttattacagagatgggaaggctgccaaccttcatgacacaaaagactcgggacgctctcgataacttggccgtactgcacacggcagaagcgggtggccgcgcctacaatcatgctctatcagagctgcctgagaccctcgaaacacttctgttattgactctgctcgccaccgtgacagggggaatctttctgttccttatgtccggcagaggtatagggaagatgaccctgggcatgtgctgcattatcactgcaagtatcctcttgtggtatgctcagattcagccgcactggatcgccgcaagcataattctggagtttttcttaatcgttctactgattcccgaaccagagaaacagaggacgcctcaagacaaccagctcacctacgtcgtgatcgccatacttacagtggtcgctgcgactatggccaatgaaatgggatttctggagaagaccaaaaaggacttcggcttggggtcgatcgcaacacagcagcccgagtctaacattctggatatcgacctccggccagcttccgcctggaccctgtacgccgttgcaactacatttgtgacgcctatgcttcgacatagcattgaaaattcaagtgtaaacgtgtctctcaccgctatcgccaatcaagcgactgtcctgatgggattgggtaaaggctggcccctgtccaagatggatattggggtgccgttactagctatcggatgttatagccaggttaacccaataacactgaccgccgcactccttctgttggtggcccactacgctattatcggccctggtctgcaggcaaaggccaccagagaggcgcagaaacgcgctgccgcagggatcatgaagaatcccacagtcgacggcattactgtaatagatctcgacccaatcccctatgatcctaaattcgaaaagcaactgggacaggtgatgcttttaattctgtgcgttacgcaggtgctcatgatgaggaccacatgggccttgtgtgaggctctgactctagccaccggcccgatctcaacactgtgggaagggaaccccggacggttttggaataccactattgcagtcagtatggctaacatcttccgtggcagctacctcgccggtgcggggcttctgttttccataatgaaaaatacgacaaacaccagaaggggaactggcaacatcggtgagaccttgggcgagaagtggaaatctcgcctgaatgccctcgggaagagcgaattccaaatttataagaaatccggaatccaggaggtggaccggacactggcaaaggaaggcattaaacgaggggagactgatcaccatgctgtctcaagaggatctgccaagttaaggtggtttgtggagcgcaacatggttaccccagaaggcaaagtggtagaccttggttgcgggcggggaggctggagttactattgtggtggcctgaagaatgtgagagaggtcaaggggctcacaaaaggaggccctgggcacgaagagcccatccctatgtcgacgtacggatggaacctagttcgtctgcagagcggcgtggatgtcttcttcataccacccgaaaagtgcgacaccttgctgtgtgatattggtgagtcctctcctaatccaactgtggaggcagggaggacactccgggtacttaacctggtggaaaattggttgaacaataacacccagttttgcatcaaagttctgaatccctacatgccgtcagtgatcgagaagatggaagctctccaacgcaaatatggaggcgccttagtccgaaaccctctgagcagaaattccactcatgagatgtactgggtgagtaacgcctctggcaatattgtcagctcagtgaacatgatatccaggatgcttatcaaccggttcacaatgcgccacaagaaggcgacctatgaaccagacgttgacctggggagtggaacgagaaatattggtatcgagagcgagattcccaacctagatatcataggcaaaaggatcgaaaagattaaacaggagcatgaaacctcttggcactacgaccaggatcacccttataagacatgggcttaccatgggtcctatgagactaaacagaccggatcagcaagctcgatggtaaatggcgtggtccgactcctgacaaagccatgggacgtgttgcccactgttacccaaatggccatgacagataccactccgtttggtcagcagcgggtgttcaaggaaaaagtcgacacgcgtacacaggagcctaaggaggggaccaaaaagctgatgaaaatcactgctgaatggctctggaaggagcttggaaaaaagaagacccccagaatgtgtacacgcgaagagtttacgaggaaagtgcggtctaacgccgcactgggcgccattttcaccgatgagaataagtggaaaagtgctagagaagcggtagaggactcccgcttttgggaattagtggataaggagaggaacctgcacttggaaggcaaatgcgagacttgtgtttacaatatgatggggaagcgagagaagaaactcggagaattcggtaaggccaaaggcagccgggcaatctggtacatgtggctgggggctagatttctagagttcgaagcccttggatttctgaacgaggaccattggttctcaagggaaaattccctctctggcgtcgagggtgaggggctgcacaagttgggatatattctgcgcgatgtgagcaaaaaggaaggcggcgcaatgtacgccgacgacacagctgggtgggatacccgtataactctcgaggaccttaagaacgaagagatggtgacaaatcacatggaaggagagcataaaaagctggccgaggcgatctttaaattaacctatcaaaacaaggtcgttcgggtgcagagaccaacacctaggggtactgtaatggatattatcagtcgccgagaccagcggggctccgggcaagtgggaacctacggcctgaatacgttcaccaacatggaagcacagttgatcagacagatggagggtgaaggggtcttcaaaaatattcagcacctcacagtgactgaggaggttgccgtgcaaaactggctggctagggtcggacgcgaaagactaagccggatggccatatctggcgatgactgcgtggtaaagccccttgatgacaggtttgcaaacgctctgaccgccctcaatgatatgggcaagatccgtaaagacattcagcagtgggagccatcaaaggggtggaacgattggacacaggttcccttctgcagtcatcactttcatgaactgatcatgaaagacggacgagtgttggtcgtgccttgtcgcaatcaagatgagttaattggtagagctcggatctcccagggcgccgggtggagcctgagggaaactgcatgcctcggaaagtcttatgcgcagatgtggtcgcttatgtacttccaccgcagagacctgcggctagccgctaacgccatatgttcagcagtgccaagccactgggtcccgacctccaggacgacatggagtatccatgctaaacacgagtggatgaccactgaggacatgctgacagtttggaatcgagtgtggattcgtgaaaacccctggatggaggataagacccctgtagaatcttgggaggaaatcccatatctcggcaagagagaggaccagtggtgcggtagcttgattgggctgacttcccgcgccacctgggcaaaaaatatccaagccgcgataaaccaggtgcggtcacttattggaaatgaggaatacacagattacatgcccagtatgaagaggtttagacgcgaggaagaggaagctggcgtcctgtggtga

SEQ ID NO: 14792 - RNA, 9876 nt, synthetic construct
  misc_feature 1..9876: note = derived and/or modified CDS sequence (opt3) from DENV-2__FJ373299__SS-prME
  source 1..9876: mol_type = other RNA
agcgcaggaatgatcattatgctgatacccaccgtgatggctttccacctcactactagaaacggggagcctcatatgatcgtcggcattcaggaaaagggtaaatcccttctgtttaagacggaggacggagttaatatgtgcaccttgatggcaatggatttaggggaactgtgtgaggacacaatcacttacaaatgcccattactcaggcaaaacgaaccggaggatattgactgttggtgcaattctacctcaacatgggtgacctatggaacttgtacaaccacgggagagcaccggcgcgaaaagcgaagtgtagccctggtgccccatgtcggtatggggcttgagactcgtaccgaaacatggatgagctccgagggggcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaggaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccaattaaagctgaattggttcaagaaagggtcttccattggacagatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacaatataaatttcagcccgagagtccaagcaagttggcctccgctatccagaaagcccaggaagagggcatatgtggtattagatctgtcactaggctcgagaatctgatgtggaagcaaatcacacccgaattaaaccacattctggcagagaatgaagttaaactaaccatcatgactggcgatataaaggggatcatgcaggccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaagacgcgttttgtgactctaggttaatgagcgctgccattaaggataatcgtgcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcagcacaattaccggcctggctaccacacgcagattgctggtccatggcatctgggcaaactagagatggacttcgatttttgtgacgggacaaccgtgatcgtcactgaagattgcggaaaccgaggccccagcctgagaaccacaactgcctctgggaagctcattaccgagtggtgctgtaggtcctgcacactgccgcctcttcgctatcggggagaggacggctgttggtacggtatggaaataagaccattgaaggagaaagaagagaatctggtgaactcattagttacggcggggcacggacaagtggataatttcagtctcggcgtactgggtatggccctttttctggaagagatgttgaggacccgcgtcggcactaagcatgctatcctcctggtggcagtgagcttcgtcacactaattaccgggaacatgtcgtttaaagacctgggacgagttgtggtaatggtgggcgccactatggctgatgacatcgggatgggagtcacatatctcgccctgcttgcagcgttcaaggtgcggcccacctttgccgctggcttgctgttacgtaaactcacgtccaaggagctgatgatgactaccattggtatcgttcttctgtctcagagcacaatacctgaaaccgtgctagagctcactgatgccctggcattggggatgatggtcctgaagatcgtgagaaatatggaaaaataccagttagctgttacaattatggccatcctctgcgtgcccaacgcagtcattctgcagaatgcctggaaggtatcatgtaccatccttgctgtggttagtgtgtccccactgttgctcacatctagccaacagaaaactgactggatacctctggcgctaaccattaagggactgaaccccacggccatcttccttacaaccctctccaggactaataaaaagcgctcatggccactgaacgaggcaatcatggctgtcggcatggtgagcattttggccagttctctgctcaaaaatgacataccgatgaccggccctctagtagccgggggactgcttacagtgtgctatgtcctgactggtcggtccgctgatttggaactcgagagagcaaccgacgttaagtgggaggatcaggccgaaatcagcggctcgtcacccattctgtctatcacgattagtgaggacgggtccatgagcatcaagaacgaagaggaggaacagacactaaccatactgatcaggactggacttctcgtgatttctggcctgtttccaatcagcattcccatcacagcggctgcctggtacttgtgggaggtgaaaaagcaacgagccggtgtcttatgggatgtgccttccccaccccctatggggaaagccgaactggaggacggagcttatcgcataaagcagaaaggcattctcggctactcacagatcggggcaggagtttacaaggaaggtaccttccacactatgtggcatgtaacacggggcgccgtgctgatgcacaaggggaaaagaatcgagccgagttgggcggatgtcaagaaagaccttattagctatggaggcggttggaagctggagggggaatggaaagagggagaagaggtgcaggttttggctctagaaccaggcaagaatcccagggccgtgcaaaccaagcctggcctgtttaaaacgaacactgggaccatcggagcagtctctctcgatttctccccaggtacatcaggcagtcccataattgacaagaaagggaaggtggtaggactgtacggcaacggtgtcgtgacccgtagcggggcctatgtttccgctatcgcccagacagagaaatctattgaggataatcctgaaatcgaggacgatatatttcgcaagcggagacttactattatggacttacacccgggagcaggcaagaccaaaaggtacctgcccgctatcgtgcgagaagccatcaagcggggcctccgcacgttgattctggcgccaacaagagtcgtggccgcagagatggaagaggctctcagggggctgcctatccggtatcagactcccgccattcgagctgagcataccggaagagaaatagttgaccttatgtgtcacgcaacattcaccatgcgcctgttgtcgccagtgagggtccctaactacaatctaatcattatggatgaggcccatttcactgaccccgccagcatcgctgcgcgtggttatatctcaacccgggtggaaatgggcgaggcagccgggatttttatgacagctacgccaccgggatccagagatcctttcccccaaagtaacgccccaataatcgacgaggaaagggagattcccgaacgctcttggaatagcggccacgagtgggtaactgattttaaaggtaagaccgtgtggttcgttccttccatcaaagcagggaacgacattgccgcttgcctgcgaaagaatggaaagaaagtcatccagctctcaagaaagacatttgattctgaatacgtgaaaacccggactaacgactgggatttcgtggtcacaaccgacataagcgagatgggcgcgaattttaaggccgagagggtaatcgatccacgccgttgtatgaaacccgtgattttaacggacggcgaagagagagttatcctggcagggcctatgccggtgactcatagttccgctgcccagcggaggggacgcattggtcgaaacccaaagaatgaaaacgaccagtacatctatatgggcgagccccttgaaaatgatgaggactgcgcacactggaaagaggccaagatgctgctcgataacataaatacacctgaagggattatccccagcatgttcgagccagaaagagagaaggtcgacgctattgatggagaataccggttgaggggcgaggcccgcaaaacctttgtggacctgatgagaaggggtgatctccctgtttggctggcgtataaggtggcagccgggggcatcaactacgctgaccggcgttggtgtttcgatggaatcaaaaacaatcaaatccttgaggaaaacgtcgaggtggaaatttggaccaaggagggcgagcgcaaaaagctaaagccccgatggctggacgccagaatctattctgatccattggctttaaaagaatttaaggagttcgcagccgggaggaaatcactgactctcaatctgattacagaaatgggacggcttcctaccttcatgacacagaagactcgcgacgctctggataacctcgccgtattgcacacggcagaggcgggtggcagagcctacaatcatgctctgtccgaactaccggagaccctggagacactccttctgttaactttgctggccaccgtgacagggggaatctttctcttcctgatgagtggcaggggtatagggaaaatgacccttggcatgtgctgcattatcactgcaagcatcctgctctggtatgctcagattcagccccactggatcgccgcatcgataattttggaatttttcctgatcgttttactaattccagagcctgaaaagcaacggacgccccaggacaaccagctgacctacgtcgtgatcgccatactcacagtggtcgctgcgactatggccaatgagatgggatttcttgaaaagaccaaaaaggacctgggcttggggtctatcgcaacacagcaaccagagtccaacattctggatatcgacctccgacctgctagcgcctggaccctgtacgccgttgcaactacattcgtgacgcccatgcttagacattcaattgagaatagttctgtaaacgtgtccctcaccgctatcgccaatcaggcgactgtcctgatgggattgggtaaaggctggccgctgagcaagatggatattggggtgccattactagctatcggatgttattcacaggttaaccctataacactgaccgccgcactccttctgttggtggcccactacgctattatcggccccggtctgcaggcaaaagccacccgcgaagcgcaaaagagggctgccgcagggatcatgaagaatccaacagtcgacggcattactgtaatagatctcgaccccatcccttatgatccgaaatttgagaagcagctgggacaggtgatgcttttaattctgtgcgttacgcaagtgctcatgatgcggaccacatgggccttgtgtgaagctctgactctagccaccggccccatcagtacactgtgggaggggaacccaggacgtttctggaataccactattgcagtcagcatggctaacatctttagaggctcctacctcgccggtgcggggcttctgttctctataatgaaaaatacgacaaacaccaggcgcggaactggcaacatgggtgaaaccttgggcgagaagtggaaaagccggctgaatgccctcgggaagtccgagtttcagatctataaaaagtcaggcattcaggaagtggaccgaacactggcaaaggagggcatcaaaagaggggaaactgatcaccatgctgtctctaggggaagtgccaagttacgctggttcgtggagcggaacatggttacccctgagggcaaagtggtagaccttggttgcgggagaggaggctggtcgtactattgtggtggcctgaagaatgtgcgtgaagtcaaagggctcacaaagggaggccccgggcacgaggaacctattccaatgagcacgtacggatggaacctagttaggctgcagtccggcgtggatgtctttttcataccccctgagaagtgcgacaccttgctgtgtgatataggtgaatcttcaccaaatcccactgtggaggcagggcggacactccgcgtacttaacctggtggagaattggttgaacaataacacccaattctgcattaaagttctgaatccgtacatgcctagcgtgatcgaaaagatggaggctctccagcgaaaatatggaggcgccttagtcagaaacccactgtccaggaatagtactcatgaaatgtactgggtgtctaacgccagcggcaatatcgtctcatccgtgaacatgattagtcggatgcttataaaccgctttacaatgagacacaagaaagcgacctatgagcccgacgttgacctggggagcggaacgaggaatatcggtattgaatctgagacccctaacctagatatcattggcaagcgaatcgagaagataaaacaggaacatgagacatcctggcactacgaccaggatcacccatataagacttgggcttaccatgggtcatatgaaaccaaacaaacaggaagcgcatcgtctatggtaaatggcgtggtccggctcctgactaagccctgggacgtgttgccgaccgttacacagatggccatgaccgatactacgcctttcggtcagcagcgtgtgtttaaagagaaggtcgacacaagaacccaagaacccaaggaggggactaaaaagctgatgaaaatcaccgctgagtggctctggaaggaacttggcaaaaagaaaacaccacgcatgtgtacgagggaggagttcacccggaaggtgagaagtaacgccgcactgggcgccatttttactgatgagaataagtggaaatccgctcgcgaggcggtagaagacagcaggttctgggagttagtggataaggaacgaaacctgcacttggagggcaaatgcgaaacatgtgtttacaatatgatggggaagcgggagaaaaagctcggagagtttggtaaggccaaaggctcaagagcaatctggtacatgtggctgggggctaggttcctagaatttgaggcccttggattcctgaacgaagaccattggttttcccgcgaaaattctctcagcggcgtcgaaggtgaggggctgcacaagttgggatatattctgcgtgatgtgagtaaaaaggagggcggcgcaatgtacgccgacgacaccgctgggtgggatactcggatcacactcgaagaccttaaaaacgaggaaatggtgaccaatcacatggagggagaacataagaagctggccgaggcgattttcaaattaacatatcagaacaaggtcgttagagtgcagaggcctactccccgcggtaccgtaatggatataatctcccgacgggaccaaagaggcagcggacaggtgggaacgtacggcctgaatacctttacaaacatggaggcacagttgattaggcagatggaaggtgagggggtcttcaaaaatatccaacacctcactgtgaccgaagaggttgccgtgcagaactggctggctcgcgtcggaagagagcggctatctaggatggccatctcaggcgatgactgcgtggtaaagccacttgatgaccgtttcgcaaacgctctgacagccctcaatgatatgggcaaaattcgaaaggacatacagcagtgggaacccagtaaggggtggaacgattggactcaagttcctttttgctcccatcacttccatgagctgatcatgaaagacggacgcgtgttggtcgtgccatgtagaaatcaggatgaattaattggtcgggctaggatcagccagggcgccgggtggtctctgcgcgagaccgcatgcctcggaaagtcgtatgcgcagatgtggtcacttatgtactttcacagacgggacctgaggctagccgctaacgccatttgtagcgcagtgccgtcccactgggtccccacgagtcgaacaacctggtctatccatgctaaacacgaatggatgactacagaggacatgctgaccgtttggaatcgtgtgtggataagagagaacccttggatggaagataagactccagtagagagctgggaagagatcccctatctcggcaaacgcgaagaccaatggtgcggttccttgattgggctgacctcacgggccacatgggcaaagaatatccaggtggccattaaccaggtcaggagtcttatcggaaatgaggagtacacggattacatgccttctatgaagagattccgccgggaagaggaagaggcgggcgtgctgtggtga

SEQ ID NO: 14793 - RNA, 9876 nt, synthetic construct
  misc_feature 1..9876: note = derived and/or modified CDS sequence (opt3) from DENV-2__FJ410193__SS-prME
  source 1..9876: mol_type = other RNA
agcgcaggcatgatcattatgctgatccccaccgtgatggctttccacctcaccactagaaacggggagcctcatatgatcgtcggtattcaagaaaagggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttatctgcaagcatagcatggtggatcgaggctggggtaatgggtgtggactattcggcaaaggcgggattgtcacttgcgcaatgtttacctgcaagaaaaacatggaaggaaagatagtgcagcctgagaatctcgaatacacaatcgtggtcaccccacactccggtgaggagcatgccgttggcaacgacactgggaaacacggaaaggaaattaaagtgacgccgcagtcaagtatcacagaggctgaactgaccggctatggtactgtaaccatggagtgtagccccagaacagggcttgatttcaatgaaatggtgctgttgcaaatggagaacaaggcctggctcgtccacaggcagtggtttctggacttacctctgccatggctccccggcgcagataagcaggagtctaattggatacagaaagaaacccttgtgactttcaagaaccctcatgctaaaaagcaagacgttgtggtcctgggatcccaggagggcgccatgcacacagcgttgacgggggccaccgaaattcagatgtcaagcggaaatctactgtttactggtcatctcaaatgccggctgcgtatggacaaacttcaactgaagggcatgagttactctatgtgtacagggaaattcaaggtggtaaaagagatcgcagagacccagcacggaacaatcgttattcgcgtgcagtatgaaggcgatggttccccatgcaagatccccttcgagattatggacttggagaagagatacgtcctcgggaggctgataactgtgaacccgatcgtcaccgagaaggatagccctgtgaacattgaagctgagcccccatttggcgactcgtacatcatcattggagttgagcctggccagttaaagctgaattggttcaaaaaggggtcttccataggacaaatgtttgaaacgaccatgcggggtgccaaacgaatggctatcctaggcgatacagcctgggacttcgggtcactcggaggcgtgtttacaagtattggtaaggcactgcatcaggtattcggggccatctatggcgctgcgtttagcggagtctcctggaccatgaaaattcttatcggcgtgataatcacatggattgggatgaactctcgcagcacttcattgagtgtttccctggtgctcgtcggaatcgtgaccctgtaccttggcgtaatggtgcaggcagatagcggttgtgttgtctcttggaagaataaggagctgaaatgcgggtcaggaattttcatcacggacaacgtgcacacatggaccgaacagtataagtttcaacccgagagtccaagcaaattggcctccgctatacagaaggcccaggaagagggcatttgtggtatcagatctgtgactaggctcgagaatctgatgtggaaacagattacacccgaattaaaccacatcctggcagagaatgaagtcaagctaaccataatgactggcgatatcaaagggattatgcaagccggaaagcggtcgctccgccctcagccaaccgagctgaagtacagctggaaaacatggggcaaggctaaaatgctttccacggaatcatataaccagaccttcttgatcgacgggccggagactgccgagtgccccaatacaaacagagcatggaatagtctggaagttgaggattacggatttggcgtgttcaccacaaacatttggctcaagctgaaagaaaagcaggacgcgttttgtgactctaagttaatgagcgctgccatcaaagataatagggcagtgcatgccgacatgggttattggatagagtccgctctgaacgatacttggaagattgagaaagcctcattcatcgaagtaaagaattgccactggcctaaaagccataccctttggtctaacggggtcttggagtccgaaatgatcattccaaagaacctcgcaggacccgtgagtcaacacaattaccgtcctggctaccacacgcagatcgctggtccatggcatctgggcaagctagagatggacttcgatttttgtgacgggacaaccgttattgtgactgaagattgcggaaaccggggccccagcctgcgaaccacaactgcctctgggaaactcataaccgagtggtgctgtagatcctgcacactgccgcctcttaggtatcgcggagaggacggctgttggtacggtatggaaatccggccattgaaggagaaagaagagaatctggtcaactcattagtgacggcggggcacggacaggttgataatttcagtctcggcgtgctgggtatggccctttttctggaagagatgttgagaaccagggtaggcactaagcatgctattctcctggtcgcagtgagcttcgtgacactaatcaccgggaacatgtcgtttaaagacctgggacgcgtcgttgtgatggtaggcgccactatggctgatgacattgggatgggagtgacatatctcgccctgcttgcagcgttcaaggtccgacccacctttgccgctggcttgctgttacggaagctcacgtccaaagagctgatgatgactaccatcggtatagtgcttctgtctcaaagcacaatccctgaaaccgttctagagctcactgatgccctggcattggggatgatggtgctgaagattgtccgtaatatggaaaaataccagttagctgtgacaatcatggccattctctgcgttcccaacgcagtgatcctgcagaatgcctggaaggtctcatgtaccatacttgctgtagtgagtgtttccccactgttgctcacatctagccagcagaagactgactggattcctctggcgctaaccatcaagggactgaaccccacggccatcttccttacaaccctctccagaactaataaaaagaggtcatggccactgaacgaggcaattatggctgtgggcatggtcagcatattggccagttctctgttaaagaatgacatcccgatgaccggccctctcgtggccgggggactgcttacagtatgctatgtgctgactggtcgctccgctgatttggaactcgagcgggcaaccgacgtcaaatgggaggatcaggccgaaattagcggctcgtcacccatcctgtctattacgatcagtgaggacgggtccatgagcataaagaacgaagaggaggaacagacactaaccatcctgattagaactggacttctcgttatctctggcctgtttccaattagcatccccataacagcggctgcctggtacttgtgggaggtgaaaaagcagagggccggtgtgttatgggatgtcccttccccaccccctatggggaaagccgaactggaggacggagcttatcgaattaagcaaaagggcatcctcggctactcacagatcggggcaggagtgtacaaagaaggtaccttccacactatgtggcatgttacacgcggcgccgtactgatgcacaaggggaaacggattgagccgagttgggcggatgtgaagaaagaccttatcagctatggaggcggttggaagctggagggggaatggaaggagggagaagaggtccaggtgttggctctagaaccaggcaaaaatcccagagccgttcagaccaagcctggcctgtttaaaacgaacactgggaccataggagcagtgtctctcgatttctccccaggtacatcaggcagtcccattatcgacaagaaagggaaggtcgtgggactgtacggcaacggtgtagtcaccaggagcggggcctatgtgtccgctattgcccaaacagagaagtctatcgaggataatcctgaaatagaggacgatatttttcgtaaacgccggcttactatcatggacttacacccgggagcaggcaagaccaaaagatacctgcccgctatcgttagggaagccattaagcgaggcctccggacgttgatcctggcgccaacacgcgtggtcgccgcagagatggaagaggctctcagagggctgcctattaggtatcagactcccgccatacgggctgagcataccggacgagaaatcgtggaccttatgtgtcacgcaacattcaccatgagactgttgtcgccagttcgcgtgcctaactacaatctaattatcatggatgaggcccatttcactgaccccgccagcatcgctgcgaggggttatatttcaacccgtgtcgaaatgggcgaggcagccgggatatttatgacagctacgccaccgggatcccgggatcctttcccccagagtaacgccccaatcattgacgaggaaagagagatccccgaaaggtcttggaatagcggccacgagtgggtgactgattttaaaggtaagaccgtatggttcgtgccttccattaaggcagggaacgacatcgccgcttgcctgcgcaaaaatggaaagaaagttatacaactctcacgaaagacatttgattctgaatacgtcaaaaccagaactaacgactgggatttcgtggtgacaaccgacatcagcgagatgggcgcgaattttaaggccgagcgggtcattgatccaaggcgctgtatgaaacccgtaatcttaacggacggcgaagaacgtgtgattctggcagggcctatgccggttactcatagttccgctgcccagagacggggaaggatcggtcgcaacccaaagaatgaaaacgaccagtacatatatatgggcgagccccttgaaaatgatgaggactgcgcacactggaaggaggccaaaatgctgctcgataacattaatacacctgaagggatcattcccagcatgttcgagccagaacgagagaaggtggacgctatcgatggagaatacagattgcggggcgaggccaggaaaacctttgtcgacctgatgcgcagaggtgatctccctgtgtggctggcgtataaggttgcagccgaggggataaactacgctgacaggcggtggtgtttcgatggcatcaaaaacaatcagattcttgaagagaacgtggaagtcgagatctggaccaaggagggagaacgtaagaaactaaagccccgctggctggacgcccgaatttattctgatccattggctttaaaagagtttaaggagttcgcagccggcagaaaatcactgactctcaatctgatcacagagatggggaggcttcctaccttcatgacacaaaagactcgggacgctctggataacctcgccgtgttgcacacggcagaagcgggaggtcgcgcctacaatcatgctctgtccgagctaccggagaccctggaaacactccttctgttaactttgctggccaccgtaacaggcgggatatttctcttcctgatgagtggaagaggcattggtaagatgacccttgggatgtgctgcatcactacggcaagcatcctgctctggtatgctcagattcagccccactggatcgccgcatcgataattttggagtttttcctgatcgtgttactaattccagaacctgagaaacagaggacaccccaagacaaccagctgacatacgttgtcatcgccatactcactgtggtggctgcgaccatggccaatgaaatgggctttcttgagaagactaaaaaggacctgggattgggctctatcgcaacccagcagccagagtccaacattctggatatcgacctccggcctgctagcgcctggactctgtacgccgtcgcaacaacgttcgttacccccatgcttcgacattcaattgaaaatagttctgtgaacgtatccctcactgctatcgccaatcaagcgacagtgctgatggggttgggaaaaggttggccgctgagcaagatggatattggcgtcccattactagctatcgggtgttattcacaggtgaaccctataaccctgaccgccgcactccttctgttggttgcccactacgctattatcggacccggcctgcaggcaaaggccacaagagaggcgcagaaacgcgctgccgcaggtatcatgaagaatccaactgtggacgggattacggtcatagatctcgaccccatcccttatgatccgaaatttgaaaagcaactgggccaggtaatgcttttaattctgtgcgtgacccaggttctcatgatgaggacaacttgggccttgtgtgaggctctgaccctagccacaggacccatcagtaccctgtgggaaggcaacccagggcggttctggaatactacgattgcagtgagcatggctaacatctttcgtggatcctacctcgccggcgcgggtcttctgttctctataatgaaaaatacaaccaacactagaagggggaccggaaacatgggcgagacattgggtgagaagtggaaaagccgcctgaatgccctcggcaagtccgaatttcaaatctataagcggtcagggattcaggaggtcgaccgaactctggcaaaagaaggaatcaagagaggcgagaccgatcaccatgctgtgtctagggggagtgccaaattacgctggttcgtcgagcggaacatggtgacacctgaaggaaaggttgtggaccttggctgcggtagagggggatggtcgtactattgtggcggtctgaaaaatgtacgtgaggtgaagggcctcacgaaagggggacccggccacgaagaacctattccaatgagcacctacgggtggaacctagtcaggctgcagtccggagttgatgtgtttttcataccccctgaaaaatgcgacactttgctgtgtgatataggcgagtcttcaccaaatcccacagtcgaggcaggtcggaccctccgcgtgcttaacctggtagaaaattggttgaacaataacactcagttctgcattaaggtgctgaatccgtacatgcctagcgttatcgagaaaatggaagctctccaacgaaagtatgggggagccttagtgagaaacccactgtccaggaatagtacacatgagatgtactgggtctctaacgccagcggcaatatcgtgtcatccgtcaacatgattagtcggatgcttataaaccgctttaccatgagacacaaaaaggcgacgtatgaacccgacgtggacctgggcagcgggaccaggaatatcggaattgagtctgagatccctaacctagatattatcggtaagcgaatagagaaaatcaagcaggagcatgaaacatcctggcactacgaccaggatcacccatataaaacttgggcttaccatggctcatatgagaccaagcagacagggagcgcatcgtctatggttaatggagtagtgcggctcctgactaaaccctgggacgtcttgccgaccgtgacacaaatggccatgaccgatactacgcctttcggccagcagcgtgtttttaaggaaaaggtggacacaagaacccaggagcccaaagagggtactaagaaactgatgaagattaccgctgaatggctctggaaagagcttgggaagaaaaagacaccacgcatgtgtacgagggaagagttcacccggaaggtcagaagtaacgccgcactgggagccatctttactgatgagaataaatggaagtccgctcgcgaagcggtggaggacagcaggttctgggaattagtagataaagagcgaaacctgcacttggaaggcaagtgcgagacatgtgtgtacaatatgatgggcaaacgggagaagaagctcggggaatttggaaaagccaagggttcaagagcaatttggtacatgtggctgggcgctaggttcctagagtttgaagcccttgggttcctgaacgaggaccattggttttcccgcgaaaattctctcagcggagttgagggcgagggtctgcacaaattggggtatatcctgcgtgatgtcagtaagaaagaaggaggcgcaatgtacgccgacgacaccgctggctgggatactcggattacactcgaggaccttaagaacgaagagatggtgaccaatcacatggaaggggagcataagaaactggccgaggcgatattcaagttaacatatcaaaacaaagtggtcagagttcagaggcctgcaccccgcggaactgtgatggatatcatttcccgacgggaccagagaggtagcggccaagtagggacctacggactgaatacgtttaccaacatggaagcccagttgatcaggcagatggagggcgaaggtgtgttcaagaatatccagcacctcacagtcactgaggaggtggctgttcaaaactggctggcccgcgtggggagagaacggctatctaggatggcaatttcaggagatgactgcgtcgtgaaaccacttgatgaccgtttcgctaacgccctgaccgctctcaatgatatgggcaagatacgaaaggacatccagcagtgggagcccagtaaaggctggaacgattggacacaggtacctttttgctcccatcacttccatgaactgattatgaaggacgggcgcgttttggtggtcccatgtagaaatcaagatgagttaatcggacgggccaggattagccagggtgcaggctggtctctgcgcgaaactgcgtgcctcgggaaatcgtatgcccagatgtggtcacttatgtactttcacagacgggacctgaggctagctgccaacgcaatctgtagcgctgtgccgtcccactgggtgcccaccagtcgaacgacatggtctatacatgccaagcacgagtggatgaccactgaggacatgctgacagtctggaatcgtgtttggatcagagaaaacccttggatggaggataaaaccccagtggaaagctgggaggaaattccctatctcggaaagcgcgaggaccagtggtgcggctccttgatcggtctgacttcacgggcaacctgggccaagaatattcaagcggctatcaaccaggtaaggagtcttatagggaatgaggaatacacagattacatgccttctatgaaaagattccgccgggaggaagaggaagccggagtgctgtggtga

SEQ ID NO: 14794 - RNA, 9876 nt, synthetic construct
  misc_feature 1..9876: note = derived and/or modified CDS sequence (opt3) from DENV-2__FJ410195__SS-prME
  source 1..9876: mol_type = other RNA
agcgccggcatgatcattatgctgatacccaccgtgatggctttccacctcacaactagaaacggggagcctcatatgatcgtcggaattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagagcaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaagcttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggaaaaaagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttactagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactgccgagtgccccaatacaaacagagcatggaatagtctggaagtggaggattacggatttggcgtgttcaccacaaacatctggctcaagctgaaagaaaagcaggacgcgttttgtgactctaagttaatgagcgctgccattaaagataatagggcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaaactcattaccgagtggtgctgtagatcctgcacactgccgcctcttaggtatcgcggagaggacggctgttggtacggtatggaaatacggccattgaaggagaaagaagagaatctggtgaactcattagttacggcggggcacggacaggtggataatttcagtctcggcgtactgggtatggccctttttctggaagagatgttgagaaccagggtcggcactaagcatgctatcctcctggtggcagtgagcttcgtcacactaattaccgggaacatgtcgtttaaagacctgggacgcgttgtggtaatcgtgggcgccactatggctgatgacattgggatgggagtcacatatctcgccctgcttgcagcgttcaaggtgcgacccacctttgccgctggcttgctgttacggaagctcacgtccaaagagctgatgatgactaccatcggtatagttcttctgtctcaaagcacaatccctgaaaccgtgctagagctcactgatgccctggcattggggatgatggtcctgaagattgtgcgtaatatggaaaaataccagttagctgttacaatcatgaccattctctgcgtgcccaacgccgtcatcctgcagaatgcatggaaggtatcatgtacaatacttgccgtggttagtgtgtccccactgttgctcacttctagcagacagaaaaccgactggattcctctggctctaacgatcaagggactgaaccccacagcgatcttccttaccactctctccaggaccaataaaaagcgctcatggccactgaacgaggccattatggcagtcggcatggtgagcatattggctagttctctgttaaagaatgacatcccgatgacaggccctctcgtagccgggggactgcttactgtgtgctatgtcctgaccggtcggtccgccgatttggaactcgagagagctacggacgttaaatgggaggatcaagcagaaattagcggctcgtcacccatcctgtctattacaatcagtgaggacgggtccatgagcataaagaacgaagaggaggaacagaccctaactatcctgattaggacaggacttctcgtgatctctggcctgttgccaattagcatccccataaccgccgcggcttggtacttatgggaggtgaaaaagcagcgagccggtgtcctgtgggatgtgccttccccaccccctatggggaaagcagaactcgaggacggagcctatcgcattaagcagaagggcatcctgggctactcacaaatcggggctggagtttacaaagaaggtacttttcacacaatgtggcatgtaacccggggcgcagtgcttatgcacaaggggaaaagaattgagccgagttgggccgatgtcaagaaagacctgatcagctatggaggcggttggaagttggagggggaatggaaggagggagaagaggtgcaggttctagcgctggaaccaggcaaaaatcccagggctgtgcagacgaagcctggcctcttcaaaactaacaccgggacaataggagccgtctctctggatttttccccaggtacctcaggcagtcccattatcgacaagaaagggaaggtggtaggactttacggcaacggtgtcgtgacacgtagcggggcatatgtttccgccattgctcagactgagaagtctatcgaggataatcctgaaatagaggacgatattttccgcaaacggagattaaccatcatggacctgcacccgggagccggcaagacgaaaaggtacctccccgcaatcgtgcgagaagctattaagcggggcttgcgcacactgatcctcgccccaactagagtcgtggcggccgagatggaagaggcactgagggggcttcctattcggtatcaaacccccgctatacgagccgagcatacaggaagagaaatcgttgacctgatgtgtcacgctacctttactatgcgcttgctatcgccagtgagggtccctaactacaatctgattatcatggatgaggcacatttcaccgaccccgccagcatcgccgctcgtggttatatttcaacacgggtggaaatgggcgaggcggcagggatattcatgacggccactccaccgggatccagagatccttttccccagagtaacgctccaatcattgacgaggaaagggagatccccgaacgctcttggaatagcggccacgagtgggtaaccgatttcaaaggtaagacagtgtggtttgttccttccattaaggccgggaacgacatcgcagcctgcctccgaaaaaatggaaagaaagtcatacagttatcaagaaagaccttcgattctgaatacgtgaaaactcggacaaacgactgggattttgtggtcaccacggacatcagcgagatgggcgctaatttcaaggcggagagggtaattgatccacgccgttgtatgaaacccgtgatcctgactgacggcgaagagagagttattcttgccgggcctatgccggtgacacatagttccgcagctcaacggaggggacgcatcggtcgaaacccaaagaatgaaaacgaccagtacatatatatgggcgagcccctggaaaatgatgaggactgcgcccactggaaggaggcaaaaatgctcttggataacattaatacccctgaagggatcattcccagcatgtttgagccagaaagagagaaggtcgacgccatcgatggagaataccggctgaggggcgaggctcgcaaaaccttcgtggacctcatgagaaggggtgatctgcctgtttggcttgcctataaggtggcggcagaggggataaactacgccgaccggcgttggtgttttgatggcatcaaaaacaatcagattctagaagagaacgtcgaagtggagatctggactaaggagggagaacgcaagaaactgaagccccgatggttggacgctagaatttattctgatccattagccctgaaagagttcaaggaatttgctgcaggcaggaaatcactcacactgaatcttatcaccgagatggggcggctgcctacattcatgactcagaagacgcgcgacgccctcgataacttggctgtactgcacaccgccgaagcaggaggtagagcgtacaatcatgccctatccgagctgccggagacactcgaaactcttctgttattgaccctgctcgctacagtgaccggcgggatattcctgtttcttatgagtggaaggggcattggtaagatgactctggggatgtgctgcatcatcacggccagcattctcttgtggtatgcacaaatccagccccactggatagctgcctcgattatcctggagttctttttaattgttctactgatcccagaacctgagaaacagcggaccccccaggacaaccaactcacatacgtcgtgatagcaatccttactgtggtcgccgctaccatggcgaatgaaatgggcttcctggagaagacaaaaaaggacttgggactgggctctattgccacccagcagccagagtccaacatcctcgatattgacctgcgacctgcaagcgcttggactctttacgccgttgccacaacgtttgtgacccccatgctcagacattcaatcgaaaatagttctgtaaacgtgtccctgactgcaattgctaatcaggccacagtcttgatggggctgggaaaaggttggccgttaagcaagatggatatcggcgtgccactactggcgatagggtgttattcacaagttaaccctattaccctcaccgctgcccttctgttgctggtggcacactacgccatcatcggacccggcctccaggctaaggcaacacgcgaggcccagaaaagggcggctgccggtattatgaagaatccaactgtcgacgggataacggtaatcgatctggaccccattccttatgatccgaaattcgaaaagcagcttggccaagtgatgttactgatcctctgcgttacccaggtgttgatgatgcggacaacttgggcactgtgtgaggccctaaccctggctacaggacccattagtaccctctgggaaggcaacccagggcgtttttggaatactacgatcgccgtcagcatggcaaacatattcagaggatcctaccttgctggcgccggtctgttgttttctatcatgaaaaatacaaccaacactaggcgcgggaccggaaacatgggcgagacactgggtgagaagtggaaaagccggctcaatgcgctgggcaagaacgaattccagatttataagaaatccgggatccaagaggtggaccgaactttagccaaggaaggaattaaaagaggcgagaccgatcaccatgcagtctcaagggggtctgctaagcttcgctggtttgtggagcggaatatggttacacctgaaggaaaagtggtagacctgggctgcggtagagggggatggagttactattgtggcggtctcaagaacgtgcgtgaggtcaagggcctaacgaaagggggacccggccacgaagagcctatcccaatgtcgacctacgggtggaatctggttaggttgcagagcggagtggatgtcttctttataccccctgaaaagtgcgacactctgctctgtgatattggcgagtcctctccaaaccccacagtggaggccggtcggacccttcgcgtactgaatttggtggaaaactggctgaataacaatactcagttctgcatcaaagttctcaacccgtacatgccttcagtgatcgagaagatggaagcattacagcgaaaatatgggggagctctggtcagaaatccacttagcaggaactccacacatgagatgtactgggtgagtaatgcctctggcaacattgtcagctcagtgaacatgatatcccggatgctgatcaatcgcttcaccatgagacacaagaaggccacgtatgaacccgacgttgacctaggcagtgggaccaggaacattggaatcgagagcgagattcctaatctcgatatcataggtaaacgaatcgaaaagattaaacaagagcatgaaacatcttggcactacgaccaggatcacccatataagacttgggcgtaccatggctcctatgagaccaaacagacagggtcagctagctcgatggtaaacggagtggtccggctgttgactaagccctgggacgtgctgccgaccgttacacagatggcaatgaccgatactacgccttttggccaacagcgtgtgttcaaggaaaaagtcgacacaagaacccaggagcccaaggagggtactaaaaagctcatgaaaatcaccgccgaatggctttggaaggagctggggaaaaagaagacaccacgcatgtgtacgagggaagagtttacccggaaagtgagatctaatgctgccttaggagcaattttcactgatgagaacaagtggaaaagtgcccgcgaagctgtagaggactccaggttttgggaactggtggataaggagcgaaatttgcacctcgaaggcaaatgcgagacatgtgtttacaacatgatgggcaagcgggagaagaaactgggggaattcggaaaggcgaaaggtagcagagccatctggtacatgtggctaggcgcaaggtttcttgagttcgaagctctggggtttctcaatgaggaccattggttctcacgcgaaaactccctgtctggagtcgagggcgagggtttgcacaagctggggtatattctccgtgatgtgagcaaaaaggaaggaggcgccatgtacgcagacgacaccgccggctgggatactcggataacacttgaggacctgaagaatgaagagatggtgaccaaccacatggaaggggagcataaaaagttagctgaggccatctttaaactgacatatcagaataaggtcgttagagtgcaaaggcctactccccgcggaaccgtaatggatattatcagtcgacgggaccagagaggttccggccaggtggggacgtacggattgaacaccttcacaaatatggaagcgcaactcatcaggcagatggagggcgaaggtgtctttaaaaacattcagcacctgactgtgaccgaggaggttgcagtgcagaactggctagcccgcgtcgggagagaacggcttagcaggatggctatatctggagatgactgcgtggtaaagccactggatgaccgtttcgccaatgcactcacagctctgaacgatatgggcaagatccgaaaagacattcaacagtgggagccctcaaagggctggaatgattggactcaggttcctttctgcagtcatcactttcatgaattgatcatgaaagacgggcgcgtgttagtcgtgccatgtagaaaccaggatgagctgattggacgggccaggatctcccaaggtgctggctggagcctccgcgaaaccgcctgccttgggaagtcttatgcacagatgtggtcgctgatgtacttccacagacgggacctaaggctggcggccaatgctatatgttcagccgtgccgagccactgggtccccacgtcccgaacaacctggagtatccatgcaaaacacgagtggatgactacagaggacatgctcaccgtttggaaccgtgtgtggattagagaaaatccttggatggaggataagactccagtagaatcttgggaggaaatcccctatttgggaaagcgcgaggaccagtggtgcggcagcctgattggtcttacctcccgggctacatgggccaaaaacatccaggcagccataaatcaagtgaggtcactgattgggaacgaggaatacacggattacatgcctagtatgaagagatttcgccgggaggaagaggaagcgggagtcctctggtga

SEQ ID NO: 14795 - RNA, 9876 nt, synthetic construct
  misc_feature 1..9876: note = derived and/or modified CDS sequence (opt3) from DENV-2__FJ432726__SS-prME
  source 1..9876: mol_type = other RNA
agcgccggcatgataattatgctgatacccaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacacaatcacttacaaatgcccattactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaatggaaatcaaggtaacgccgcagtcaagtattacagaggctgaactgaccggctatggtactgtgaccatggagtgtagccccagaacagggcttgatttcaatgaaatggtcctgttgcaaatggagaacaaagcctggctcgtgcacaggcagtggtttctggacttacctctgccatggctccccggcgcagataagcaggagtctaattggatccagaaggaaacccttgttactttcaaaaaccctcatgctaagaaacaagacgtggtcgtgctgggatcccaggagggcgccatgcacacagcgttgacgggggccaccgaaatacagatgtcaagcggaaatctactgtttactggtcatctcaagtgccggctgcgtatggacaaacttcaactgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccagttaaagctgaattggttcaagaaagggtcttccattggacaaatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacagtataaatttcaacccgagagtccaagcaagttggcctccgctatccagaaagcccaggaagagggcatatgtggtattagatctgtcactaggctcgagaatctgatgtggaagcagatcacacccgaattaaaccacattctggcagagaatgaagttaaactaaccatcatgactggcgatatacgggggatcatgcaagccggaaagcgctcgctcagacctcagccaaccgagctgaaatacagctggaagacatggggcaaggctaaaatgctttccacggaatcatataaccagaccttcttgattgacgggccggagactgccgagtgccccaatacaaacagggcatggaatagtctggaagtggaggattacggatttggcgtgttcaccacaaacatctggctcaagctgaaagaaaagcaggacgcgttttgtgactctaaattaatgagcgctgccattaaggataatcgtgcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgctagtcaacacaattaccggcctggctaccacacgcagattgccggtccatggcatctgggcaaactagagatggacttcgatttttgtgacgggacaaccgttatcgtgactgaagattgcggaaaccgaggccccagcctgagaaccacaactgcgtctgggaagctcattaccgagtggtgctgtaggtcctgcacactgccgcctcttcgctatcggggagaggacggctgttggtacggtatggaaataagaccattgaaggagaaagaagagaatctggtcaactcattagtgacggccgggcacggacaggttgataatttcagtctcggcgtgctgggtatggctctttttctggaagagatgttgaggacccgcgtaggcactaagcatgcaatcctcctggtcgccgtgagcttcgtgacactaattaccgggaacatgtcgtttaaagacctgggacgagtcgttgtgatggtaggcgctactatggccgatgacatcgggatgggagtgacatatctcgcactgcttgcggccttcaaggtccggcccacctttgctgccggcttgctgttacgtaaactcacgtccaaggagctgatgatgactaccattggtatcgtgcttctgtctcaaagcacaatacctgaaaccgttctagagctcactgatgcactggctttggggatgatggtgctgaagatcgtcagaaatatggaaaaataccagttagccgtgacaattatggcaatcctctgcgttcccaacgccgtgattctgcagaatgcttggaaggtctcatgtaccatccttgcggtagtgagtgtttccccactgttgctcacatctagccagcagaagactgactggatacctctggccctaaccattaagggactgaaccccacggcaatcttccttacaaccctctccaggactaataaaaagcgctcatggccactgaacgaggctatcatggccgtgggcatggtcagcattttggccagttctctgctcaaaaatgacataccgatgaccggccctctagtggctgggggactgcttacagtatgctatgtgctgactggtcggtccgcagatttggaactcgagagagccaccgacgtcaagtgggaggatcaggcggaaatcagcggctcgtcacccattctgtctatcacgattagtgaggacgggtccatgagcatcaagaacgaagaggaggaacagacactaaccatactgatcaggactggacttctcgttatttctggcctgtttccaatcagcattcccatcacagctgccgcatggtacttgtgggaggtgaaaaagcagcgagccggtgtgttatgggatgtcccttccccaccccctatggggaaagctgaactggaggacggagcatatcgcataaagcaaaaaggcattctcggctactcacagatcggggccggagtgtacaaggaaggtaccttccacactatgtggcatgttacacggggcgcggtactgatgcacaaggggaaaagaatcgagccgagttgggctgatgtgaagaaagaccttattagctatggaggcggttggaagctggagggggaatggaaagagggagaagaggtccaggtgttggccctagaaccaggcaagaatcccagggcagttcagaccaagcctggcctgtttaaaacgaacactgggaccatcggagccgtgtctctcgatttctccccaggtacatcaggcagtcccataattgacaagaaagggaaggtcgtgggactgtacggcaacggtgtagtcacccgtagcggggcttatgtgtccgccatcgcacaaacagagaaatctattgaggataatcctgaaatcgaggacgatatatttcgcaagcggagacttactattatggacttacacccgggagctggcaagaccaaaaggtacctgcccgccatcgttcgagaagcgatcaagcggggcctccgcacgttgattctggccccaacaagagtggtcgcagctgagatggaagaggccctcagggggctgcctatccggtatcagactcccgctattcgagcagagcataccggaagagaaatagtggaccttatgtgtcacgccacattcaccatgcgcctgttgtcgccagttagggtgcctaactacaatctaatcattatggatgaggcccatttcactgaccccgctagcatcgcggcacgtggttatatctcaacccgggtcgaaatgggcgaggccgctgggatttttatgacagccacgccaccgggatccagagatcctttcccccagagtaacgcaccaataatcgacgaggaaagggagattcccgaacgctcttggaatagcggccacgagtgggtgactgattttaaaggtaagaccgtatggttcgtgccttccatcaaagccgggaacgacattgctgcgtgcctgcgaaagaatggaaagaaagttatccaactctcaagaaagacatttgattctgaatacgtcaaaacccggactaacgactgggatttcgtggtgacaaccgacataagcgagatgggcgccaattttaaggcagagagggtcatcgatccacgccgttgtatgaaacccgtaattttaacggacggcgaagagagagtgatcctggctgggcctatgccggttactcatagttccgccgcacagcggaggggacgcattggtcgaaacccaaagaatgaaaacgaccagtacatctatatgggcgagccccttgaaaatgatgaggactgcgcccactggaaagaggctaagatgctgctcgataacataaatacacctgaagggattatccccagcatgttcgagccagaaagagagaaggtggacgccattgatggagaataccggttgaggggcgaggcgcgcaaaacctttgtcgacctgatgagaaggggtgatctccctgtgtggctggcatataaggttgccgctgaggggatcaactacgccgaccggcgttggtgtttcgatggcatcaaaaacaatcagatccttgaagagaacgtggaagtcgagatttggaccaaggagggagaacgcaaaaagctaaagccccgatggctggacgctagaatctattctgatccattggcattaaaagagtttaaggagttcgccgctggcaggaaatcactgactctcaatctgattacagagatggggcggcttcctaccttcatgacacaaaagactcgcgacgccctggataacctcgcagtgttgcacacggcggaagccggaggtagagcttacaatcatgccctgtccgagctaccggagaccctggaaacactccttctgttaactttgctggcaaccgtaacaggcgggatctttctcttcctgatgagtggaaggggcataggtaaaatgacccttgggatgtgctgcattatcactgctagcatcctgctctggtatgcccagattcagccccactggatcgcagcctcgataattttggagtttttcctgatcgtgttactaattccagaacctgagaagcagcggacgccccaagacaaccagctgacctacgttgtcatcgctatactcacagtggtggcggccactatggcaaatgaaatgggctttcttgagaagaccaaaaaggacctgggattgggctctatcgctacacagcagccagagtccaacattctggatatcgacctccgacctgccagcgcctggaccctgtacgcagtcgctactacattcgttacgcccatgcttagacattcaattgaaaatagttctgtgaacgtatccctcaccgccatcgcgaatcaagctactgtgctgatggggttgggaaaaggttggccgctgagcaagatggatattggcgtcccattactagccatcgggtgttattcacaggtgaaccctataacactgaccgcagccctccttctgttggttgctcactacgcaattatcggacccggcctgcaggccaaagcgacccgcgaggctcagaagagggccgcagccggtatcatgaagaatccaacagtggacgggattactgtcatagatctcgaccccatcccttatgatccgaaatttgaaaagcaactgggccaggtaatgcttttaattctgtgcgtgacgcaggttctcatgatgcggaccacatgggctttgtgtgaggccctgactctagcaaccggacccatcagtacactgtgggaaggcaacccagggcgtttctggaataccactattgctgtgagcatggccaacatctttagaggatcctacctcgcgggcgccggtcttctgttctctataatgaaaaatacgacaaacaccaggcgcgggactggaaacatcggcgagaccttgggtgagaagtggaaaagccggctgaatgcactcggcaagtccgaatttcaaatttataaaaagtcagggatccaggaggtcgaccgaacactggctaaggaaggaattaaaagaggcgagactgatcaccatgccgtgtctagggggagtgcaaagttacgctggttcgtcgagcggaacatggtgacccctgaaggaaaagttgtggaccttggctgcggtagagggggatggtcgtactattgtggcggtctgaagaatgtacgtgaggtgaaaggcctcacaaaagggggacccggccacgaggaacctatcccaatgagcacgtacgggtggaacctagtcaggctgcagtccggagttgatgtgtttttcataccccctgaaaagtgcgacaccttgctgtgtgatattggcgagtcttcaccaaatcccactgtcgaggctggtcggacactccgcgtgcttaacctggtagaaaattggttgaacaataacacccagttctgcatcaaagtgctgaatccgtacatgcctagcgttatcgagaagatggaagccctccaacgaaaatatgggggagccttagtgagaaacccactgtccaggaatagtactcatgagatgtactgggtctctaacgcgagcggcaatattgtgtcatccgtcaacatgataagtcggatgcttatcaaccgctttacaatgagacacaagaaagctacctatgaacccgacgtggacctgggcagcgggacgaggaatattggaatcgagtctgagattcctaacctagatatcataggtaagcgaatcgaaaagattaaacaggagcatgaaacctcctggcactacgaccaggatcacccatataagacatgggcataccatggctcatatgagactaaacagaccgggagcgcctcgtctatggttaatggagtagtgcggctcctgacaaagccctgggacgtcttgccgactgtgacccaaatggctatgacagataccactcctttcggccagcagcgtgtttttaaagaaaaggtggacacgagaacacaggagcccaaggagggtaccaaaaagctgatgaaaatcactgccgaatggctctggaaggagcttgggaaaaagaaaaccccacgcatgtgtacaagggaagagttcacgcggaaggtcagaagtaacgcagccctgggagctatttttaccgatgagaataagtggaaatccgcgcgcgaagccgtggaggacagcaggttctgggaattagtagataaggagcgaaacctgcacttggaaggcaaatgcgagacttgtgtgtacaatatgatgggcaagcgggagaaaaagctcggggaatttggaaaggcaaaaggttcaagagctatctggtacatgtggctgggcgccaggttcctagagtttgaagcacttgggttcctgaacgaggaccattggttttcccgcgaaaattctctcagcggagttgagggcgagggtctgcacaagttggggtatattctgcgtgatgtcagtaaaaaggaaggaggcgccatgtacgctgacgacacagccggctgggatacccggataactctcgaggaccttaaaaacgaagagatggtgacaaatcacatggaaggggagcataagaagctggcggaggcaatcttcaaattaacctatcaaaacaaggtggtcagagttcagaggcctacaccccgcggaactgtgatggatattatctcccgacgggaccagagaggtagcggccaagtagggacctacggactgaatacgtttaccaacatggaagcccagttgatcaggcagatggagggcgaaggtgtgttcaaaaatattcagcacctcacagtcactgaggaggtggctgttcataactggctggcccgcgtggggagagaacggctatctaggatggcaatatcaggagatgactgcgtcgtgaagccacttgatgaccgtttcgctaacgccctgaccgctctcaatgatatgggcaaaatccgaaaggacattcaacagtgggagcccagtaagggctggaacgattggacacaggtacctttttgctcccaccatttccacgaactgatcatgaaagacgggcgcattttggttgtgccatgtagaaatcaggatgagttaatcggacgggccaggataagccaaggtgcaggctggtctctgcgcgaaactgcgtgcctcgggaagtcgtatgcccagatgtggtcacttatgtactttcacagacgggacctgaggctagctgccaacgcaatctgtagcgctgtcccgtcccattgggtgcccaccagtcgaacgacatggtctattcacgccaaacatgagtggatgaccactgaggacatgctgacagtgtggaatcgtgtctggatcagagaaaacccttggatggaggataagaccccagttgaaagctgggaggaaattccctatctcggaaaacgcgaggaccagtggtgcggctccttgatcggtctgacttcacgggcaacctgggccaagaatatacaggcggctattaaccaagtgaggagtcttatcgggaatgaggaatacacagattacatgccttctatgaagagattccgccgggaggaagaggaagccggagtactgtggtga

SEQ ID NO: 14796 - RNA, 9876 nt, synthetic construct
  misc_feature 1..9876: note = derived and/or modified CDS sequence (opt3) from DENV-2__JF730049__SS-prME
  source 1..9876: mol_type = other RNA
agcgccggaatgatcattatgctgatacccaccgtgatggctttccacctcactactcggaacggggaacctcatatgatcgtcggcattcaggaaaagggtaaatcccttctgtttaagacggaggacggagttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgtggtaggcaacgacactgggaaacacggacaggaaatcaaggtgacgccgcaatcaagtattacagaggccgaactgaccggctatggtactgtcaccatggagtgtagccccagaacagggcttgatttcaatgaaatggtgctgttgcagatggagaacaaggcttggctcgttcacaggcagtggtttctggacttacctctgccatggctccccggcgccgataagcaggagtctaattggatccaaaaggaaacccttgtgactttcaaaaaccctcatgcaaagaaacaggacgtcgtggtactgggatcccaggagggcgctatgcacacagccttgacgggggcgaccgaaatacaaatgtcaagcggaaatctactgtttactggtcatctcaagtgccggctgcgtatggacaaacttcagctgaagggcatgagttactctatgtgtacagggaagttcaaagttgtgaaggagattgccgagacccagcacggaacaatcgtcatccgcgtgcagtatgaaggcgatggttccccatgcaaaattcccttcgagatcatggacttggaaaagagatacgtcctcgggaggctgattactgtgaacccgatagttaccgagaaagatagccctgtgaacatcgaagcagagcccccatttggcgactcgtacattatcatcggagtagagcctggccaattaaagctgaattggttcaagaaagggtcttccattggacagatgtttgaaacgaccatgcggggtgctaagcgaatggccatactaggcgatacagcttgggacttcgggtcactcggaggcgtctttacaagtatcggtaaagccctgcatcaggtgttcggggcaatttatggcgccgcttttagcggagtttcctggaccatgaagatccttattggcgtgatcataacatggatcgggatgaactctcgcagcacttcattgagtgtctccctggtgctcgtaggaattgtgaccctgtaccttggcgttatggtccaggcggatagcggttgtgtggtgtcttggaaaaataaggagctgaagtgcgggtcaggaatcttcattacggacaacgtccacacatggaccgaacaatataaatttcagcccgagagtccaagcaagttggcatccgccatccagaaagctcaggaagagggcatatgtggtattagatctgttactaggctcgagaatctgatgtggaagcaaatcacacccgaattaaaccacattctgaccgagaatgaagtgaaactaactatcatgaccggcgatataaaggggatcatgcaggccggaaaacggtcgctccgccctcagccaacagagctgaagtacagctggaagacgtggggcaaagcaaagatgttctccaccgaatcatataaccagacttttcttattgacgggccggagacagccgagtgccccaataccaacagagcttggaatagtttggaagtggaggattacggattcggcgtatttacaactaacatctggctgaaactcaaggaaaaacaagacgccttctgtgactctaagctgatgagcgcagcgattaaggataatagggctgtccatgccgacatgggttattggatcgagtccgcattaaacgatacctggaaaatagagaaggcctcattcattgaagtgaaaaattgccactggcctaagagccatacgctgtggtctaacggggttcttgagtccgaaatgatcatccccaagaacttggctggacccgtgagtcagcacaattaccgtcctggctaccacacacagattgccggtccatggcatctcggcaagctggagatggactttgatttctgtgacgggaccactgtcatcgtgaccgaagattgcggaaaccggggccccagcctacgaacaactaccgcatctgggaagctgattacagagtggtgctgtagatcctgcacgctcccgcctctgaggtatcgcggagaggacggctgttggtacggtatggaaatacggccacttaaagagaaggaagagaatttggttaactcactggtgaccgctgggcacggacaagtagataattttagtttaggcgtcctcggtatggccctgttccttgaagagatgctgaaaactagagtgggcacaaagcatgcgatcttgctcgtggccgtcagctttgttaccctgattactgggaacatgtcgttcaaagacctaggaagggtggtagtgatggtcggcgctacaatggcagatgacatcgggatgggagtgacctatctggccctcctggctgcctttaaggttcgccccacgttcgcagcgggccttttgctgcgaaagttaacttccaaagagctcatgatgaccacaattggtatcgtgctgctttctcagagcaccatacctgaaactgtcctggagctaacagatgccctcgctctggggatgatggtgttgcggatcgttcgtaatatggaaaagtaccagctggccgtgaccattatggcaatcttatgcgtccccaacgctgtaattctccagaatgcctggaaagtgtcatgtacaatcctggcagttgtgagtgtctccccacttctgttgacttctagccaacagaagaccgactggatacctctcgccctgacgattaaaggactaaaccccacagctatctttctgaccactctttccagaaccaataagaaaaggtcatggccactcaacgaggcgatcatggccgtgggcatggtaagcattctggcaagttctttgctgaagaatgacataccgatgacaggccctttagtggctgggggactcctgactgtctgctatgttcttaccggtcgctccgccgatctggaattggagcgggccacggacgtgaagtgggaggatcaggctgaaatcagcggctcgtcacccattctctctatcacaattagtgaggacgggtccatgagcatcaaaaacgaagaggaggaacagaccctgactatactaatcagaacaggactgcttgtgatttctggcctcttcccaatcagcattcccatcaccgcagccgcgtggtacctgtgggaggtcaagaaacaaagggctggtgtgttgtgggatgttccttccccaccccctatggggaaggccgaattagaggacggagcatatcgaataaaacagaagggcattctgggctactcacagatcggggccggagtatacaaggaaggtacttttcacacaatgtggcatgtgacccgcggcgctgtcctcatgcacaaagggaagcggatcgagccgagttgggcagatgtgaaaaaggacctgattagctatggaggcggttggaaacttgagggggaatggaaggagggagaagaggttcaggtgctggccttggaaccaggcaagaatcccagagcggtccaaacgaaacctggcctattcaagacttctaccgggacaatcggagctgtgtccctggatttttcaccaggtaccagtggcagccccataattgacaaaaaggggaaagtagtcggactctacggcaacggtgtggttacaaggtccggggcctatgtgtctgcaatcgcccagactgagaagtcgattgaggataaccctgaaatcgaggacgatatattccgtaagcgccggctgaccattatggaccttcacccgggagctggcaaaacgaagagatacttacccgccatcgtcagggaagcaatcaaacgaggcctgcggacactcattttggctccaactcgcgtggttgccgcggagatggaagaggccctgagagggctccctatcaggtatcagacccccgcaattcgggctgagcatacaggacgagaaatagtggacctgatgtgtcacgccaccttcactatgagacttctgagcccagtccgcgtgcctaattacaacttgatcattatggatgaggctcattttaccgaccccgcatcaatcgccgccaggggttatatctccacacgtgtagaaatgggcgaggctgcggggattttcatgacggcaactccaccgggaagtcgggatccttttccccaatctaatgccccaataatcgacgaggaaagagagattcccgaaaggagctggaactccggccacgagtgggtgaccgatttcaagggtaaaacagtttggtttgtcccttcaatcaaggctgggaatgacattgccgcatgcctacgcaagaacggcaagaaggtgatccagctgtctcgaaaaaccttcgatagcgaatacgtgaagactagaacaaatgactgggattttgtcgtaaccacggacataagtgagatgggcgccaacttcaaagctgagcgggtgatcgatccaaggcgctgtatgaagcccgttattctcactgacggcgaagaacgtgtgatcttagcggggcctatgccggtcacacattccagcgccgcacagagacggggaaggattggtcgcaatcccaaaaacgaaaatgaccagtacatctatatgggcgagcccctggaaaacgatgaggactgcgctcactggaaggaggccaagatgcttctggataatataaacacccctgaagggattatcccctctatgtttgagccagaacgagagaaagtggacgcaattgatggagaatacagactccggggcgaggccaggaagaccttcgttgacttgatgcgcagaggtgatctgcctgtgtggctcgcttataaagtcgccgcggaggggatcaattacgcagacaggcggtggtgttttgatggcataaagaacaaccaaatcctggaagagaatgtggaagtagagatttggactaaagagggagaacgtaagaaacttaaaccccgctggctagacgcccgaatctattcagatccactggctttgaaggagttcaaagagttcgccgctggcagaaagtccttaacactgaacctcattaccgagatggggaggctgcctacatttatgactcagaaaacgcgggacgcacttgataatctggccgtgctccacaccgctgaagccggaggtcgcgcatacaaccatgcgttgagtgagctgccggagacactagaaactctgctccttctgaccttattggccacagttaccggcgggatcttcctgtttctcatgagcggaagaggcataggtaagatgactctggggatgtgctgcattatcacggcttcgatccttctgtggtatgcccagattcagccccactggatcgcagcttctataattctcgagttctttttgatcgtcctgttaattccagaacctgagaagcaaaggaccccacaggacaatcagctaacatacgtggtgatcgccatactgactgtcgttgcagccaccatggctaacgaaatgggcttcctcgagaaaacaaagaaagaccttggactgggctccatcgcgacccagcaaccagagagcaatattttggatatcgacctgcggcctgcctcagcatggactctctacgctgtggccacaacgtttgtaacccccatgctgcgacatagtattgaaaactcttccgtgaatgtcagccttactgccatcgcaaaccaggctacagtgctcatggggctgggaaagggttggccgttgtcaaaaatggatattggcgttccactgttagccatcgggtgttatagtcaggtgaatcctataaccctaaccgcggctctgctccttctggtcgcccactacgcaattatcggacccggcttgcaggccaaggctacaagagaggcacaaaagcgcgccgcggctggtatcatgaaaaacccaactgtagacgggattacggtgatagatctggaccccatcccttatgatccgaagttcgaaaaacagctcggccaggttatgctgcttattttatgcgtgacccaagtcctgatgatgaggacaacttgggccctctgtgaggcattgaccctggccacaggacccatcagcaccctatgggaaggcaatccagggcggttttggaacactacgattgctgtgtccatggccaatatcttccgtggatcttacctggcaggcgctggtctcctttttagcataatgaagaacacaaccaatactagaagggggaccggaaacatgggcgagacactgggtgagaaatggaagtcccgcttgaacgccctgggcaaatcagagttccagatctataagaagtctgggattcaggaggtcgaccggactctcgcgaaagaaggaatcaagcgaggcgagaccgatcaccatgccgtgagtagagggtcggcaaaactgaggtggtttgttgagcgcaatatggtgacacctgaaggaaaggtagtggacttaggctgcggtagagggggatggagctactattgtggcggtcttaaaaacgtcagagaggttaagggcctgacgaaagggggacccggccacgaagaacctattccaatgtccacctacgggtggaatctcgtgcgtctacagtctggagtcgatgtgttcttcatcccacctgaaaaatgcgacactctgttgtgtgatataggcgagtcaagcccaaaccccacagtagaggctggtaggaccctgcgggtgctcaatcttgttgaaaactggctgaataacaatactcaattttgcattaaggtgttgaacccgtacatgccttccgtcatcgagaaaatggaagccctgcagcgcaagtatgggggagcactcgtgcgaaatccattaagtagaaactctacacatgagatgtactgggtcagcaatgcttcaggcaacatcgtgtccagtgttaatatgattagcaggatgctgataaaccggttcaccatgcgccacaaaaaggccacgtatgaacccgacgtagaccttggctctgggaccagaaacatcggaattgagtccgagatccctaatctggatattatcggtaagaggatagagaaaatcaagcaggagcatgaaacatcatggcactacgaccaggatcacccatataaaacttgggcctaccatggcagctatgagaccaagcaaacagggtcggcgtctagtatggtgaacggagtcgtgcgactactcactaaaccctgggacgttctgccgaccgtgacacagatggctatgaccgatactacgccttttggccagcagcgggtcttcaaggaaaaggtggacacacgtacccaagagcccaaagagggtactaagaaattgatgaagattaccgcagaatggctgtggaaagagctcgggaagaaaaagacaccaagaatgtgtacgcgcgaagagtttaccaggaaggtacggtccaatgccgctcttggagccatcttcactgatgagaacaaatggaaaagcgcaagagaagccgtggaggactcacgcttttgggaactggttgataaagagaggaatttacacctggaaggcaagtgcgagacatgtgtctacaacatgatgggcaaacgagagaagaagttgggggagttcggaaaagctaagggttcccgggcgatttggtacatgtggctcggcgccagatttctggagttcgaagcactagggtttcttaatgaggaccattggttctctagggaaaacagcctgagtggagtggagggcgagggtctccacaaactggggtatatcttgcgcgatgtgtccaagaaagaaggaggcgctatgtacgccgacgacaccgcaggctgggatactcgtattacactggaggacctcaagaatgaagagatggtcaccaaccacatggaaggggagcataagaaacttgccgaggctatatttaagctgacatatcagaataaagttgtgcgggtacagagacctactcccaggggaaccgtgatggatatcattagccgccgagaccaacggggttctggccaggtcgggacgtacggattaaacaccttcacaaatatggaagcccagctgatcagacagatggagggcgaaggtgtgttcaagaacatccaacacttgactgttaccgaggaggtggcggtccagaattggctcgcaagggtggggcgcgaaagactgtcacggatggccattagtggagatgactgcgtagttaaaccactagatgacaggtttgctaacgcccttacagcactgaacgatatgggcaagatacgtaaggacatccagcagtgggagccctccaaaggctggaatgattggactcaagtgcctttctgcagccatcactttcatgaactcattatgaaggacgggcgagtcctggtggtgccatgtcgcaaccaggatgagttgatcggtagagctcggatttctcagggagccggctggtcgttaagggaaaccgcttgcctggggaaatcatatgcccagatgtggagcctcatgtacttccaccgcagagaccttcggctggcagcgaatgccatctgttccgctgtcccgagtcactgggttcccacgtctaggacaacctggagcatacatgccaagcacgagtggatgactacagaggacatgctaaccgtgtggaaccgagtatggatccgtgaaaatccttggatggaggataaaactccagtggaatcctgggaggaaattccctatctgggaaagagagaggaccaatggtgcggctcactcatcggtttgaccagtcgcgcaacatgggctaagaacattcaggccgcaatcaatcaggtccggtctctgatagggattgaggaatacacggattacatgcctagcatgaaaaggtttagacgcgaggaagaggaagccggagtgctttggtga

SEQ ID NO: 14797 - RNA, 9876 nt, synthetic construct
  misc_feature 1..9876: note = derived and/or modified CDS sequence (opt3) from DENV-2__FJ562098__SS-prME
  source 1..9876: mol_type = other RNA
agcgccggaatgatcattatgctgatacccaccgtgatggctttccacctcactactagaaacggggaacctcatatgatcgtaggcattcaggaaaagggtaaatcccttctgtttaagacggaggacggagttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagctaccgagaaggatagccctgtgaacatcgaagccgagcccccatttggcgactcgtacattatcatcggagttgagcctggccagttaaagctgaattggttcaaaaaggggtcttccattggacaaatgtttgaaacgaccatgcggggtgctaaacgaatggccatactaggcgatacagcatgggacttcgggtcactcggaggcgtgtttacaagtatcggtaaggccctgcatcaggtattcggggctatttatggcgcggcatttagcggagtctcctggaccatgaaaatccttattggcgtgatcataacatggatcgggatgaactctcgcagcacttcattgagtgtttccctggtgctcgtcggaattgtgaccctgtaccttggcgtaatggtgcaggccgatagcggttgtgttgtctcttggaagaataaggagctgaaatgcgggtcaggaatcttcattacggacaacgtgcacacatggaccgaacagtataagtttcaacccgagagtccaagcaaattggcttccgccatccagaaggcacaggaagagggcatatgtggtattagatctgtgactaggctcgagaatctgatgtggaaacagatcacacccgaattaaaccacattctggccgagaatgaagtcaagctaaccatcatgactggcgatataaaagggatcatgcaagctggaaagcggtcgctccgccctcagccaattgagctgaagtacagctggaaaacctggggcaaggccaaaatgctttccacagaatcacataaccagacgttcttgatcgacgggccggagaccgcagagtgccccaatactaacagagcgtggaatagtctggaagttgaggattatggatttggcgtgttcacaaccaacatttggctcaggctgaaggaaaaacaggacgctttttgtgactctaagttaatgagcgccgcaatcaaggataatcgtgccgtgcacgctgacatgggttactggatagagtccgccctgaacgatacatggaaaattgagaaggcatcattcatcgaagtcaagaattgccattggcctaagagccacactctttggtctaacggggtcttggagtccgaaatggtgatccccaagaacctcgctggacccgttagtcaacacaattatcggcctggctaccatacccagattgccggtccatggcacctgggcaagctagagatggacttcgatttttgtgacgggacgacagtgatcgtcaccgaagattgcggaaaccgaggccccagcctgagaactaccacagcgtctgggaagctcattactgagtggtgctgtaggtcctgcaccctgccgcctcttcgctaccggggagaggacggctgttggtatggtatggaaataagaccattgaaagagaaggaagagaatctggtgaactcattagttacagccgggcatggacaggtggataatttcagtctcggcgtactgggtatggctctttttctggaagagatgttgaggacgcgcgtcggcaccaaacacgcaatcctcctggtggccgtgagcttcgtcactctaattacagggaacatgtcgtttaaggacctgggacgagttgtggtaatggtgggcgctaccatggccgatgacatcgggatgggagtcacttacctcgcactgcttgcggccttcaaagtgcggcccacatttgctgccggcttgctgttacgtaagctcacctccaaggagctgatgatgacgactattggtatcgttcttctgtctcaaagcaccatacctgaaacagtgctagagctcaccgatgcactggctttggggatgatggtcctgaaaatcgtgagaaatatggaaaagtatcagttagccgttactattatggcaatcctctgcgtgcccaacgccgtcattctgcagaatgcttggaaagtatcatgtacaatccttgcggtggttagtgtgtccccactgttgctcacctctagccagcaaaagacagactggatacctctggccctaactattaaaggactgaaccccaccgcaatcttccttacgacactctccaggaccaataagaaacgctcatggccactgaacgaggctatcatggccgtcggcatggtgagcattttggccagttctctgttaaagaatgacataccgatgactggccctctcgtagctgggggactgcttaccgtgtgctacgtcctgacaggtcggtccgcagatttggaactcgagagagccactgacgttaagtgggaggatcaggcggaaatcagcggctcgtcacccattctgtctatcaccattagtgaggacgggtccatgagcatcaaaaacgaagaggaggaacagacgctaacaatactgatcaggaccggacttctcgtgatttctggcctgtttccaatcagcattcccatcactgctgccgcatggtatttgtgggaggtgaagaaacagcgagccggtgtcttatgggatgtgccttccccaccccctatggggaaggctgaactggaggacggagcataccgcataaaacaaaagggcattctcggctattcacagatcggggccggagtttacaaggaaggtacattccataccatgtggcacgtaactcggggcgcggtgctgatgcacaaagggaagagaatcgagccgagttgggctgatgtcaaaaaggaccttattagctacggaggcggttggaaactggagggggaatggaaggagggagaagaggtgcaggttttggccctagaaccaggcaagaatcccagggcagtgcagacaaaacctggcctgtttaagaccaacacggggactatcggagccgtctctctcgatttctccccaggtacctcaggcagtcccataattgacaaaaaggggaaagtggtaggactgtatggcaacggtgtcgtgacacgtagcggggcttacgtttccgccatcgcacaaaccgagaagtctattgaggataatcctgaaatcgaggacgatatatttcgcaagcggagacttacaattatggacttacatccgggagctggcaaaactaagaggtatctgcccgccatcgtgcgagaagcgatcaaacggggcctccgcaccttgattctggccccaacgagagtcgtggcagctgagatggaagaggccctcagggggctgcctatccggtaccagacacccgctattcgagcagagcacactggaagagaaatagttgaccttatgtgtcatgccaccttcacaatgcgcctgttgtcgccagtgagggtccctaactataatctaatcattatggatgaggcccacttcaccgaccccgctagcatcgcggcacgtggttacatctcaactcgggtggaaatgggcgaggccgctgggatttttatgaccgccacaccaccgggatccagagatcctttcccccagagtaacgcaccaataatcgacgaggaaagggagattcccgaacgctcttggaatagcggccatgagtgggtaacggattttaagggtaaaactgtgtggttcgttccttccatcaaggccgggaacgacattgctgcgtgcctgcgaaagaatggcaaaaaggtcatccaactctcaagaaaaacctttgattctgaatatgtgaagacacggaccaacgactgggatttcgtggtcactacagacataagcgagatgggcgccaattttaaagcagagagggtaatcgatccacgccgttgtatgaagcccgtgattttaaccgacggcgaagagagagttatcctggctgggcctatgccggtgacgcacagttccgccgcacagcggaggggacgcattggtcgaaaccccaaaaatgaaaacgaccagtacatctacatgggcgagccccttgaaaatgatgaggactgcgcccactggaaggaggctaagatgctgctcgataacataaatactcctgaagggattatccccagcatgttcgagccagaaagagagaaagtcgacgccattgatggagaatatcggttgaggggcgaggcgcgcaagacatttgtggacctgatgagaaggggtgatctccctgtttggctggcatacaaagtggccgctgaggggatcaactatgccgaccggcgttggtgtttcgatggcataaagaacaatcagatccttgaagagaacgtcgaagtggagatttggaccaaagagggagaacgcaagaagctaaaaccccgatggctggacgctagaatctactctgatccattggcattaaaggagtttaaagagttcgccgctggcaggaagtcactgaccctcaatctgattactgagatggggcggcttcctacattcatgacccagaaaactcgcgacgccctggataacctcgcagtattgcatactgcggaagccggaggtagagcttataatcacgccctgtccgagctaccggagacgctggaaaccctccttctgttaacattgctggcaactgtgaccggcgggatctttctcttcctgatgagtggaaggggcataggtaagatgacacttgggatgtgctgcattatcaccgctagcatcctgctctggtacgcccaaattcagccccattggatcgcagcctcgataattttggagtttttcctgatcgttttactaattccagaacctgagaagcagcggactccccaagacaaccagctgacgtatgtcgtgatcgctatactcaccgtggtcgcggccacaatggcaaatgaaatgggctttcttgagaaaactaagaaagacctgggattgggctctatcgctacccagcagccagagtccaacattctggatatcgacctccgacctgccagcgcctggacactgtacgcagttgctaccactttcgtgacacccatgcttagacactcaattgaaaatagttctgtaaacgtgtccctcacggccatcgcgaatcaagctaccgtcctgatggggttgggaaagggttggccgctgagcaaaatggatattggcgtgccattactagccatcgggtgttactcacaggttaaccctataactctgacagcagccctccttctgttggtggctcactatgcaattatcggacccggcctgcaggccaaggcgacccgcgaggctcagaagagggccgcagccggtatcatgaaaaatccaaccgtcgacgggattacagtaatagatctcgaccccatcccttacgatccgaagtttgaaaaacaactgggccaggtgatgcttttaattctgtgcgttactcaggtgctcatgatgcggacgacctgggctttgtgtgaggccctgacactagcaactggacccatcagtaccctgtgggaaggcaacccagggcgtttctggaatacaaccattgctgtcagcatggccaacatctttagaggatcctatctcgcgggcgccggtcttctgttctctataatgaagaatactacgaacacaaggcgcgggaccggaaacatgggcgagactttgggtgagaaatggaaaagccggctgaatgcactcggcaaatccgaatttcaaatctacaagaagtcagggattcaggaggtggaccgaaccctggctaaagaaggaatcaagagaggcgagacagatcatcacgccgtctctagggggagtgcaaaattacgctggttcgtggagcggaacatggttactcctgaaggaaaggtggtagaccttggctgcggtagagggggatggtcgtattactgtggcggtctgaaaaatgtgcgtgaggtcaagggcctcaccaaagggggacccggccatgaagaacctattccaatgagcacatatgggtggaacctagttaggctgcagtccggagtggatgtctttttcatcccacctgaaaaatgcgacacgttgctgtgtgatataggcgagtcttcaccaaatcccaccgtggaggctggtcggactctccgcgtacttaacctggtggaaaattggttgaacaataacacacagttctgcattaaggttctgaatccgtacatgcctagcgtgatcgagaaaatggaagccctccaacgaaagtacgggggagccttagtcagaaacccactgtccaggaatagtacccacgagatgtattgggtgtctaacgcgagcggcaatatcgtctcatccgtgaacatgattagtcggatgcttataaaccgctttactatgagacataaaaaggctacatacgaacccgacgttgacctgggcagcgggaccaggaatatcggaattgagtctgagatccctaacctagatattatcggtaagcgaatagagaaaatcaagcaggagcacgaaacgtcctggcactatgaccaggatcatccatacaaaacctgggcatatcacggctcatacgagacaaagcagactgggagcgcctcgtctatggtaaatggagtggtccggctcctgaccaaaccctgggacgtgttgccgacagttactcaaatggctatgaccgatacaacccctttcggccagcagcgtgtgtttaaggaaaaggtcgacactagaacgcaggagcccaaagagggtacaaagaaactgatgaagattaccgccgaatggctctggaaagagcttgggaagaaaaagactccacgcatgtgtaccagggaagagttcacacggaaggtgagaagtaacgcagccctgggagctatctttacggatgagaataaatggaagtccgcgcgcgaagccgtagaggacagcaggttctgggaattagtggataaagagcgaaacctgcatttggaaggcaagtgcgagacctgtgtttataatatgatgggcaaacgggagaagaagctcggggaatttggaaaagcaaagggttcaagagctatttggtacatgtggctgggcgccaggttcctagagtttgaagcacttgggttcctgaacgaggaccactggttttcccgcgaaaattctctcagcggagtcgagggcgagggtctgcacaaattggggtacatcctgcgtgatgtgagtaagaaagaaggaggcgccatgtatgctgacgacactgccggctgggatacacggattaccctcgaggaccttaagaacgaagagatggtgactaatcatatggaaggggagcacaagaaactggcggaggcaatattcaagttaacataccaaaacaaagtcgttagagtgcagaggcctaccccacgcggaacagtaatggatatcatttcccgacgggaccagagaggtagcggccaagtggggacttatggactgaatacctttacgaacatggaagcccagttgatcaggcagatggagggcgaaggtgtcttcaagaatatccagcatctcaccgtgacagaggaggttgctgtgcaaaactggctggcccgcgtcgggagagaacggctatctaggatggcaatttcaggagatgactgcgtggtaaaaccacttgatgaccgtttcgctaacgccctgactgctctcaatgatatgggcaagatacgaaaggacatccagcagtgggagcccagtaaaggctggaacgattggacccaggttcctttttgctcccaccatttccacgaactgattatgaaggacgggcgcgtgttggtcgtgccatgtagaaatcaagatgagttaatcggacgggccaggattagccagggtgcaggctggtctctgcgcgaaacagcgtgcctcgggaaatcgtacgcccagatgtggtcacttatgtattttcacagacgggacctgaggctagctgccaacgcaatctgtagcgctgtgccgtcccattgggtccccacaagtcgaaccacgtggtctatacacgccaagcatgagtggatgacaaccgaggacatgctgactgtttggaatcgtgtgtggatcagagaaaacccttggatggaggataaaacaccagtagaaagctgggaggaaattccctacctcggaaagcgcgaggaccagtggtgcggctccttgatcggtctgacctcacgggcaacttgggccaagaatattcaagcggctatcaaccaggtgaggagtcttatagggaatgaggaatataccgattacatgccttctatgaaaagattccgccgggaggaagaggaagccggagtcctgtggtga

SEQ ID NO: 14798 - RNA, 9876 nt, synthetic construct
  misc_feature 1..9876: note = derived and/or modified CDS sequence (opt3) from DENV-2__FJ859028__SS-prME
  source 1..9876: mol_type = other RNA
agcgcaggaatgatcattatgctgataccaaccgtgatggctttccacctcactactcggaacggggagcctcatatgatcgtcggcattcaggaaaagggtaaatcccttctgtttaagacggaggacggagttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccacatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccaattaaagctgaattggttcaagaaagggtcttccattggacagatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacaatataaatttcagcccgagagtccaagcaagttggcctccgctatccagaaagcccaggaagagggcatatgtggtattagatctgtcactaggctcgagaatctgatgtggaagcaaatcacacccgaattaaaccacattctggcagagaatgaagttaaactaaccatcatgactggcgatataaaggggatcatgcaggccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaagacgcgttttgtgactctaagttaatgagcgctgccattaagaataacagggcagtacatgccgatatgggttattggatcgagtccgctctgaatgacacttggaaaatagagaaggcctcattcattgaagtcaaaaactgccactggcctaagagccataccctttggtctaacggggtgttggagtccgaaatgatcatccccaagaatctcgcaggacccgttagtcagcacaactaccgtcctggctaccacacgcagattgctggtccatggcatctgggcaagctagagatggatttcgacttttgtgatgggacaaccgtggtcgtgactgaagactgcggaaatcggggccccagcctgcgaaccacaactgcctctgggaagctcatcaccgagtggtgctgtagatcctgcacactgccgcctcttaggtatcgcggagaggatggctgttggtacggtatggaaattcggccattgaaagagaaggaagagaacctggttaattcattagtgacggcggggcacggacaagtagacaacttcagtctcggcgtcctgggtatggccctttttctggaagagatgttgagaaccagggtgggcactaaacatgctatactcctggtggcagtcagcttcgttacactaatcaccgggaatatgtcgtttaaggatctgggacgcgtggtagtgatggtcggcgccactatggctgacgatattgggatgggagtgacatatctcgccctgcttgcagcgttcaaagttcgacccacctttgccgctggcttgctgttacggaagctcacgtccaaggagctgatgatgactaccatcggtattgtgcttctgtctcagagcacaatccctgaaaccgtcctagagctcactgacgccctggcattggggatgatggtgctgaaaatagttcgtaacatggaaaagtaccagttagctgtgacaatcatggccattctctgcgtccccaatgcagtaatcctgcagaacgcctggaaagtgtcatgtaccattcttgctgttgtgagtgtctccccactgttgctcacatctagccaacagaagactgattggatccctctggcgctaaccataaaaggactgaatcccacggccattttccttacaaccctctccagaactaacaagaaaaggtcatggccactgaatgaggcaatcatggctgtgggcatggtaagcatcttggccagttctctgttaaagaacgacattccgatgaccggccctctcgtggccgggggactgcttacagtctgctatgttctgactggtcgctccgctgacttggaactcgagcgggcaaccgatgtgaagtgggaggaccaggccgaaataagcggctcgtcacccatcctgtctattacgatcagtgaggatgggtccatgagcattaaaaatgaagaggaggaacagacactaaccatcctgataagaactggacttctcgtgatctctggcctgtttccaattagcatccccattacagcggctgcctggtacttgtgggaggtcaagaaacaaagggccggtgtgttatgggacgttccttccccaccccctatggggaaggccgaactggaggatggagcttatcgaatcaaacagaagggcatactcggctactcacagattggggcaggagtatacaaggaaggtaccttccacactatgtggcatgtgacacgcggcgccgtcctgatgcacaaagggaagcggatcgagccgagttgggcggacgtgaaaaaggatcttatcagctatggaggcggttggaaactggagggggaatggaaggagggagaagaggttcaggtgttggctctagaaccaggcaagaaccccagagccgtccaaaccaaacctggcctgtttaagacgaacactgggaccattggagcagtgtctctcgacttctccccaggtacatcaggcagtcccatcatagataaaaaggggaaagtagtcggactgtacggcaatggtgtggttaccaggagcggggcctatgtgtccgctattgcccagacagagaagtctatcgaggacaaccctgaaattgaggatgacatctttcgtaagcgccggcttactataatggatttacacccgggagcaggcaaaaccaagagatacctgcccgctattgtcagggaagccatcaaacgaggcctccggacgttgatcctggcgccaacacgcgtggttgccgcagagatggaagaggctctcagagggctgcctattaggtatcagactcccgccatccgggctgagcataccggacgagaaattgtggaccttatgtgtcacgcaacattcaccatgagactgttgtcgccagtccgcgtgcctaattacaacctaataatcatggacgaggcccatttcactgatcccgccagcattgctgcgaggggttatatctcaacccgtgtagaaatgggcgaggcagccgggatctttatgacagctacgccaccgggatcccgggaccctttcccccaaagtaatgccccaattatagatgaggaaagagagatccccgaaaggtcttggaacagcggccacgagtgggtgactgactttaagggtaaaaccgtttggttcgtcccttccattaaggcagggaatgatatcgccgcttgcctgcgcaagaacggcaagaaggtgattcagctctcacgaaaaacatttgactctgaatacgtgaagaccagaactaatgattgggacttcgtcgtaacaaccgatatcagcgagatgggcgcgaactttaaagccgagcgggtgatagacccaaggcgctgtatgaagcccgttatcttaacggatggcgaagaacgtgtgattctggcagggcctatgccggtcactcatagttccgctgcccagagacggggaaggatcggtcgcaatcccaaaaacgaaaatgaccagtacatttatatgggcgagccccttgaaaacgacgaggattgcgcacactggaaggaggccaagatgctgctcgacaatatcaacacacctgaagggataattcccagcatgttcgagccagaacgagagaaagtggatgctatcgacggagaatacagattgcggggcgaggccaggaagacctttgttgatctgatgcgcagaggtgacctccctgtgtggctggcgtataaagtcgcagccgaggggattaactacgctgataggcggtggtgtttcgacggcatcaagaataaccaaatacttgaagagaatgtggaagtagagatctggaccaaagagggagaacgtaagaagctaaaaccccgctggctggatgcccgaatttattctgacccattggctttaaaggagtttaaagagttcgcagccggcagaaagtcactgactctcaacctgatcacagagatggggaggcttcctaccttcatgacacagaaaactcgggatgctctggacaatctcgccgtgttgcacacggcagaagcgggaggtcgcgcctacaaccatgctctgtccgagctaccggagaccctggaaacactccttctgttaactttgctggccaccgttacaggcgggatttttctcttcctgatgagtggaagaggcatcggtaagatgacccttgggatgtgctgcataattactgcaagcatcctgctctggtatgctcagatccagccccactggattgccgcatcgatcatattggagtttttcctgattgtcttactaatcccagaacctgagaagcaaaggacgccccaggataatcagctgacctacgtggtgattgccatcctcacagtcgttgctgcgactatggccaacgaaatgggctttcttgagaaaaccaagaaagacctgggattgggctctatagcaacacagcaaccagagtccaatatcctggacattgatctccggcctgctagcgcctggaccctgtacgccgtggcaactacattcgtaacgcccatgcttcgacattcaatcgaaaacagttctgtgaatgtctccctcaccgctattgccaaccaggcgactgtgctgatggggttgggaaagggttggccgctgagcaaaatggacatcggcgttccattactagctattgggtgttattcacaggtgaatcctatcacactgaccgccgcactccttctgttggtcgcccactacgctataattggacccggcctgcaggcaaaggccaccagagaggcgcaaaagcgcgctgccgcaggtatcatgaaaaacccaacagtagatgggatcactgtgattgacctcgatcccataccttatgacccgaagtttgaaaaacagctgggccaggttatgcttttaatcctgtgcgtgacgcaagtcctcatgatgaggaccacatgggccttgtgtgaggctctgactctagccaccggacccattagtacactgtgggaaggcaatccagggcggttctggaacaccactatcgcagtgagcatggctaatatttttcgtggatcctacctcgccggcgcgggtcttctgttctctatcatgaagaacacgacaaacaccagaagggggactggaaatatgggcgagaccttgggtgagaaatggaaaagccgcctgaacgccctcggcaaatccgaatttcagatatataagaagtcagggatccaggaggtcgatcggacactggcaaaagaaggaattaagcgaggcgagactgaccaccatgctgtgtctagagggagtgccaaattaaggtggttcgttgagcgcaatatggtgacccctgaaggaaaggtagtggatcttggctgcggtagagggggatggtcgtactattgtggcggtctgaaaaacgtcagagaggttaagggcctcacaaaagggggacccggccacgaggaacctatcccaatgagcacgtacgggtggaatctagtgcgtctgcagtccggagtcgacgtgtttttcattccccctgaaaaatgcgataccttgctgtgtgacatcggcgagtcttcaccaaaccccactgtagaggcaggtaggacactccgggtgcttaatctggttgaaaactggttgaataacaatacccaattctgcataaaggtgctgaacccgtacatgcctagcgtcattgagaaaatggaagctctccagcgcaagtatgggggagccttagtgcgaaatccactgtccagaaacagtactcatgagatgtactgggtctctaatgccagcggcaacatcgtgtcatccgttaacatgatcagtaggatgcttattaatcggtttacaatgcgccacaaaaaggcgacctatgaacccgatgtagacctgggcagcgggacgagaaacataggaatcgagtctgagattcctaatctagacatcattggtaagaggatcgagaaaataaagcaggagcatgaaacctcctggcactacgatcaggaccacccatataaaacatgggcttaccatggctcatatgagactaagcaaaccgggagcgcatcgtctatggtgaacggagtcgtgcgactcctgacaaaaccctgggatgttttgccgactgtgacccagatggccatgacagacaccactcctttcggccagcagcgggtctttaaggaaaaggtggatacgcgtacacaagagcccaaagagggtaccaagaaactgatgaagatcactgctgaatggctctggaaagagcttgggaagaaaaagaccccaagaatgtgtacacgcgaagagttcacgaggaaggtacggagtaatgccgcactgggagccatttttaccgacgagaacaaatggaagtccgctagagaagcggtggaggatagccgcttctgggaattagttgacaaagagaggaatctgcacttggaaggcaagtgcgagacttgtgtctacaacatgatgggcaaacgagagaagaagctcggggaatttggaaaagccaagggttcacgggcaatctggtacatgtggctgggcgctagattcctagagtttgaagcccttgggttcctgaatgaggatcattggttttccagggaaaactctctcagcggagtggagggcgagggtctgcacaaattggggtatattctgcgcgacgtgagtaagaaagaaggaggcgcaatgtacgccgatgacacagctggctgggacacccgtatcactctcgaggatcttaagaatgaagagatggtcacaaaccacatggaaggggagcataagaaactggccgaggcgattttcaagttaacctatcagaataaagttgtgcgggtacagagacctacacccaggggaactgtgatggacataatctcccgccgagatcaacggggtagcggccaggtcgggacctacggactgaacacgtttaccaatatggaagcacagttgattagacagatggagggcgaaggtgtgttcaagaacatccaacacctcacagttactgaggaggtggccgtccagaactggctggctagggtggggcgcgaaagactatctcggatggccatctcaggagacgattgcgtagttaaaccacttgacgataggttcgcaaatgctctgaccgccctcaacgacatgggcaagattcgtaaggatatacagcagtgggagcccagtaaaggctggaatgactggacacaagtgcctttttgctcccatcacttccatgaactgatcatgaaggatgggcgagtcttggtggtgccatgtcgcaaccaggacgagttaattggtagagctcggatcagccagggagccggctggtctctgagggaaactgcatgcctcgggaaatcgtatgcgcagatgtggtcacttatgtactttcaccgcagagatctgcggctagccgctaatgccatttgtagcgcagtcccgtcccactgggttcccaccagtaggacgacatggtctatccatgctaagcacgagtggatgaccactgaggacatgctgacagtgtggaaccgagtatggatacgtgaaaatccttggatggaggacaaaaccccagtggaaagctgggaggaaatcccctatctcggaaagagagaggatcaatggtgcggctccttgattggtctgacttcacgcgccacctgggcaaagaacatccaggtcgccattaatcaggtgcggagtcttatcgggaacgaggaatacacagactacatgccttctatgaaaaggttcagacgcgaggaagaggaagcgggagttctgtggtga

SEQ ID NO: 14799 - RNA, 9876 nt, synthetic construct
  misc_feature 1..9876: note = derived and/or modified CDS sequence (opt3) from DENV-2__FJ410200__SS-prME
  source 1..9876: mol_type = other RNA
agcgccggcatgatcattatgctgatacccaccgtgatggctttccacctcacaactagaaacggggagcctcatatgatcgtcggaattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagagcaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccaattaaagctgaattggttcaagaaagggtcttccattggacagatgtttgaaacgaccatgcggggtgccaagcgaatggctatactaggcgatacagcctgggacttcgggtcactcggaggcgtatttactagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacaatataaatttcagcccgagagtccaagcaagttggcctccgctatccagaaagcccaggaagagggcatatgtggtattagatctgtcactaggctcgagaatctgatgtggaagcaaatcacacccgaattaaaccacattctggcagagaatgaagttaaactaaccatcatgactggcgatataaaggggatcatgcaggccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaagacgcgttttgtgactctaagttaatgagcgctgccattaaggataatagggcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatcccaaaaaacctcgcaggacccgttagtcagcacaattaccgtcctggctaccacacgcagattgctggtccatggcatctgggcaagctagagatggacttcaacttttgtgatgggacaaccgtgatcgtcactgaagactgcggaaatcggggccccagcctgcgaaccacaactgcctctgggaagctcattaccgagtggtgctgtagatcctgcacactgccgcctcttaggtatcgcggagaggatggctgttggtacggtatggaaatacggccattgaaagagaaggaagagaacctggtgaattcattagttacggcggggcacggacaagtggacaacttcagtctcggcgtactgggtatggccctttttctggaagagatgttgagaaccagggtcggcactaaacatgctatcctcctggtggcagtgagcttcgtcacactaattaccgggaatatgtcgtttaaggatctgggacgcgttgtggtaatggtgggcgccactatgacagacgatatcgggatgggagtcacctatctcgctctgcttgccgcattcaaagtgcgacccacgtttgcggccggcttgctgttacggaagctcacttccaaggagctgatgatgaccacaattggtatcgttcttctgtctcagagcaccatacctgaaactgtgctagagctcacagacgctctggccttggggatgatggtcctgaaaatcgtgcgtaacatggaaaagtaccagttagcagttaccattatggctatcctctgcgtgcccaatgccgtcattctgcagaacgcatggaaagtatcatgtacaatccttgccgtggttagtgtgtccccactgttgctcacttctagccaacagaagaccgattggatacctctggctctaacgattaaaggactgaatcccacagcgatcttccttaccactctctccagaaccaacaagaaaaggtcatggccactgaatgaggccatcatggcagtcggcatggtgagcattttggctagttctctgttaaagaacgacataccgatgacaggccctctcgtagccgggggactgcttactgtgtgctatgtcctgaccggtcgctccgccgacttggaactcgagcgggctacggatgttaagtgggaggaccaggcagaaatcagcggctcgtcacccattctgtctatcacaattagtgaggatgggtccatgagcatcaaaaatgaagaggaggaacagaccctaactatactgatcagaacaggacttctcgtgatttctggcctgtttccaatcagcattcccatcaccgccgcggcttggtacttgtgggaggtgaagaaacaaagggccggtgtcttatgggacgtgccttccccaccccctatggggaaggcagaactggaggatggagcctatcgaataaaacagaagggcattctcggctactcacagatcggggctggagtttacaaggaaggtactttccacacaatgtggcatgtaacccgcggcgcagtgctgatgcacaaagggaagcggatcgagccgagttgggccgacgtcaaaaaggatcttattagctatggaggcggttggaaactggagggggaatggaaggagggagaagaggtgcaggttttggcgctagaaccaggcaagaaccccagagctgtgcaaacgaaacctggcctgtttaagactaacaccgggacaatcggagccgtctctctcgacttctccccaggtacctcaggcagtcccataattgataaaaaggggaaagtggtaggactgtacggcaatggtgtcgtgacaaggagcggggcatatgtttccgccatcgctcagactgagaagtctattgagaacaatcctgaaatcgaggacgatatatttcgtaagcgccggcttaccattatggacttacacccgggagccggcaaaacgaagagatacctgcccgcaatcgtgagggaagctatcaaacgaggcctccggacattgattctggccccaactcgcgtcgtggcggccgagatggaagaggcactcagagggctgcctatcaggtatcagacccccgctattcgggccgagcatacaggacgagaaatagttgatcttatgtgtcacgctaccttcactatgagactgttgtcgccagtgcgcgtccctaactacaatctaatcattatggacgaggcacatttcaccgaccccgccagcatcgccgctaggggttatatctcaacacgtgtggaaatgggcgaggcggcagggatttttatgacggccactccaccgggatcccgggatcctttcccccaaagtaacgctccaataatcgacgaggaaagagagattcccgaaaggtcttggaatagcggccacgagtgggtaaccgattttaagggtaaaacagtgtggttcgttccttccatcaaggccgggaacgacattgcagcctgcctgcgcaagaatggaaaaaaggtcatccagctctcacgaaaaacctttgattctgaatacgtgaagactagaacaaacgactgggatttcgtggtcaccacggacataagcgagatgggcgctaattttaaagcggagcgggtaatcgatccaaggcgctgtatgaagcccgtgattttaactgacggcgaagagcgtgttatcctggccgggcctatgccggtgacacatagttccgcagctcagagacggggaaggattggtcgcaacccaaaaaatgaaaacgatcagtacatctatatgggcgagccccttgaaaatgacgaggactgcgcccactggaaggaggcaaagatgctgctcgataacataaacacccctgaagggattatccccagcatgttcgagccagaacgagagaaagtcgacgccattgatggagaatacagattgcggggcgaggctaggaagacctttgtggacctgatgcgcagaggtgatctccctgtttggctggcctataaagtggcggcagaggggatcaattacgccgacaggcggtggtgtttcgatggcataaagaacaatcaaatccttgaagagaacatggaagtcgagatttggactaaagagggagaacgtaagaagctaaaaccccgctggctggacgctcgaatctattctgatccattggccttaaaggagtttaaagaattcgctgcaggcagaaagtcactgacactcaatctgattaccgagatggggaggcttcctacattcatgactcagaaaacgcgggacgccctggataacctcgctgtgttgcacaccgccgaagcaggaggtcgcgcgtacaatcatgccctgtccgagctaccggagacactggaaactctccttctgttaaccttgctggctacagtaaccggcgggatctttctcttcctgatgagtggaagaggcataggtaagatgactcttgggatgtgctgcattatcacggccagcatcctgctctggtatgcacagattcagccccactggatcgctgcctcgataattttggagtttttcctgatcgtgttactaattccagaacctgagaagcaaaggaccccccaggacaaccagctgacatacgttgtcatcgcaatactcactgtggtggccgctaccatggcgaatgaaatgggctttcttgagaaaacaaagaaagatctgggattgggctctatcgccacccggcagccagagtccaacattctggacatcgacctccgacctgcaagcgcttggactctgtacgccgtcgccacaacgttcgttacccccatgcttagacattcaattgaaaatagttctgtgaacgtatccctcactgcaatcgctaatcaagccacagtgctgatggggttgggaaagggttggccgctgagcaaaatggatattggcgtcccattactagcgatcgggtgttattcacaggtgaaccctataaccctgaccgctgccctccttctgttggttgcacactacgccattatcggacccggcctgcaggctaaggcaacacgcgaggcccagaagagggcggctgccggtatcatgaaaaatccaactgtggacgggattacggtcatagatctcgaccccatcccttatgatccgaagtttgaaaaacaactgggccaggtaatgcttttagtgctgtgcgttacccaggtgctcatgatgcggacaacttgggcattgtgtgaggccctgaccctagctacaggacccattagtaccctgtgggaaggcaacccagggcgtttctggaatactacgatcgccgtcagcatggcaaacatttttagaggatcctacctcgctggcgccggtcttctgttctctatcatgaagaacacaaccaatactaggcgcgggaccggaaacatgggcgagacattgggtgagaaatggaagagccggctgaatgcgctcggcaaatccgaatttcaaatatataagaagtcagggatccaggaggtggaccgaactctggccaaagaaggaattaagagaggcgagaccgatcaccatgcagtctctagggggagtgctaaattacgctggttcgtggagcggaacatggttacacctgaaggaaaggtggtagaccttggctgcggtagagggggatggtcgtactattgtggcggtctgaaaaatgtgcgtgaggtcaagggcctcacgaaggggggacccggccacgaagagcctatcccaatgagcacctacgggtggaacctagttaggctgcagtccggagtggatgtctttttcattccccctgaaaaatgcgacactttgctgtgtgatatcggcgagtcttcaccaaatcccacagtggaggccggtcggaccctccgcgtacttaacctggtggaaaattggttgaacaataacactcagttctgcataaaggttctgaatccgtacatgcctagcgtgattgagaaaatggaagcactccaacgaaagtatgggggagctttagtcagaaacccactgtccaggaatagtacacatgagatgtactgggtgtctaacgccagcggcaacatcgtctcatccgtgaatatgatcagtcggatgcttattaaccgctttaccatgagacacaaaaaggccacgtatgaacccgacgttgatctgggcagcgggaccaggaatataggaatcgagtctgagattcctaacctagacatcattggtaagcgaatcgaaaaaataaagcaggagcatgaaacatcctggcactacgaccaggatcacccatataaaacttgggcgtaccatggctcatatgagaccaagcagacagggagcgcttcgtctatggtaaatggagtggtccggctcctgactaaaccctgggacgtgttgccgaccgttacacaaatggcaatgaccgatactacgcctttcggccagcagcgtgtgtttaaggaaaaggtcgacacaagaacccaggagcccaaagagggtactaagaaactgatgaagatcaccgccgaatggctctggaaagagcttgggaagaaaaagacaccacgcaggtgtacgcgggaagagttcaccagaaaggtgcgcagtaacgctgccctgggagcaatttttactgatgagaataaatggaagtccgccagggaagctgtagaggacagccgattctgggaattagtggataaagagcggaacctgcacttggaaggcaagtgcgagacatgtgtttacaatatgatgggcaaaagagagaagaagctcggggaatttggaaaagcgaagggttcaagggccatctggtacatgtggctgggcgcacgcttcctagagtttgaagctcttgggttcctgaacgaggaccattggttttcccgtgaaaattctctcagcggagtcgagggcgagggtctgcacaaattggggtatattctgcgggatgtgagtaagaaagaaggaggcgccatgtacgcagacgataccgccggctgggacactagaatcacactcgaggaccttaagaacgaagagatggtgaccaatcacatggaaggggagcataagaaactggctgaggccattttcaagttaacatatcaaaacaaagtcgttagggtgcagcgccctactccccgaggaaccgtaatggatataatctcccggagagaccagaggggtagcggccaagtggggacgtacggactgaatacctttacaaacatggaagcgcagttgattcgccagatggagggcgaaggtgtcttcaagaacatccagcacctcactgtgaccgaggaggttgcagtgaaaaattggctggccagagtcgggcgggaaaggctatctcgtatggctatctcaggagatgactgcgtggtaaagccacttgatgaccgattcgccaacgcactgacagctctcaatgatatgggcaagattcgcaaagacatacaacagtgggagcccagtaagggctggaacgattggactcaggttcctttttgctcccatcacttccatgaactgatcatgaaagacgggagagtgttggtcgtgccatgtcggaatcaggatgagttaattggaagggcccgcatcagccaaggtgctggctggtctctgagagaaaccgcctgcctcgggaagtcgtatgcacagatgtggtcacttatgtactttcaccggagggacctgcgactagcggccaacgctatttgtagcgccgtgccgtcccactgggtccccacgagtcgtacaacctggtctatccatgcaaaacacgagtggatgactacagaggatatgctgaccgtttggaatagagtgtggatacgcgaaaacccttggatggaggacaagactccagtagaaagctgggaggaaatcccctatctcggaaagcgggaggaccagtggtgcggctccttgattggtctgacctcaagggctacatgggccaaaaatatccaggcagccattaaccaagtgagaagtcttatcgggaatgaggaatacacggattacatgccttctatgaagcgcttccggagggaggaagaggaagcgggagtcctgtggtga

SEQ ID NO: 14800 - RNA, 9876 nt, synthetic construct
  misc_feature 1..9876: note = derived and/or modified CDS sequence (opt3) from DENV-2__FJ410202__SS-prME
  source 1..9876: mol_type = other RNA
agcgcaggcatgatcattatgctgatccccaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtgtcggtaaggcactgcatcaggtgttcggggccatctatggcgctgcgtttagcggagtttcctggaccatgaaaattcttatcggcgtgattatcacatggatagggatgaactctcgcagcacttcattgagtgtctccctggtgctcgtaggaatcgtgaccctgtaccttggcgttatggtccaggcagatagcggttgtgtggtgtcttggaagaataaggagctgaaatgcgggtcaggaattttcatcacggacaacgtccacacatggaccgaacagtataagtttcaacccgagagtccaagcaaattggcctccgctattcagaaggcccaggaagagggcatctgtggtataagatctgttactaggctcgagaatctgatgtggaaacagattacacccgaattaaaccacatcctggcagagaatgaagtgaagctaaccattatgactggcgatatcaaagggataatgcaagccggaaagcggtcgctccgccctcagccaaccgagctgaagtacagctggaaaacatggggcaaggctaaaatgctttccacggaatcatataaccagaccttcttgatcgacgggccggagactgccgagtgccccaatacaaacagagcatggaatagtctggaagtggaggattacggatttggcgtattcaccacaaacatttggctcaagctgaaagaaaagcaggacgcgttttgtgactctaagttaatgagcgctgccatcaaagataatagggcagtccatgccgacatgggttattggattgagtccgctctgaacgatacttggaagatcgagaaagcctcattcatagaagtgaagaattgccactggcctaaaagccataccctttggtctaacggggttttggagtccgaaatgattatcccaaagaacctcgcaggacccgtgagtcaacacaattaccgtcctggctaccacacgcagatcgctggtccatggcatctgggcaagctagagatggacttcgatttttgtgacgggacaaccgtcattgtgactgaagattgcggaaaccggggccccagcctgcgaaccacaactgcctctgggaaactcatcaccgagtggtgctgtagatcctgcacactgccgcctcttaggtatcgcggagaggacggctgttggtacggtatggaaattcggccattgaaggagaaagaagagaatctggttaactcattagtgacggcggggcacggacaggtagataatttcagtctcggcgtcctgggtatggccctttttctggaagagatgttgagaaccagggtgggcactaagcatgctatactcctggtggcagtcagcttcgttacactaatcaccgggaacatgtcgtttaaagacctgggacgcgtggtagtgatggtcggcgccactatggctgatgacattgggatgggagtgacatatctcgccctgcttgcagcgttcaaggttcgacccacctttgccgctggcttgctgttacggaagctcacgtccaaagagctgatgatgactaccatcggtattgtgcttctgtctcaaagcacaatccctgaaaccgtcctagagctcactgatgccctggcattggggatgatggtgctgaagatagttcgtaatatggaaaaataccagttagctgtgacaatcatggccattctctgcgtccccaacgcagtaatcctgcagaatgcctggaaggtgtcatgtaccattcttgctgttgtgagtgtctccccactgttgctcacatctagccagcagaagactgactggatccctctggcgctaaccataaagggactgaaccccacggccattttccttacaaccctctccagaactaataaaaagaggtcatggccactgaacgaggcaatcatggctgtgggcatggtaagcatcttggccagttctctgttaaagaatgacattccgatgaccggccctctcgtggccgggggactgcttacagtctgctatgttctgactggtcgctccgctgatttggaactcgagcgggcaaccgacgtgaaatgggaggatcaggccgaaataagcggctcgtcacccatcctgtctattacgatcagtgaggacgggtccatgagcattaagaacgaagaggaggaacagacactaaccatcctgataagaactggacttctcgtgatctctggcctgtttccaattagcatccccattacagcggctgcctggtacttgtgggaggtcaaaaagcagagggccggtgtgttatgggatgttccttccccaccccctatggggaaagccgaactggaggacggagcttatcgaatcaagcaaaagggcatactcggctactcacagattggggcaggagtatacaaagaaggtaccttccacactatgtggcatgtgacacgcggcgccgtcctgatgcacaaggggaaacggatcgagccgagttgggcggatgtgaagaaagaccttatcagctatggaggcggttggaagctggagggggaatggaaggagggagaagaggttcaggtgttggctctagaaccaggcaaaaatcccagagccgtccagaccaagcctggcctgtttaaaacgaacactgggaccattggagcagtgtctctcgatttctccccaggtacatcaggcagtcccatcatagacaagaaagggaaggtagtcggactgtacggcaacggtgtggttaccaggagcggggcctatgtgtccgctattgcccaaacagagaagtctatcgaggataatcctgaaattgaggacgatatctttcgtaaacgccggcttactataatggacttacacccgggagcaggcaagaccaaaagatacctgcccgctattgtcagggaagccatcaagcgaggcctccggacgttgatcctggcgccaacacgcgtggttgccgcagagatggaagaggctctcagagggctgcctattaggtatcagactcccgccatccgggctgagcataccggacgagaaattgtggaccttatgtgtcacgcaacattcaccatgagactgttgtcgccagtccgcgtgcctaactacaatctaataatcatggatgaggcccatttcactgaccccgccagcattgctgcgaggggttatatctcaacccgtgtagaaatgggcgaggcagccgggatctttatgacagctacgccaccgggatcccgggatcctttcccccagagtaacgccccaattatagacgaggaaagagagatccccgaaaggtcttggaatagcggccacgagtgggtgactgattttaaaggtaagaccgtttggttcgtcccttccattaaggcagggaacgacatcgccgcttgcctgcgcaaaaatggaaagaaagtgattcaactctcacgaaagacatttgattctgaatacgtgaaaaccagaactaacgactgggatttcgtcgtaacaaccgacatcagcgagatgggcgcgaattttaaggccgagcgggtgatagatccaaggcgctgtatgaaacccgttatcttaacggacggcgaagaacgtgtgattctggcagggcctatgccggtcactcatagttccgctgcccagagacggggaaggatcggtcgcaacccaaagaatgaaaacgaccagtacatttatatgggcgagccccttgaaaatgatgaggactgcgcacactggaaggaggccaaaatgctgctcgataacatcaatacacctgaagggataattcccagcatgttcgagccagaacgagagaaggtggacgctatcgatggagaatacagattgcggggcgaggccaggaaaacctttgttgacctgatgcgcagaggtgatctccctgtgtggctggcgtataaggtcgcagccgaggggattaactacgctgacaggcggtggtgtttcgatggcatcaaaaacaatcagatacttgaagagaacgtggaagtagaggtgtggaccaaggagggagaacgtaagaaactaaagccccgctggctggacgcccgaatctattctgatccattggctttaaaagagtttaaggagttcgcagccggcagaaaatcactgactctcaatctgattacagagatggggaggcttcctaccttcatgacacaaaagactcgggacgctctggataacctcgccgttttgcacacggcagaagtcggaggtcgcgcgtacaatcatgccctgtccgagctaccggagaccctggaaacactccttctgttaactttgctggctaccgtgacaggcgggatctttctcttcctgatgagtggaagaggcattggtaagatgacccttgggatgtgctgcatcataactgccagcattctgctctggtatgcacagatccagccccactggatcgctgcctcgattatcttggagtttttcctgatagtgttactaattccagaacctgagaaacagaggacgccccaagacaaccagctgacctacgtcgttatcgcaattctcacagtggtagccgctactatggcgaatgaaatgggctttcttgagaagaccaaaaaggacctgggattgggctctatcgccacacagcagccagagtccaacatactggatatcgacctccggcctgcaagcgcttggaccctgtacgccgtggccactacattcgtcacgcccatgcttcgacattcaattgaaaatagttctgtgaacgtttccctcaccgcaatcgctaatcaagccactgtgctgatggggttgggaaaaggttggccgctgagcaagatggatattggcgtcccattactagcgatcgggtgttattcacaggtaaaccctattacactgaccgctgccctccttctgttggtggcacactacgccatcataggacccggcctgcaggctaaggcaaccagagaggcccagaaacgcgcggctgccggtattatgaagaatccaacagttgacgggatcactgtgatcgatctcgaccccattccttatgatccgaaatttgaaaagcaactgggccaggtcatgcttttaatactgtgcgtgacgcaggtcctcatgatgaggaccacatgggcattgtgtgaggccctgactctagctaccggacccatcagtacactgtgggaaggcaacccagggcggttctggaataccactattgccgtgagcatggcaaacatctttcgtggatcctacctcgctggcgccggtcttctgttctctattatgaaaaatacgacaaacaccagaagggggactggaaacatgggcgagaccttgggtgagaagtggaaaagccgcctgaatgcgctcggcaagtccgaatttcaaatctataagcggtcagggatacaggaggttgaccgaacactggccaaagaaggaatcaagagaggcgagactgatcaccatgcagtgtctagggggagtgctaaattacgctggttcgtagagcggaacatggtgacccctgaaggaaaggtcgttgaccttggctgcggtagagggggatggtcgtactattgtggcggtctgaaaaatgtgcgtgaggtcaagggcctcacaaaagggggacccggccacgaagaacctattccaatgagcacgtacgggtggaacctagtgaggctgcagtccggagtagatgtgtttttcataccccctgaaaaatgcgacaccttgctgtgtgatattggcgagtcttcaccaaatcccactgttgaggccggtcggacactccgcgtgcttaacctggtcgaaaattggttgaacaataacacccagttctgcatcaaggtgctgaatccgtacatgcctagcgtcatagagaaaatggaagcactccaacgaaagtatgggggagctttagtgagaaacccactgtccaggaatagtactcatgagatgtactgggtttctaacgccagcggcaatattgtatcatccgtgaacatgatcagtcggatgcttatcaaccgctttacaatgagacacaaaaaggccacctatgaacccgacgtcgacctgggcagcgggacgaggaatattggaatagagtctgagatccctaacctagatattatcggtaagcgaattgagaaaatcaagcaggagcatgaaacctcctggcactacgaccaggatcacccatataaaacatgggcgtaccatggctcatatgagactaagcagaccgggagcgcttcgtctatggtgaatggagttgtgcggctcctgacaaaaccctgggacgtcttgccgactgtgacccaaatggcaatgacagataccactcctttcggccagcagcgtgtatttaaggaaaaggtggacacgagaacacaggagcccaaagagggtaccaagaaactgatgaagataactgccgaatggctctggaaagagcttgggaagaaaaagaccccacgcatgtgtacaagggaagagttcacgcggaaggttagaagtaacgctgccctgggagcaatctttaccgatgagaataaatggaagtccgcccgcgaagctgtcgaggacagcaggttctgggaattagtggataaagagcgaaacctgcacttggaaggcaagtgcgagacttgtgtgtacaatatgatgggcaaacgggagaagaagctcggggaatttggaaaagcgaagggttcaagagccatttggtacatgtggctgggcgcaaggttcctagagtttgaagctcttgggttcctgaacgaggaccattggttttcccgcgaaaattctctcagcggagtcgagggcgagggtctgcacaaattggggtatatcctgcgtgatgttagtaagaaagaaggaggcgccatgtacgcagacgacacagccggctgggatacccggattactctcgaggaccttaagaacgaagagatggtgacaaatcacatggaaggggagcataagaaactggctgaggccatcttcaagttaacctatcaaaacaaagtagtgagagtccagaggcctacaccccgcggaactgtgatggatattatatcccgacgggaccagagaggtagcggccaagttgggacctacggactgaatacgtttaccaacatggaagcgcagttgatcaggcagatggagggcgaaggtgtgttcaagaatattcagcacctcacagtcactgaggaggtggcagtacaaaactggctggcccgcgttgggagagaacggctatctaggatggctatctcaggagatgactgcgtggtcaaaccacttgatgaccgtttcgccaacgcactgaccgctctcaatgatatgggcaagatccgaaaggacattcagcagtgggagcccagtaaaggctggaacgattggacacaggtgcctttttgctcccatcacttccatgaactgataatgaaggacgggcgcgtgttggtcgttccatgtagaaatcaagatgagttaatcggacgggccaggattagccagggtgctggctggtctctgcgcgaaactgcctgcctcgggaaatcgtatgcacagatgtggtcacttatgtactttcacagacgggacctgaggctagcggccaacgctatctgtagcgccgtgccgtcccactgggtacccaccagtcgaacgacatggtctattcatgcaaagcacgagtggatgaccactgaggacatgctgacagtgtggaatcgtgtctggatcagagaaaacccttggatggaggataaaaccccagtggaaagctgggaggaaataccctatctcggaaagcgcgaggaccagtggtgcggctccttgatcggtctgacttcacgggctacctgggccaagaatattcaagcagccatcaaccaggttaggagtcttattgggaatgaggaatacatcgattacatgccttctatgaaaagattccgccgggaggaagaggaagcgggagtgctgtggtga

SEQ ID NO: 14801 - RNA, 9876 nt, synthetic construct
  misc_feature 1..9876: note = derived and/or modified CDS sequence (opt3) from DENV-2__FJ410208__SS-prME
  source 1..9876: mol_type = other RNA
agcgccggcatgatcattatgctgatacccaccgtgatggctttccacctcacaactagaaacggggagcctcatatgatcgtcggaattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagagcaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccaattaaagctgaattggttcaagaaagggtcttccattggacagatgtttgaaacgaccatgcggggtgccaagcgaatggctatactaggcgatacagcctgggacttcgggtcactcggaggcgtatttactagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacaatataaatttcagcccgagagtccaagcaagttggcctccgctatccagaaagcccaggaagagggcatatgtggtattagatctgtcactaggctcgagaatctgatgtggaagcaaatcacacccgaattaaaccacattctggcagagaatgaagttaaactaaccatcatgactggcgatataaaggggatcatgcaggccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaagacgcgttttgtgactctaagttaatgagcgctgccattaaggataatagggcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatcccaaaaaacctcgcaggacccgttagtcagcacaattaccgtcctggctaccacacgcagattgctggtccatggcatctgggcaagctagagatggacttcaacttttgtgatgggacaaccgtgatcgtcactgaagactgcggaaatcggggccccagcctgcgaaccacaactgcctctgggaagctcattaccgagtggtgctgtagatcctgcacactgccgcctcttaggtatcgcggagaggatggctgttggtacggtatggaaatacggccattgaaagagaaggaagagaacctggtgaattcattagttacggcggggcacggacaagtggacaacttcagtctcggcgtactgggtatggccctttttctggaagagatgttgagaaccagggtcggcactaaacatgctatcctcctggtggcagtgagcttcgtcacactaattaccgggaatatgtcgtttaaggatctgggacgcgttgtggtaatggtgggcgccactatgacagacgatatcgggatgggagtcacctatctcgctctgcttgccgcattcaaagtgcgacccacgtttgcggccggcttgctgttacggaagctcacttccaaggagctgatgatgaccacaattggtatcgttcttctgtctcagagcaccatacctgaaactgtgctagagctcacagacgctctggccttggggatgatggtcctgaaaatcgtgcgtaacatggaaaagtaccagttagcagttaccattatggctatcctctgcgtgcccaatgccgtcattctgcagaacgcatggaaagtatcatgtacaatccttgccgtggttagtgtgtccccactgttgctcacttctagccaacagaagaccgattggatacctctggctctaacgattaaaggactgaatcccacagcgatcttccttaccactctctccagaaccaacaagaaaaggtcatggccactgaatgaggccatcatggcagtcggcatggtgagcattttggctagttctctgttaaagaacgacataccgatgacaggccctctcgtagccgggggactgcttactgtgtgctatgtcctgaccggtcgctccgccgacttggaactcgagcgggctacggatgttaagtgggaggaccaggcagaaatcagcggctcgtcacccattctgtctatcacaattagtgaggatgggtccatgagcatcaaaaatgaagaggaggaacagaccctaactatactgatcagaacaggacttctcgtgatttctggcctgtttccaatcagcattcccatcaccgccgcggcttggtacttgtgggaggtgaagaaacaaagggccggtgtcttatgggacgtgccttccccaccccctatggggaaggcagaactggaggatggagcctatcgaataaaacagaagggcattctcggctactcacagatcggggctggagtttacaaggaaggtactttccacacaatgtggcatgtaacccgcggcgcagtgctgatgcacaaagggaagcggatcgagccgagttgggccgacgtcaaaaaggatcttattagctatggaggcggttggaaactggagggggaatggaaggagggagaagaggtgcaggttttggcgctagaaccaggcaagaaccccagagctgtgcaaacgaaacctggcctgtttaagactaacaccgggacaatcggagccgtctctctcgacttctccccaggtacctcaggcagtcccataattgataaaaaggggaaagtggtaggactgtacggcaatggtgtcgtgacaaggagcggggcatatgtttccgccatcgctcagactgagaagtctattgaggacaaccctgaaatcgaggatgacatatttcgtaagcgccggcttaccattatggatttacacccgggagccggcaaaacgaagagatacctgcccgcaatcgtgagggaagctatcaaacgaggcctccggacattgattctggccccaactcgcgtcgtggcggccgagatggaagaggcactcagagggctgcctatcaggtatcagacccccgctattcgggccgagcatacaggacgagaaatagttgaccttatgtgtcacgctaccttcactatgagactgttgtcgccagtgcgcgtccctaattacaacctaatcattatggacgaggcacatttcaccgatcccgccagcatcgccgctaggggttatatctcaacacgtgtggaaatgggcgaggcggcagggatttttatgacggccactccaccgggatcccgggaccctttcccccaaagtaatgctccaataatcgatgaggaaagagagattcccgaaaggtcttggaacagcggccacgagtgggtaaccgactttaagggtaaaacagtgtggttcgttccttccatcaaggccgggaatgatattgcagcctgcctgcgcaagaacggaaaaaaggtcatccagctctcacgaaaaacctttgactctgaatacgtgaagactagaacaaatgattgggacttcgtggtcaccacggatataagcgagatgggcgctaactttaaagcggagcgggtaatcgacccaaggcgctgtatgaagcccgtgattttaactgatggcgaagagcgtgttatcctggccgggcctatgccggtgacacatagttccgcagctcagagacggggaaggattggtcgcaatccaaaaaacgaaaatgaccagtacatctatatgggcgagccccttgaaaacgacgaggattgcgcccactggaaggaggcaaagatgctgctcgacaatataaacacccctgaagggattatccccagcatgttcgagccagaacgagagaaagtcgatgccattgacggagaatacagattgcggggcgaggctaggaagacctttgtggatctgatgcgcagaggtgacctccctgtttggctggcctataaagtggcggcagaggggatcaactacgccgataggcggtggtgtttcgacggcataaagaataaccaaatccttgaagagaatatggaagtcgagatttggactaaagagggagaacgtaagaagctaaaaccccgctggctggatgctcgaatctattctgacccattggccttaaaggagtttaaagaattcgctgcaggcagaaagtcactgacactcaacctgattaccgagatggggaggcttcctacattcatgactcagaaaacgcgggatgccctggacaatctcgctgtgttgcacaccgccgaagcaggaggtcgcgcgtacaaccatgccctgtccgagctaccggagacactggaaactctccttctgttaaccttgctggctacagtaaccggcgggatctttctcttcctgatgagtggaagaggcataggtaagatgactcttgggatgtgctgcattatcacggccagcatcctgctctggtatgcacagattcagccccactggatcgctgcctcgataattttggagtttttcctgatcgtgttactaattccagaacctgagaagcaaaggaccccccaggataatcagctgacatacgttgtcatcgcaatactcactgtggtggccgctaccatggcgaacgaaatgggctttcttgagaaaacaaagaaagacctgggattgggctctatcgccacccggcagccagagtccaatattctggacatcgatctccgacctgcaagcgcttggactctgtacgccgtcgccacaacgttcgttacccccatgcttagacattcaattgaaaacagttctgtgaatgtatccctcactgcaatcgctaaccaagccacagtgctgatggggttgggaaagggttggccgctgagcaaaatggacattggcgtcccattactagcgatcgggtgttattcacaggtgaatcctataaccctgaccgctgccctccttctgttggttgcacactacgccattatcggacccggcctgcaggctaaggcaacacgcgaggcccagaagagggcggctgccggtatcatgaaaaacccaactgtggatgggattacggtcatagacctcgatcccatcccttatgacccgaagtttgaaaaacaactgggccaggtaatgcttttagtgctgtgcgttacccaggtgctcatgatgcggacaacttgggcattgtgtgaggccctgaccctagctacaggacccattagtaccctgtgggaaggcaatccagggcgtttctggaacactacgatcgccgtcagcatggcaaatatttttagaggatcctacctcgctggcgccggtcttctgttctctatcatgaagaacacaaccaacactaggcgcgggaccggaaatatgatagagacattgggcgagaaatggaagagccggctgaacgcgctcggtaaatccgaatttcaaatctataagaagtcaggcattcaggaggtggatcgaactctggccaaagaagggatcaagagaggagagaccgaccaccatgcagtctctaggggcagtgctaaattacgctggttcgtggagcggaatatggttacacctgaagggaaggtggtagatcttggatgcggcagaggtgggtggtcgtactattgtggaggcctgaaaaacgtgcgtgaggtcaagggtctcacgaagggcgggcccggacacgaagagcctattccaatgagcacctacggctggaatctagttaggctgcagtccggggtggacgtctttttcatcccccctgaaaaatgcgatactttgctgtgtgacataggagagtcttcaccaaaccccacagtggaggccggccggaccctccgcgtacttaatctggtggaaaactggttgaataacaatactcagttctgcattaaggttctgaacccgtacatgcctagcgtgatcgagaaaatggaagcactccaacgaaagtatggtggggctttagtcagaaatccactgtccaggaacagtacacatgagatgtactgggtgtctaatgccagcggaaacatcgtctcatccgtgaacatgattagtcggatgcttataaatcgctttaccatgagacacaaaaaggccacgtatgaacccgatgttgacctgggcagcggcaccaggaacatcgggattgagtctgagatccctaatctagacattatcggaaagcgaatagaaaaaatcaagcaggagcatgaaacatcctggcactacgatcaggaccacccatataaaacttgggcgtaccatggttcatatgagaccaagcagacaggcagcgcttcgtctatggtaaacggggtggtccggctcctgactaaaccctgggatgtgttgccgaccgttacacaaatggcaatgaccgacactacgcctttcggacagcagcgtgtgtttaaggaaaaggtcgatacaagaacccaggagcccaaagagggcactaagaaactgatgaagattaccgccgaatggctctggaaagagcttggtaagaaaaagacaccacgcatgtgtacgagggaagagttcacccggaaggtgagaagtaatgctgccctgggggcaatctttactgacgagaacaaatggaagtccgcccgcgaagctgtagaggatagcaggttctgggaattagtggacaaagagcgaaatctgcacttggaaggaaagtgcgagacatgtgtttacaacatgatgggcaaacgggagaagaagctcggcgaatttgggaaagcgaagggatcaagagccatttggtacatgtggctgggtgcaaggttcctagagtttgaagctcttggcttcctgaatgaggatcattggttttcccgcgaaaactctctcagcggggtcgagggagagggcctgcacaaattgggttatatcctgcgtgacgtgagtaagaaagaagggggagccatgtacgcagatgacaccgccggctgggacactcggattacactcgaggatcttaagaatgaagagatggtgaccaaccacatggaaggcgagcataagaaactggctgaggccatattcaagttaacatatcaaaataaagtcgttagagtgcagaggcctactccccgcgggaccgtaatggacatcatttcccgacgggatcagagaggaagcggtcaagtgggcacgtacgggctgaacacctttacaaatatggaagcgcagttgatcaggcagatggagggagaaggcgtcttcaagaacatccagcacctcactgtgaccgaggaggttgcagtgaaaaactggctggcccgcgtcggtagagaacggctatctaggatggctatttcaggggacgattgcgtggtaaagccacttgacgatcgtttcgccaatgcactgacagctctcaacgacatgggaaagatacgaaaagatatccaacagtgggagcccagtaagggctggaatgactggactcaggttcctttttgctcccatcacttccatgaactgattatgaaagatggccgcgtgttggtcgtgccatgtagaaaccaggacgagttaatcgggcgggccaggattagccaaggagctggttggtctctgcgcgaaaccgcctgcctcggcaagtcgtatgcacagatgtggtcacttatgtactttcacagacgggatctgaggctagcggccaatgctatctgtagcgccgtgccgtcccactgggtccccacgagtcgaacaacctggtctatacatgcaaaacacgagtggatgactacagaggacatgctgaccgtttggaaccgtgtgtggatcagagaaaatccttggatggaggacaagactccagtagaaagctgggaggaaattccctatctcgggaagcgcgaggatcagtggtgcggatccttgatcggcctgacctcacgggctacatgggccaaaaacattcaggcagccatcaatcaagtgaggagtcttataggtaacgaggaatacacggactacatgccttctatgaagagattccgccgggaggaagaggaagcgggggtcctgtggtga

SEQ ID NO: 14802 - RNA, 9876 nt, synthetic construct
  misc_feature 1..9876: note = derived and/or modified CDS sequence (opt3) from DENV-2__FJ461305__SS-prME
  source 1..9876: mol_type = other RNA
agcgcaggaatgatcattatgctgataccaaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccaattaaagctgaattggttcaagaaagggtcttccattggacagatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacaatataaatttcagcccgagagtccaagcaagttggcctccgctatccagaaagcccaggaagagggcatatgtggtattagatctgtcactaggctcgagaatctgatgtggaagcaaatcacacccgaattaaaccacattctggcagagaatgaagttaaactaaccatcatgactggcgatataaaggggatcatgcaggccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaagacgcgttttgtgactctaagttaatgagcgctgccattaaggataatagggcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatccccaaaaacctcgcaggacccgttagtcagcacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaagctcattaccgagtggtgctgtagatcctgcacactgccgcctcttaggtatcgcggagaggacggctgttggtacggtatggaaatacggccattgaaagagaaggaagagaatctggtgaactcattagttacggcggggcacggacaaatcgataatttcagtctcggcgtgctgggtatggccctttttctggaagagatgttgaaaaccagagtaggcactaagcatgctattctcctggtcgcagtgagcttcgtgacactaatcaccgggaacatgtcgtttaaagacctgggaagggtcgttgtgatggtaggcgccactatggctgatgacattgggatgggagtgacatatctcgccctgcttgcagcgttcaaggtccgccccacctttgccgctggcttgctgttacgaaagctcacgtccaaagagctgatgatgactaccatcggtatagtgcttctgtctcagagcacaatccctgaaaccgttctagagctcactgatgccctggcattggggatgatggtgctgaagattgtccggaatatggaaaaataccagttagctgtgacaatcatggccattctctgcgttcccaacgcagtgatcctgcagaatgcctggaaggtctcatgtaccatacttgctgtagtgagtgtttccccactgttgctcacatctagccaacagaaaactgactggattcctctggcgctaaccatcaagggactgaaccccacggccatcttccttacaaccctctcccgtactaataaaaagagatcatggccactgaacgaggcaattatggctgtgggcatggtcagcatattggccagttctctgttaaagaatgacatcccgatgaccggccctctcgtggccgggggactgcttacagtatgctatgtgctgactggtaggtccgctgatttggaactcgagcgcgcaaccgacgtcaaatgggaggatcaggccgaaattagcggctcgtcacccatcctgtctattacgatcagtgaggacgggtccatgagcataaagaacgaagaggaggaacagacactaaccatcctgattcggactggacttctcgttatctctggcctgtttccaattagcatccccataacagcggctgcctggtacttgtgggaggtgaaaaagcaaagagccggtgtgttatgggatgtcccttccccaccccctatggggaaagccgaactggaggacggagcttataggattaagcagaagggcatcctcggctactcacagatcggggcaggagtgtacaaagaaggtaccttccacactatgtggcatgttacacgaggcgccgtactgatgcacaaggggaaacgcattgagccgagttgggcggatgtgaagaaagaccttatcagctatggaggcggttggaagctggagggggaatggaaggagggagaagaggtccaggtgttggctctagaaccaggcaaaaatccccgggccgttcaaaccaagcctggcctgtttaaaacgaacactgggaccataggagcagtgtctctcgatttctccccaggtacatcaggcagtcccattatcgacaagaaagggaaggtcgtgggactgtacggcaacggtgtagtcaccagaagcggggcctatgtgtccgctattgcccagacagagaagtctatcgaggataatcctgaaatagaggacgatatttttaggaaacgtcgccttactatcatggacttacacccgggagcaggcaagaccaaacggtacctgcccgctatcgttagagaagccattaagaggggcctccgaacgttgatcctggcgccaacacgggtggtcgccgcagagatggaagaggctctccgcgggctgcctattagatatcagactcccgccataagggctgagcataccggacgggaaatcgtggaccttatgtgtcacgcaacattcaccatgcgactgttgtcgccagttagagtgcctaactacaatctaattatcatggatgaggcccatttcactgaccccgccagcatcgctgcgcgcggttatatttcaaccagggtcgaaatgggcgaggcagccgggatatttatgacagctacgccaccgggatcccgtgatcctttcccccaaagtaacgccccaatcattgacgaggaacgggagatccccgaaagatcttggaatagcggccacgagtgggtgactgattttaaaggtaagaccgtatggttcgtgccttccattaaggcagggaacgacatcgccgcttgcctgaggaaaaatggaaagaaagttatacagctctcacgcaagacatttgattctgaatacgtcaaaacccgaactaacgactgggatttcgtggtgacaaccgacatcagcgagatgggcgcgaattttaaggccgagagagtcattgatccacggaggtgtatgaaacccgtaatcttaacggacggcgaagaacgcgtgattctggcagggcctatgccggttactcatagttccgctgcccagcgtagaggacggatcggtaggaacccaaagaatgaaaacgaccagtacatatatatgggcgagccccttgaaaatgatgaggactgcgcacactggaaggaggccaaaatgctgctcgataacattaatacacctgaagggatcattcccagcatgttcgagccagaacgcgagaaggtggacgctatcgatggagaataccgattgagaggcgaggcccggaaaacctttgtcgacctgatgaggcgcggtgatctccctgtgtggctggcgtataaggttgcagccgaggggataaactacgctgacagaaggtggtgtttcgatggcatcaaaaacaatcaaattcttgaagagaacgtggaagtcgagatctggaccaaggagggagaacggaagaaactaaagccccgttggctggacgcccgcatttattctgatccattggctttaaaagagtttaaggagttcgcagccggccgaaaatcactgactctcaatctgatcacagagatggggagacttcctaccttcatgacacagaagactagggacgctctggataacctcgccgtgttgcacacggcagaagcgggaggtcgggcctacaatcatgctctgtccgagctaccggagaccctggaaacactccttctgttaactttgctggccaccgtaacaggcgggatatttctcttcctgatgagtggacgcggcattggtaagatgacccttgggatgtgctgcatcatcactgcaagcattctgctctggtatgctcagatccagccccactggatagccgcatcgattatcttggagtttttcctgattgtgttactaatcccagaacctgagaaacaaagaacgccccaggacaaccagctgacctacgttgtcatagccatcctcacagtggtggctgcgactatggccaatgaaatgggctttcttgagaagaccaaaaaggacctgggattgggctctattgcaacacagcaaccagagtccaacatcctggatattgacctcaggcctgctagcgcctggaccctgtacgccgtcgcaactacattcgttacgcccatgcttcggcattcaatcgaaaatagttctgtgaacgtatccctcaccgctattgccaatcaggcgactgtgctgatggggttgggaaaaggttggccgctgagcaagatggatatcggcgtcccattactagctatagggtgttattcacaggtgaaccctattacactgaccgccgcactccttctgttggttgcccactacgctatcatcggacccggcctgcaggcaaaggccacccgagaggcgcagaaaagagctgccgcaggtattatgaagaatccaacagtggacgggataactgtcatcgatctcgaccccattccttatgatccgaaatttgaaaagcagctgggccaggtaatgcttttaatcctgtgcgtgacgcaagttctcatgatgcgcaccacatgggccttgtgtgaggctctgactctagccaccggacccattagtacactgtgggaaggcaacccagggaggttctggaataccactatcgcagtgagcatggctaacatatttcggggatcctacctcgccggcgcgggtcttctgttctctatcatgaaaaatacgacaaacacccgtagagggactggaaacatgggcgagaccttgggtgagaagtggaaaagcaggctgaatgccctcggcaagtccgaatttcagatttataagaaatcagggatccaggaggtcgaccgcacactggcaaaggaaggaattaaacggggcgagactgatcaccatgctgtgtctcgagggagtgccaagttaagatggttcgtcgagaggaacatggtgacccctgaaggaaaagttgtggaccttggctgcggtcgcgggggatggtcgtactattgtggcggtctgaagaatgtacgggaggtgaagggcctcacaaaagggggacccggccacgaggaacctatcccaatgagcacgtacgggtggaacctagtcagactgcagtccggagttgatgtgtttttcataccccctgaaaagtgcgacaccttgctgtgtgatattggcgagtcttcaccaaatcccactgtcgaggcaggtcgtacactcagggtgcttaacctggtagaaaattggttgaacaataacacccaattctgcatcaaagtgctgaatccgtacatgcctagcgttatcgagaagatggaagctctccagcggaaatatgggggagccttagtgcgcaacccactgtcccgaaatagtactcatgagatgtactgggtctctaacgccagcggcaatattgtgtcatccgtcaacatgataagtagaatgcttatcaacaggtttacaatgcggcacaagcgcgcgacctatgaacccgacgtggacctgggcagcgggacgagaaatattggaatcgagtctgagattcctaacctagatatcataggtaagaggatcgagaaaattaagcaggagcatgaaacctcctggcactacgaccaggatcacccatataaaacatgggcttaccatggctcatatgagactaagcaaaccgggagcgcatcgtctatggttaatggagtagtgcgactcctgacaaaaccctgggacgtcttgccgactgtgacccagatggccatgacagataccactcctttcggccagcagcgggtttttaaggaaaaggtggacacgcgtacacaagagcccaaagagggtaccaagaaactgatgaagatcactgctgaatggctctggaaagagcttgggaagaaaaagaccccaagaatgtgtacacgcgaagagttcacgaggaaggtccggagtaacgccgcactgggagccatttttaccgatgagaataaatggaagtccgctagagaagcggtggaggacagccgcttctgggaattagtagataaagagaggaacctgcacttggaaggcaagtgcgagacttgtgtgtacaatatgatgggcaaacgagagaagaagctcggggaatttggaaaagccaagggttcacgggcaatctggtacatgtggctgggcgctagattcctagagtttgaagcccttgggttcctgaacgaggaccattggttttccagggaaaattctctcagcggagttgagggcgagggtctgcacaaattggggtatattctgcgcgatgtcagtaagaaagaaggaggcgcaatgtacgccgacgacacagctggctgggatacccgtataactctcgaggaccttaagaacgaagagatggtgacaaatcacatggaaggggagcataagaaactggccgaggcgatcttcaagttaacctatcagaacaaagtggtccgggttcagagacctacacccaggggaactgtgatggatattatctcccgccgagaccaacggggtagcggccaggtagggacctacggactgaatacgtttaccaacatggaagcacagttgatcagacagatggagggcgaaggtgtgttcaagaatattcaacacctcacagtcactgaggaggtggccgttcagaactggctggctagggtggggcgcgaaagactatctcggatggccatatcaggagatgactgcgtcgtgaaaccacttgatgacaggttcgcaaacgctctgaccgccctcaatgatatgggcaagatccgtaaggacattcagcagtgggagcccagtaaaggctggaacgattggacacaagtacctttttgctcccatcacttccatgaactgatcatgaaggacgggcgagttttggtggtcccatgtcgcaatcaggatgagttaattggcagagctcggatcagccagggtgccggctggtctctgagggaaactgcatgcctcgggaaatcgtatgcgcagatgtggtcacttatgtactttcaccgcagagacctgcggctagccgctaacgccatatgtagcgcagtgccgtcccactgggtgcccaccagtaggacgacatggtctatccatgctaagcacgagtggatgaccactgaggacatgctgacagtctggaatcgagtttggattcgtgaaaacccttggatggaggataaaaccccagtggaaagctgggaggaaatcccctatctcggaaagagagaggaccaatggtgcggctccttgattggtctgacttcacgcgccacctgggcaaagaatatccaggccgcgataaaccaggtacggagtcttattgggaatgaggaatacacagattacatgccttctatgaaaaggttcagacgcgaggaagaggaagctggagtgctgtggtga

SEQ ID NO: 14803 - RNA, 9876 nt, synthetic construct
  misc_feature 1..9876: note = derived and/or modified CDS sequence (opt3) from DENV-2__FJ410215__SS-prME
  source 1..9876: mol_type = other RNA
agcgccggaatgatcattatgctgatacccaccgtgatggctttccacctcacaactagaaacggggaacctcatatgatcgtcggcattcaggaaaagggtaaatcccttctgtttaagacggaggacggcgttaatatgtgcaccttgatggcaatggatttaggggaactgtgtgaggacacaatcacttacaaatgcccacttctcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactgccgagtgccccaatacaaacagagcatggaatagtctggaagtggaggattacggatttggcgtgttcaccacaaacatctggctcaagctgaaagaaaagcaggacgcgttttgtgactctaagttaatgagcgctgccattaaagataatagggcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaaactcattaccgagtggtgctgtagatcctgcacactgccgcctcttaggtatcgcggagaggacggctgttggtacggtatggaaatacggccattgaaggagaaagaagagaatctggtgaactcattagttacggcggggcacggacaggtggataatttcagtctcggcgtactgggtatggccctttttctggaagagatgttgagaaccagggtcggcactaagcatgctatcctcctggtggcagtgagcttcgtcacactaattaccgggaacatgtcgtttaaagacctgggacgcgttgtggtaatggtgggcgccgctatggccgatgacatcgggatgggagtcacttatctcgcactgcttgcggccttcaaggtgcgacccacatttgctgccggcttgctgttacggaagctcacctccaaagagctgatgatgacgactattggtatcgttcttctgtctcaaagcaccatacctgaaacagtgctagagctcaccgatgcactggctttggggatgatggtcctgaagatcgtgcgtaatatggaaaaataccagttagccgttactattatggcaatcctctgcgtgcccaacgccgtcattctgcagaatgcttggaaggtatcatgtacaatccttgcggtggttagtgtgtccccactgttgctcacctctagccagcaaaagactgactggatacctctggccctaactattaagggactgaaccccaccgcaatcttccttacgacactctccagaaccaataaaaagaggtcatggccactgaacgaggctatcatggccgtcggcatggtgagcattttggccagttctctgttaaagaatgacataccgatgactggccctctcgtagctgggggactgcttaccgtgtgctatgtcctgacaggtcgctccgcagatttggaactcgagcgggccactgacgttaaatgggaggatcaggcggaaatcagcggctcgtcacccattctgtctatcaccattagtgaggacgggtccatgagcatcaagaacgaagaggaggaacagacgctaacaatactgatcagaaccggacttctcgtgatttctggcctgtttccaatcagcattcccatcactgctgccgcatggtacttgtgggaggtgaaaaagcagagggccggtgtcttatgggatgtgccttccccaccccctatggggaaagctgaactggaggacggagcatatcgaataaagcaaaagggcattctcggctactcacagatcggggccggagtttacaaagaaggtacattccacaccatgtggcatgtaactcgcggcgcggtgctgatgcacaaggggaaacggatcgagccgagttgggctgatgtcaagaaagaccttattagctatggaggcggttggaagctggagggggaatggaaggagggagaagaggtgcaggttttggccctagaaccaggcaaaaatcccagagcagtgcagacaaagcctggcctgtttaaaaccaacacggggactatcggagccgtctctctcgatttctccccaggtacctcaggcagtcccataattgacaagaaagggaaggtggtaggactgtacggcaacggtgtcgtgacaaggagcggggcttatgtttccgccatcgcacaaaccgagaagtctattgaggataatcctgaaatcgaggacgatatatttcgtaaacgccggcttacaattatggacttacacccgggagctggcaagactaaaagatacctgcccgccatcgtgagggaagcgatcaagcgaggcctccggaccttgattctggccccaacgcgcgtcgtggcagctgagatggaagaggccctcagagggctgcctatcaggtatcagacacccgctattcgggcagagcatactggacgagaaatagttgaccttatgtgtcacgccaccttcacaatgagactgttgtcgccagtgcgcgtccctaactacaatctaatcattatggatgaggcccatttcaccgaccccgctagcatcgcggcaaggggttatatctcaactcgtgtggaaatgggcgaggccgctgggatttttatgaccgccacaccaccgggatcccgggatcctttcccccagagtaacgcaccaataatcgacgaggaaagagagattcccgaaaggtcttggaatagcggccacgagtgggtaacggattttaaaggtaagactgtgtggttcgttccttccatcaaggccgggaacgacattgctgcgtgcctgcgcaaaaatggaaagaaagtcatccaactctcacgaaagacctttgattctgaatacgtgaaaacaagaaccaacgactgggatttcgtggtcactacagacataagcgagatgggcgccaattttaaggcagagcgggtaatcgatccaaggcgctgtatgaaacccgtgattttaaccgacggcgaagaacgtgttatcctggctgggcctatgccggtgacgcatagttccgccgcacagagacggggaaggattggtcgcaacccaaagaatgaaaacgaccagtacatctatatgggcgagccccttgaaaatgatgaggactgcgcccactggaaggaggctaaaatgctgctcgataacataaatactcctgaagggattatccccagcatgttcgagccagaacgagagaaggtcgacgccattgatggagaatacagattgcggggcgaggcgaggaaaacatttgtggacctgatgcgcagaggtgatctccctgtttggctggcatataaggtggccgctgaggggatcaactacgccgacaggcggtggtgtttcgatggcatcaaaaacaatcagatccttgaagagaacgtcgaagtggagatttggaccaaggagggagaacgtaagaaactaaagccccgctggctggacgctcgaatctattctgatccattggcattaaaagagtttaaggagttcgccgctggcagaaaatcactgaccctcaatctgattactgagatggggaggcttcctacattcatgacccaaaagacacgggacgccctggataacctcgcagtattgcacactgcggaagccggaggtcgcgcttacaatcatgccctgtccgagctaccggagacgctggaaaccctccttctgttaacattgctggcaactgtgaccggcgggatctttctcttcctgatgagtggaagaggcataggtaagatgacacttgggatgtgctgcattatcaccgctagcatcctgctctggtatgcccagattcagccccactggatcgcagcctcgataattttggagtttttcctgatcgttttactaattccagaacctgagaaacagaggactccccaagacaaccagctgacgtacgtcgtgatcgctatactcaccgtggtcgcggccacaatggcaaatgaaatgggctttcttgagaagactaaaaaggacttcggactgggctctatcgctacccagcagccagagtccaacattttggatatcgacctgcggcctgccagcgcctggacactctacgcagttgctaccacttttgtgacacccatgctgcgacattcaattgaaaatagttctgtaaacgtgtcccttacggccatcgcgaatcaagctaccgtcctcatggggctgggaaaaggttggccgttgagcaagatggatattggcgtgccactgttagccatcgggtgttattcacaggttaaccctataactctaacagcagccctgctccttctggtggctcactacgcaattatcggacccggcttgcaggccaaggcgaccagagaggctcagaaacgcgccgcagccggtatcatgaagaatccaaccgtcgacgggattacagtaatagatctggaccccatcccttatgatccgaaattcgaaaagcaactcggccaggtgatgctgcttattttatgcgttactcaggtgctgatgatgaggacgacctgggctctctgtgaggccttgacactggcaactggacccatcagtaccctatgggaaggcaacccagggcggttttggaatacaaccattgctgtcagcatggccaacatcttccgtggatcctacctggcgggcgccggtctcctattttctataatgaaaaatactacgaacacaagaagggggaccggaaacatcggcgagactctgggtgagaagtggaaaagccgcttgaatgcactgggcaagtccgagttccaaacctataagaaatcagggattcaggaggtggaccggacactcgctaaggaaggaatcaaacgaggcgagactgatcaccatgccgtctctagagggagtgcaaagctgaggtggtttgtggagcgcaacatggttacccctgaaggaaaagtggtagacttaggctgcggtagagggggatggtcgtactattgtggcggtcttaagaatgtgagagaggtcaagggcctgacaaaagggggacccggccacgaagaacctattccaatgagcacgtacgggtggaacctcgttcgtctacagtccggagtggatgtcttcttcataccccctgaaaagtgcgacaccctgttgtgtgatataggcgagtcttcaccaaatcccactgtggaggctggtaggacactgcgggtactcaaccttgtggaaaattggctgaacaataacacccagttttgcattaaagttttgaatccgtacatgcctagcgtgatcgagaagatggaagccctgcaacgcaaatatgggggagccctcgtccgaaacccattatccagaaatagtactcatgagatgtactgggtgtctaacgcgagcggcaatatcgtctcatccgtgaacatgattagtaggatgctgataaaccggttcacaatgcgccacaagaaggctacctatgaacccgacgttgaccttggcagcgggacgagaaatatcggaattgagtctgagatccctaacctggatattatcggtaaaaggatagaaaagatcaaacaggagcatgaaacctcctggcactacgaccaggatcacccatataagacatgggcataccatggctcatatgagactaaacagaccgggagcgcctcgtctatggtaaatggagtggtccgactactcacaaagccctgggacgtgctgccgactgttacccaaatggctatgacagataccactccttttggccagcagcgggtgttcaaggaaaaagtcgacacgcgtacacaggagcccaaggagggtaccaaaaagttgatgaaaattactgccgaatggctgtggaaggagctcgggaaaaagaagaccccaagaatgtgtacacgcgaagagtttacgaggaaagtgcggagtaacgcagcccttggagctatcttcaccgatgagaataagtggaaatccgcgagagaagccgtagaggacagccgcttttgggaactggtggataaggagaggaacttacacctggaaggcaaatgcgagacttgtgtttacaatatgatgggcaagcgagagaagaaattgggggagttcggaaaggcaaaaggttcacgggctatttggtacatgtggctcggcgccagatttctggagttcgaagcactagggtttcttaacgaggaccattggttctccagggaaaattctctgagcggagtcgagggcgagggtctccacaagctggggtatatcttgcgcgatgtgagtaaaaaggaaggaggcgccatgtacgctgacgacacagccggctgggatacccgtattactctggaggacctcaagaacgaagagatggtgacaaatcacatggaaggggagcataagaaacttgcggaggcaatatttaaactgacctatcaaaacaaagtcgttcgggtgcagagacctacacccaggggaactgtaatggatatcatttcccgccgagaccagcggggtagcggccaagtggggacctacggattaaatacgttcaccaacatggaagcccagctgatcagacagatggagggcgaaggtgtcttcaaaaatatccagcacttgacagtgactgaggaggttgctgtgcaaaactggctcgccagggtcgggcgcgaaagactgtctcggatggcaatttcaggagatgactgcgtggtaaagccactagatgacaggtttgctaacgcccttaccgctctgaatgatatgggcaagatacgtaaagacatccagcagtgggagcccagtaagggctggaacgattggacacaggttcctttctgctcccatcactttcatgaactcattatgaaagacgggcgagtgctggtcgtgccatgtcgcaatcaagatgagttgatcggacgggcccggattagccagggtgcaggctggtctttaagggaaactgcgtgcctggggaagtcgtatgcccagatgtggtcactcatgtacttccaccgcagagaccttcggctggctgccaacgcaatctgtagcgctgtgccgtcccactgggtccccaccagtaggacgacatggtctatacatgccaaacacgagtggatgaccactgaggacatgctaacagtttggaatcgagtgtggatccgtgaaaacccttggatggaggataagaccccagtagaaagctgggaggaaattccctatctgggaaagagagaggaccagtggtgcggctccctcatcggtttgacttcacgcgcaacctgggccaaaaatattcaagcggctatcaaccaggtgcggagtctgatagggaatgaggaatacacagattacatgccttctatgaagaggtttagacgcgaggaagaggaagccggagtcctttggtga

SEQ ID NO: 14804 - RNA, 9876 nt, synthetic construct
  misc_feature 1..9876: note = derived and/or modified CDS sequence (opt3) from DENV-2__FJ461309__SS-prME
  source 1..9876: mol_type = other RNA
agcgccggcatgatcattatgctgatacccaccgtgatggctttccacctcacaactagaaacggggagcctcatatgatcgtcggaattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagagcaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccaattaaagctgaattggttcaagaaagggtcttccattggacagatgtttgaaacgaccatgcggggtgccaagcgaatggctatactaggcgatacagcctgggacttcgggtcactcggaggcgtatttactagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacaatataaatttcagcccgagagtccaagcaagttggcctccgctatccagaaagcccaggaagagggcatatgtggtattagatctgtcactaggctcgagaatctgatgtggaagcaaatcacacccgaattaaaccacattctggcagagaatgaagttaaactaaccatcatgactggcgatataaaggggatcatgcaggccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaagacgcgttttgtgactctaagttaatgagcgctgccattaaggataatagggcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatcccaaaaaacctcgcaggacccgttagtcagcacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaagctcattaccgagtggtgctgtagatcctgcacactgccgcctcttaggtatcgcggagaggacggctgttggtacggtatggaaatacggccattgaaagagaaggaagagaatctggtgaactcattagttacggcggggcacggacaagtggataatttcagtctcggcgtactgggtatggccctttttctggaagagatgttgaaaaccagagtcggcactaagcatgctatcctcctggtggcagtgagcttcgtcacactaattaccgggaacatgtcgtttaaagacctgggaagggttgtggtaatggtgggcgccactatggctgatgacatcgggatgggagtcacatatctcgccctgcttgcagcgttcaaggtgcgccccacctttgccgctggcttgctgttacgaaagctcacgtccaaagagctgatgatgactaccattggtatcgttcttctgtctcagagcacaatacctgaaaccgtgctagagctcactgatgccctggcattggggatgatggtcctgaagatcgtgcggaatatggaaaaataccagttagctgttacaattatggccatcctctgcgtgcccaacgcagtcattctgcagaatgcctggaaggtatcatgtaccatccttgctgtggttagtgtgtccccactgttgctcacatctagccaacagaaaactgactggatacctctggcgctaaccattaagggactgaaccccacggccatcttccttacaaccctctcccgtactaataaaaagagatcatggccactgaacgaggcaatcatggctgtcggcatggtgagcattttggccagttctctgttaaagaatgacataccgatgaccggccctctcgtagccgggggactgcttacagtgtgctatgtcctgactggtaggtccgctgatttggaactcgagcgcgcaaccgacgttaaatgggaggatcaggccgaaatcagcggctcgtcacccattctgtctatcacgattagtgaggacgggtccatgagcatcaagaacgaagaggaggaacagacactaaccatactgatccggactggacttctcgtgatttctggcctgtttccaatcagcattcccatcacagcggctgcctggtacttgtgggaggtgaaaaagcaaagagcaggtgtcttatgggatgtgccttccccaccccctatggggaaagccgaactggaggacggagcttataggataaagcagaagggcattctcggctactcacagatcggggcaggagtttacaaagaaggtaccttccacactatgtggcatgtaacacgaggcgccgtgctgatgcacaaggggaaacgcatcgagccgagttgggcggatgtcaagaaagaccttattagctatggaggcggttggaagctggagggggaatggaaggagggagaagaggtgcaggttttggctctagaaccaggcaaaaatccccgggccgtgcaaaccaagcctggcctgtttaaaacgaacactgggaccatcggagcagtctctctcgatttctccccaggtacatcaggcagtcccataattgacaagaaagggaaggtggtaggactgtacggcaacggtgtcgtgaccagaagcggggcctatgtttccgctatcgcccagacagagaagtctattgaggataatcctgaaatcgaggacgatatatttaggaaacgtcgccttactattatggacttacacccgggagcaggcaagaccaaacggtacctgcccgctatcgtgagagaagccatcaagaggggcctccgaacgttgattctggcgccaacacgggtcgtggccgcagagatggaagaggctctccgcgggctgcctatcagatatcagactcccgccattagggctgagcataccggacgggaaatagttgaccttatgtgtcacgcaacattcaccatgcgactgttgtcgccagtgagagtccctaactacaatctaatcattatggatgaggcccatttcactgaccccgccagcatcgctgcgcgcggttatatctcaaccagggtggaaatgggcgaggcagccgggatttttatgacagctacgccaccgggatcccgtgatcctttcccccaaagtaacgccccaataatcgacgaggaacgggagattcccgaaagatcttggaatagcggccacgagtgggtaactgattttaaaggtaagaccgtgtggttcgttccttccatcaaggcagggaacgacattgccgcttgcctgaggaaaaatggaaagaaagtcatccagctctcacgcaagacatttgattctgaatacgtgaaaacccgaactaacgactgggatttcgtggtcacaaccgacataagcgagatgggcgcgaattttaaggccgagagagtaatcgatccacggaggtgtatgaaacccgtgattttaacggacggcgaagagcgcgttatcctggcagggcctatgccggtgactcatagttccgctgcccagcgtagaggacggattggtaggaacccaaagaatgaaaacgaccagtacatctatatgggcgagccccttgaaaatgatgaggactgcgcacactggaaggaggccaaaatgctgctcgataacataaatacacctgaagggattatccccagcatgttcgagccagaacgcgagaaggtcgacgctattgatggagaataccgattgagaggcgaggcccggaaaacctttgtggacctgatgaggcgcggtgatctccctgtttggctggcgtataaggtggcagccgaggggatcaactacgctgacagaaggtggtgtttcgatggcataaaaaacaatcaaatccttgaagagaacgtcgaagtggagatttggaccaaggagggagaacggaagaaactaaagccccgttggctggacgcccgcatctattctgatccattggctttaaaagagtttaaggaattcgcagccggccgaaaatcactgactctcaatctgattacagagatggggagacttcctaccttcatgacacagaagactagggacgctctggataacctcgccgtattgcacacggcagaagcgggaggtcgggcctacaatcatgctctgtccgagctaccggagaccctggaaacactccttctgttaactttgctggccaccgtgacaggcgggatctttctcttcctgatgagtggacgcggcataggtaagatgacccttgggatgtgctgcattatcactgcaagcatcctgctctggtatgctcagattcagccccactggatcgccgcatcgataattttggagtttttcctgatcgttttactaattccagaacctgagaaacaaagaacgccccaggacaaccagctgacctacgtcgtgatcgccatactcacagtggtcgctgcgactatggccaatgaaatgggctttcttgagaagaccaaaaaggacctgggattgggctctatcgcaacacagcaaccagagtccaacattctggatatcgacctcaggcctgctagcgcctggaccctgtacgccgttgcaactacattcgtgacgcccatgcttcggcattcaattgaaaatagttctgtaaacgtgtccctcaccgctatcgccaatcaggcgactgtcctgatggggttgggaaaaggttggccgctgagcaagatggatattggcgtgccattactagctatcgggtgttattcacaggttaaccctataacactgaccgccgcactccttctgttggtggcccactacgctattatcggacccggcctgcaggcaaaggccacccgagaggcgcaaaaaagagctgccgcaggtatcatgaagaatccaacagtcgacgggattactgtaatagatctcgaccccatcccttatgatccgaaatttgaaaagcagctgggccaggtgatgcttttaattctgtgcgttacgcaagtgctcatgatgcgcaccacatgggccttgtgtgaggctctgactctagccaccggacccatcagtacactgtgggaaggcaacccagggaggttctggaataccactattgcagtcagcatggctaacatctttcggggatcctacctcgccggcgcgggtcttctgttctctataatgaaaaatacgacaaacacccgtagagggactggaaacatgggcgagaccttgggtgagaagtggaaaagcaggctgaatgccctcggcaagtccgaatttcagatctataagaaatcagggattcaggaggtggaccgcacactggcaaaggaaggaatcaaacggggcgagactgatcaccatgctgtctctcgagggagtgccaagttaagatggttcgtggagaggaacatggttacccctgaaggaaaagtggtagaccttggctgcggtcgcgggggatggtcgtactattgtggcggtctgaagaatgtgcgggaggtcaagggcctcacaaaagggggacccggccacgaagagcctattccaatgagcacgtacgggtggaacctagttagactgcagtccggagtggatgtctttttcatcccccctgaaaagtgcgacaccttgctgtgtgatataggcgagtcttcaccaaatcccactgtggaggcaggtcgtacactcagggtacttaacctggtggaaaattggttgaacaataacacccaattctgcattaaagttctgaatccgtacatgcctagcgtgatcgagaagatggaagctctccagcggaaatatgggggagccttagtccgcaacccactgtcccgaaatagtactcatgagatgtactgggtgtctaacgccagcggcaatatcgtctcatccgtgaacatgattagtagaatgcttataaacaggtttacaatgcggcacaagaaggcgacctatgaacccgacgttgacctgggcagcgggacgcgcaatatcggaattgagtctgagatccctaacctagatattatcggtaaaagaatagaaaagatcaaacaggagcatgaaacctcctggcactacgaccaggatcacccatataagacatgggcttaccatggctcatatgagactaaacaaaccgggagcgcatcgtctatggtaaatggagtggtcaggctcctgacaaagccctgggacgtgttgccgactgttacccagatggccatgacagataccactcctttcggccagcagcgagtgtttaaggaaaaagtcgacacgcggacacaagagcccaaggagggtaccaaaaagctgatgaaaattactgctgaatggctctggaaggagcttgggaaaaagaagaccccacgtatgtgtacaagagaagagttcacgcgcaaagtgaggagtaacgccgcactgggagccatctttaccgatgagaataagtggaaatccgctcgggaagcggtagaggacggcagattctgggaattagtggataaggagcgcaacctgcacttggaaggcaaatgcgagacttgtgtttacaatatgatggggaagagggagaagaaactcggagaatttggtaaggccaaaggcagccgagcaatttggtacatgtggctgggggctcggttcctagagtttgaagcccttggattcctgaacgaggaccattggttttcaagagaaaattccctctctggcgtcgagggtgaggggctgcacaagttgggatatatcctgagggatgtgagcaaaaaggaaggcggcgcaatgtacgccgacgacacagctgggtgggatacccgcattactctcgaggaccttaagaacgaagagatggtgacaaatcacatggaaggagagcataaaaagctggccgaggcgatattcaaattaacctatcagaacaaggtcgttcgtgtgcagcggcctacacccagaggtactgtaatggatatcattagtaggcgcgaccaacgaggctccgggcaggtgggaacctacggcctgaatacgtttaccaacatggaagcacagttgatccggcagatggagggtgaaggggtcttcaaaaatatccaacacctcacagtgactgaggaggttgccgtgcagaactggctggctagagtcggaagggaacgcctaagcagaatggccatttctggcgatgactgcgtggtaaagccacttgatgaccggttcgcaaacgctctgaccgccctcaatgatatgggcaagataaggaaagacatccagcagtgggagccctcaaaggggtggaacgattggacacaagttcctttttgcagtcatcacttccatgaactgattatgaaagacggacgtgtgttggtcgtgccatgtcgaaatcaggatgagttaatcggtcgcgctagaatttcccagggcgccgggtggagcctgcgggaaactgcatgcctcggaaagtcttatgcgcagatgtggtcgcttatgtactttcacaggcgcgacctgagactagccgctaacgccatctgttcagcagtgccgagccactgggtccccacctcccggacgacatggagtatacatgctaaacacgagtggatgaccactgaggacatgctgacagtttggaatagggtgtggatccgagaaaacccttggatggaggataagaccccagtagaatcttgggaggaaattccctatctcggcaagcgtgaggaccaatggtgcggtagcttgatcgggctgacttccagagccacctgggcaaaaaatattcaggccgcgatcaaccaggtgcgctcacttataggaaatgaggaatacacagattacatgcctagtatgaagcggttcaggagagaggaagaggaagctggcgtcctgtggtga

SEQ ID NO: 14805 - RNA, 9876 nt, synthetic construct
  misc_feature 1..9876: note = derived and/or modified CDS sequence (opt3) from DENV-2__FJ461311__SS-prME
  source 1..9876: mol_type = other RNA
agcgccggaatgatcattatgctgataccaaccgtgatggctttccacctcactactcggaacggggagcctcatatgatcgtcggcattcaggaaaagggtaaatcccttctgtttaagacggaggacggagttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtggccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccaattaaagctgaattggttcaagaaagggtcttccattggacagatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacaatataaatttcagcccgagagtccaagcaagttggcctccgctatccagaaagcccaggaagagggcatatgtggtattagatctgtcactaggctcgagaatctgatgtggaagcaaatcacacccgaattaaaccacattctggcagagaatgaagttaaactaaccatcatgactggcgatataaaggggatcatgcaggccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaagacgcgttttgtgactctaagttaatgagcgctgccattaaggataatagggcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatccccaagaacctcgcaggacccgttagtcagcacaattaccgtcctggctaccacacgcagattgctggtccatggcatctgggcaagctagagatggacttcaacttttgtgatgggacaaccgtgatcgtcactgaagactgcggaaatcggggccccagcctgcgaaccacaactgcctctgggaagctcattaccgagtggtgctgtagatcctgcacactgccgcctcttaggtatcgcggagaggatggctgttggtacggtatggaaatacggccattgaaagagaaggaagagaacctggtaaattcattagttacggcggggcacggacaagtggacaacttcagtctcggcgtactgggtatggccctttttctggaagagatgttgagaaccagggtcggcactaaacatgctatcctcctggtggcagtgagcttcgtcacactaattaccgggaatatgtcgtttaaggatctgggacgcgttgtggtaatggtgggcgccactatgacagacgatatcgggatgggagtcacctatctcgctctgcttgccgcattcaaagtgcgacccacgtttgcggccggcttgctgttacggaagctcacttccaaggagctgatgatgaccacaattggtatcgttcttctgtctcagagcaccatacctgaaactgtgctagagctcacagacgctctggccttggggatgatggtcctgaaaatcgtgcgtaacatggaaaagtaccagttagcagttaccattatggctatcctctgcgtgcccaatgccgtcattctgcagaacgcatggaaagtatcatgtacaatccttgccgtggttagtgtgtccccactgttgctcacttctagccaacagaagaccgattggatacctctggctctaacgattaaaggactgaatcccacagcgatcttccttaccactctctccagaaccaacaagaaaaggtcatggccactgaatgaggccatcatggcagtcggcatggtgagcattttggctagttctctgttaaagaacgacataccgatgacaggccctctcgtagccgggggactgcttactgtgtgctatgtcctgaccggtcgctccgccgacttggaactcgagcgggctacggatgttaagtgggaggaccaggcagaaatcagcggctcgtcacccattctgtctatcacaattagtgaggatgggtccatgagcatcaaaaatgaagaggaggaacagaccctaactatactgatcagaacaggacttctcgtgatttctggcctgtttccaatcagcattcccatcaccgccgcggcttggtacttgtgggaggtgaagaaacaaagggccggtgtcttatgggacgtgccttccccaccccctatggggaaggcagaactggaggatggagcctatcgaataaaacagaagggcattctcggctactcacagatcggggctggagtttacaaggaaggtactttccacacaatgtggcatgtaacccgcggcgcagtgctgatgcacaaagggaagcggatcgagccgagttgggccgacgtcaaaaaggatcttattagctatggaggcggttggaaactggagggggaatggaaggagggagaagaggtgcaggttttggcgctagaaccaggcaagaaccccagagctgtgcaaacgaaacctggcctgtttaagactaacaccgggacaatcggagccgtctctctcgacttctccccaggtacctcaggcagtcccataattgataaaaaggggaaagtggtaggactgtacggcaatggtgtcgtgacaaggagcggggcatatgtttccgccatcgctcagactgagaagtctattgaggacaaccctgaaatcgaggatgacatatttcgtaagcgccggcttaccattatggatttacacccgggagccggcaaaacgaagagatacctgcccgcaatcgtgagggaagctatcaaacgaggcctccggacattgattctggccccaactcgcgtcgtggcggccgagatggaagaggcactcagagggctgcctatcaggtatcagacccccgctattcgggccgagcatacaggacgagaaatagttgaccttatgtgtcacgctaccttcactatgagactgttgtcgccagtgcgcgtccctaattacaacctaatcattatggacgaggcacatttcaccgatcccgccagcatcgccgctaggggttatatctcaacacgtgtggaaatgggcgaggcggcagggatttttatgacggccactccaccgggatcccgggaccctttcccccaaagtaatgctccaataatcgatgaggaaagagagattcccgaaaggtcttggaacagcggccacgagtgggtaaccgactttaagggtaaaacagtgtggttcgttccttccatcaaggccgggaatgatattgcagcctgcctgcgcaagaacggcaagaaggtcatccagctctcacgaaaaacctttgactctgaatacgtgaagactagaacaaatgattgggacttcgtggtcaccacggatataagcgagatgggcgctaactttaaagcggagcgggtaatcgacccaaggcgctgtatgaagcccgtgattttaactgatggcgaagaacgtgttatcctggccgggcctatgccggtgacacatagttccgcagctcagagacggggaaggattggtcgcaatcccaaaaacgaaaatgaccagtacatctatatgggcgagccccttgaaaacgacgaggattgcgcccactggaaggaggcaaagatgctgctcgacaatataaacacccctgaagggattatccccagcatgttcgagccagaacgagagaaagtcgatgccattgacggagaatacagattgcggggcgaggctaggaagacctttgtggatctgatgcgcagaggtgacctccctgtttggctggcctataaagtggcggcagaggggatcaactacgccgataggcggtggtgtttcgacggcataaagaataaccaaatccttgaagagaatatggaagtcgagatttggactaaagagggagaacgtaagaagctaaaaccccgctggctggatgctcgaatctattctgacccattggccttaaaggagtttaaagagttcgctgcaggcagaaagtcactgacactcaacctgattaccgagatggggaggcttcctacattcatgactcagaaaacgcgggatgccctggacaatctcgctgtgttgcacaccgccgaagcaggaggtcgcgcgtacaaccatgccctgtccgagctaccggagacactggaaactctccttctgttaaccttgctggctacagtaaccggcgggatctttctcttcctgatgagtggaagaggcataggtaagatgactcttgggatgtgctgcattatcacggccagcatcctgctctggtatgcacagattcagccccactggatcgctgcctcgataattttggagtttttcctgatcgtgttactaattccagaacctgagaagcaaaggaccccacaggataatcagctgacatacgttgtcatcgcaatactcactgtggtggccgctaccatggcgaacgaaatgggctttcttgagaaaacaaagaaagacctgggattgggctctatcgccacccggcagccagagtccaatattctggacatcgatctccgacctgcaagcgcttggactctgtacgccgtcgccacaacgttcgttacccccatgcttagacattcaattgaaaacagttctgtgaatgtatccctcactgcaatcgctaaccaagccacagtgctgatggggttgggaaagggttggccgctgagcaaaatggacattggcgtcccattactagcgatcgggtgttattcacaggtgaatcctataaccctgaccgctgccctccttctgttggttgcacactacgccattatcggacccggcctgcaggctaaggcaacacgcgaggcccagaagagggcggctgccggtatcatgaaaaacccaactgtggatgggattacggtcatagacctcgatcccatcccttatgacccgaagtttgaaaaacaactgggccaggtaatgcttttagtgctgtgcgttacccaggtgctcatgatgcggacaacttgggcattgtgtgaggccctgaccctagctacaggacccattagtaccctgtgggaaggcaatccagggcgtttctggaacactacgatcgccgtcagcatggcaaatatttttagaggatcctacctcgctggcgccggtcttctgttctctatcatgaagaacacaaccaacactaggcgcgggaccggaaatatgggcgagacattgggtgagaaatggaaaagccaactgaacgcgctcggcaaatccgaatttcagatatataagaagtcagggatccaggaggtggatcggactctggccaaagaaggaattaagcgaggcgagaccgaccaccatgcagtctctagagggagtgctaaattaaggtggttcgtggagcgcaatatggttacacctgaaggaaaggtggtagatcttggctgcggtagagggggatggtcgtactattgtggcggtctgaaaaacgtgagagaggtcaagggcctcacgaaagggggacccggccacgaggaacctatcccaatgagcacctacgggtggaatctagttcgtctgcagtccggagtggacgtctttttcattccccctgaaaaatgcgatactttgctgtgtgacatcggcgagtcttcaccaaaccccacagtggaggccggtaggaccctccgggtacttaatctggtggaaaactggttgaataacaatactcaattctgcataaaggttctgaacccgtacatgcctagcgtgattgagaaaatggaagcactccagcgcaagtatgggggagctttagtccgaaatccactgtccagaaacagtacacatgagatgtactgggtgtctaatgccagcggcaacatcgtctcatccgtgaacatgatcagtaggatgcttattaatcggtttaccatgcgccacaaaaaggccacgtatgaacccgatgttgacctgggcagcgggaccagaaacataggaatcgagtctgagattcctaatctagacatcattggtaagaggatcgagaaaataaagcaggagcatgaaacatcctggcactacgatcaggaccacccatataaaacttgggcgtaccatggctcatatgagaccaagcaaacagggagcgcttcgtctatggtaaacggagtggtccgactcctgactaaaccctgggatgtgttgccgaccgttacacagatggcaatgaccgacactacgcctttcggccagcagcgggtgtttaaggaaaaggtcgatacacgtacccaagagcccaaagagggtactaagaaactgatgaagatcaccgccgaatggctctggaaagagcttgggaagaaaaagacaccaagaatgtgtacgcgcgaagagttcaccaggaaggtgcggagtaatgctgccctgggagcaatttttactgacgagaacaaatggaagtccgccagagaagctgtagaggatagccgcttctgggaattagtggacaaagagaggaatctgcacttggaaggcaagtgcgagacatgtgtttacaacatgatgggcaaacgagagaagaagctcggggaatttggaaaagcgaagggttcacgggccatctggtacatgtggctgggcgcaagattcctagagtttgaagctcttgggttcctgaatgaggatcattggttttccagggaaaactctctcagcggagtcgagggcgagggtctgcacaaattggggtatattctgcgcgacgtgagtaagaaagaaggaggcgccatgtacgcagatgacaccgccggctgggacactcgtatcacactcgaggatcttaagaatgaagagatggtgaccaaccacatggaaggggagcataagaaactggctgaggccattttcaagttaacatatcagaataaagtcgttcgggtgcagagacctactcccaggggaaccgtaatggacataatctcccgccgagatcaacggggtagcggccaggtggggacgtacggactgaacacctttacaaatatggaagcgcagttgattagacagatggagggcgaaggtgtcttcaagaacatccaacacctcactgtgaccgaggaggttgcagtgaaaaactggctggccagggtcgggcgcgaaagactatctcggatggctatctcaggagacgattgcgtggtaaagccacttgacgataggttcgccaatgcactgacagctctcaacgacatgggcaagattcgtaaagatatacagcagtgggagcccagtaagggctggaatgactggactcaggttcctttttgctcccatcacttccatgaactgatcatgaaagatgggcgagtgttggtcgtgccatgtcgcaaccaagacgagttaattggtagagcccggatcagccagggagctggctggtctctgagggaaaccgcctgcctcgggaagtcgtatgcacagatgtggtcacttatgtactttcaccgcagagatctgcggctagcggccaatgctatttgtagcgccgtgccgtcccactgggtccccacgagtaggacaacctggtctatccatgcaaaacacgagtggatgactacagaggacatgctgaccgtttggaaccgagtgtggatacgtgaaaatccttggatggaggacaagactccagtagaaagctgggaggaaatcccctatctcggaaagagagaggatcagtggtgcggctccttgattggtctgacctcacgcgctacatgggccaaaaacatccaagcagccattaatcaggtgcggagtcttatcgggaacgaggaatacacggactacatgccttctatgaagaggttcagacgcgaggaagaggaagcgggagtcctgtggtga

SEQ ID NO: 14806 - RNA, 9876 nt, synthetic construct
  misc_feature 1..9876: note = derived and/or modified CDS sequence (opt3) from DENV-2__FJ410217__SS-prME
  source 1..9876: mol_type = other RNA
agcgcaggaatgatcattatgctgataccaaccgtgatggctttccacctcacaactagaaacggggaacctcatatgatcgtcggcattcaggaaaagggtaaatcccttctgtttaagacggaagacggagttaatatgtgcaccttgatggcaatggatttaggggaactgtgtgaagacacaatcacttacaaatgcccacttctcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtatcgtctcttggaagaataaggagctgaaatgcgggtcaggaattttcgtgacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcacataaccagaccttcttgattgacgggccggagactgccgagtgccccaatacaaacagagcatggaatagtctggaagtggaggattatggatttggcgtgttcaccacaaacatctggctcaggctgaaggaaaaacaggacgcgttttgtgactctaagttaatgagcgctgccattaaggataatcgtgcagtacacgccgacatgggttactggatcgagtccgctctgaacgatacttggaaaatagagaaggcctcattcattgaagtcaaaaattgccattggcctaagagccacaccctttggtctaacggggtgttggagtccgaaatgatcatccccaagaacctcgcaggacccgttagtcaacacaattatcggcctggctaccatacgcagattgctggtccatggcacctgggcaagctagagatggacttcgatttttgtgacgggacaaccgtgatcgtcactgaagattgcggaaaccgaggccccagcctgagaaccacaactgcctctgggaagctcattaccgagtggtgctgtaggtcctgcacactgccgcctcttcgctaccggggagaggacggctgttggtatggtatggaaataagaccattgaaagagaaggaagagaatctggtgaactcattagttacggcggggcatggacaggtggataatttcagtctcggcgtactgggtatggccctttttctggaagagatgttgaggacccgcgtcggcactaaacacgctatcctcctggtggcagtgagcttcgtcacactaattaccgggaacatgtcgtttaaggacctgggacgagttgtggtaatggtgggcgccactatggctgatgacatcgggatgggagtcacatacctcgccctgcttgcagcgttcaaagtgcggcccacctttgccgctggcttgctgttacgtaagctcacgtccaaggagctgatgatgactaccattggtatcgttcttctgtctcaaagcacaatacctgaaaccgtgctagagctcactgatgccctggcattggggatgatggtcctgaaaatcgtgagaaatatggaaaagtatcagttagctgttacaattatggccatcctctgcgtgcccaacgcagtcattctgcagaatgcctggaaagtatcatgtaccatccttgctgtggttagtgtgtccccactgttgctcacatctagccagcaaaagactgactggatacctctggcgctaaccattaaaggactgaaccccacggccatcttccttacaaccctctccaggactaataagaaacgctcatggccactgaacgaggcaatcatggctgtcggcatggtgagcattttggccagttctctgttaaagaatgacataccgatgaccggccctctcgtagccgggggactgcttacagtgtgctacgtcctgactggtcggtccgctgatttggaactcgagagagcaaccgacgttaagtgggaggatcaggccgaaatcagcggctcgtcacccattctgtctatcacgattagtgaggacgggtccatgagcatcaaaaacgaagaggaggaacagacactaaccatactgatcaggactggacttctcgtgatttctggcctgtttccaatcagcattcccatcacagcggctgcctggtatttgtgggaggtgaagaaacagcgagccggtgtcttatgggatgtgccttccccaccccctatggggaaggccgaactggaggacggagcttaccgcataaaacaaaagggcattttcggctattcacagatcggggcaggagtttacaaggaaggtacctttcatactatgtggcacgtaacacggggcgccgtgctcatgcacaaagggaagagaatcgagccgagttgggcggatgtcaaaaaggacctgattagctacggaggcggttggaaacttgagggggaatggaaggagggagaagaggtgcaggttctggctttggaaccaggcaagaatcccagggccgtgcagaccaaacctggcctattcaagacgaacactgggaccatcggagcagtctctctggatttttccccaggtacatcaggcagtcccataattgacaaaaaggggaaagtggtaggactctatggcaacggtgtcgtgacccgtagcggggcctacgtttccgctatcgcccaaacagagaagtctattgaggataatcctgaaatcgaggacgatatattccgcaagcggagactgactattatggaccttcatccgggagcaggcaaaaccaagaggtatttacccgctatcgtgcgagaagccatcaaacggggcctgcgcacgctcattttggcgccaacaagagtcgtggccgcagagatggaagaggctctgagggggctccctatccggtaccagactcccgccattcgagctgagcacaccggaagagaaatagttgacctgatgtgtcatgcaacattcaccatgcgccttctgtcgccagtgagggtccctaactataatttgatcattatggatgaggcccactttactgaccccgccagcatcgctgcgcgtggttacatctcaacccgggtggaaatgggcgaggcagccgggattttcatgacagctacgccaccgggatccagagatccttttccccagagtaacgccccaataatcgacgaggaaagggagattcccgaacgctcttggaatagcggccatgagtgggtaactgatttcaagggtaaaaccgtgtggtttgttccttccatcaaggcagggaacgacattgccgcttgcctacgaaagaatggcaagaaggtcatccaactgtcaagaaaaacattcgattctgaatatgtgaagacccggactaacgactgggattttgtggtcacaaccgacataagcgagatgggcgcgaatttcaaagccgagagggtaatcgatccacgccgttgtatgaagcccgtgattctcgcagacggcgaagagagagttatcttagctgggcctatgccggtgacgcacagttccgccgcacagcggaggggacgcattggtcgaaaccccaagaatgaaaacgaccagtacatctacatgggcgagcccctggaaaatgatgaggactgcgcccactggaaggaggctaagatgcttctggataacataaatactcctgaagggattatccccagcatgtttgagccagaaagagagaaagtcgacgccattgatggagaatatcggctcaggggcgaggcgcgcaagacattcgtggacttgatgagaaggggtgatctgcctgtttggctcgcatacaaagtggccgctgaggggatcaactatgccgaccggcgttggtgttttgatggcataaagaacaatcagatcctggaagagaacgtcgaagtggagatttggaccaaagagggagaacgcaagaaacttaaaccccgatggctagacgctagaatctactctgatccactggcattgaaggagttcaaagagttcgccgctggcaggaagtcattaaccctgaatctcattactgagatggggcggctgcctacatttatgacccagaaaactcgcgacgcccttgataacctggcagtactccatactgcggaagccggaggtagagcttataatcacgccttgtccgagctgccggagacgctagaaaccctgctccttctgacattattggcaactgtgaccggcgggatcttcctgtttctcatgagtggaaggggcataggtaagatgacactggggatgtgctgcattatcaccgctagcatccttctgtggtacgcccaaattcagccccattggatcgcagcctcgataattctcgagttctttttgatcgttctgttaattccagaacctgagaagcagcggactccccaagacaaccagctaacgtatgtcgtgatcgctatactgaccgtggtcgcggccacaatggcaaatgaaatgggcttcctcgagaaaactaagaaagaccttggactgggctctatcgctacccagcagccagagtccaacattttggatatcgacctgcgacctgccagcgcctggacactctacgcagttgctaccacttttgtgacacccatgctgagacactcaattgaaaatagttctgtaaacgtgtcccttacggccatcgcgaatcaagctaccgtcctcatggggctgggaaagggttggccgttgagcaaaatggatattggcgtgccactgttagccatcgggtgttactcacaggttaaccctataactctaacagcagccctgctccttctggtggctcactatgcaattatcggacccggcttgcaggccaaggcgacccgcgaggctcagaagagggccgcagccggtatcatgaaaaatccaaccgtcgacgggattacagtaatagatctggaccccatcccttacgatccgaagttcgaaaaacaactcggccaggtgatgctgcttattttatgcgttactcaggtgctgatgatgcggacgacctgggctctctgtgaggccttgacactggcaactggacccatcagtaccctatgggaaggcaacccagggcgtttttggaatacaaccattgctgtcagcatggccaacatcttcagaggatcctatctggcgggcgccggtctcctattttctataatgaagaatactacgaacgcaaggcgcgggacaggaaacatgggcgagaccctgggtgagaaatggaaaagccggttgaatgctctgggcaaatccgagttccaaatctacaagaagtcagggattcaggaggtggaccgaactctcgccaaagaaggaatcaagagaggcgagaccgatcatcacgcagtctctagggggagtgctaaactgcgctggtttgtggagcggaacatggttacacctgaaggaaaggtggtagacttaggctgcggtagagggggatggtcgtattactgtggcggtcttaaaaatgtgcgtgaggtcaagggcctgactaaagggggacccggccatgaagaacctattccaatgagcacctatgggtggaacctcgttaggctacagtccggagtggatgtcttcttcatcccacctgaaaaatgcgacacactgttgtgtgatataggcgagtcttcaccaaatcccacggtggaggccggtcggaccctgcgcgtactcaaccttgtggaaaattggctgaacaataacactcagttttgcattaaggttttgaatccgtacatgcctagcgtgatcgagaaaatggaagccctgcaacgaaagtacgggggagcgctcgtcagaaacccattatccaggaatagtacacacgagatgtattgggtgtctaacgctagcggcaatatcgtctcatccgtgaacatgattagtcggatgctgataaaccgcttcaccatgagacataaaaaggcaacttacgaacccgacgttgaccttggcagcgggacaaggaatatcggaattgagtctgagatccctaacctggatattatcggtaagcgaatagagaaaatcaagcaggagcacgaaacctcctggcactatgaccaggatcatccatacaaaacgtgggcctatcacggctcatacgagaccaagcagacagggagcgcttcgtctatggtaaatggagtggtccggctactcactaaaccctgggacgtgctgccgaccgttacacaaatggccatgactgataccacaccttttggccagcagcgtgtgttcaaggaaaaggtcgacaccagaactcaggagcccaaagagggtacgaagaaattgatgaagattacagcagaatggctgtggaaagagctcgggaagaaaaagaccccacgcatgtgtactagggaagagtttacccggaaggtgagaagtaacgccgctcttggagcgatcttcacagatgagaataaatggaagtccgcccgcgaagcagtagaggacagcaggttttgggaactggtggataaagagcgaaacttacatctggaaggcaagtgcgagacgtgtgtttataatatgatgggcaaacgggagaagaagttgggggagttcggaaaagctaagggttcaagagccatttggtacatgtggctcggcgcaaggtttctggagttcgaagccctagggtttcttaacgaggaccactggttctcccgcgaaaattctctgagcggagtcgagggcgagggtctccacaaactggggtacatcttgcgtgatgtgagtaagaaagaaggaggcgctatgtatgccgacgacaccgcgggctgggatactcggattacactggaggacctcaagaacgaagagatggtgaccaatcatatggaaggggagcacaagaaacttgcagaggccatatttaagctgacttaccaaaacaaagtcgttagagtgcagaggcctacaccccgcggaaccgtaatggatatcatttcccgacgggaccagagaggtagcggccaagtggggacatatggattaaatactttcaccaacatggaagctcagctgatcaggcagatggagggcgaaggtgtcttcaagaatatccagcatttgacggtgaccgaggaggttgccgtgcaaaactggctcgcacgcgtcgggagagaacggctgtctaggatggctatttcaggagatgactgcgtggtaaaaccactagatgaccgttttgccaacgctcttacagccctgaatgatatgggcaagatacgaaaggacatccagcagtgggagcccagtaaaggctggaacgattggactcaggttcctttctgctcccaccattttcacgaactcattatgaaggacgggcgcgtgctggtcgtgccatgtagaaatcaagatgagttgatcggacgggcaaggattagccagggtgcgggctggtctttacgcgaaaccgcctgcctggggaaatcgtacgctcagatgtggtcactcatgtatttccacagacgggaccttaggctggccgcaaacgctatctgtagcgccgtgccgtcccattgggtccccacaagtcgaactacctggtctatacacgcaaagcatgagtggatgacgacagaggacatgctaaccgtttggaatcgtgtgtggatcagagaaaacccttggatggaggataaaactccagtagaaagctgggaggaaattccctacctgggaaagcgcgaggaccagtggtgcggctccctcatcggtttgacatcacgggccacctgggcgaagaatattcaagctgccatcaaccaggtgaggagtctgatagggaatgaggaatatactgattacatgccttctatgaaaagatttcgccgggaggaagaggaagcaggagtcctttggtga

SEQ ID NO: 14807 - RNA, 9876 nt, synthetic construct
  misc_feature 1..9876: note = derived and/or modified CDS sequence (opt3) from DENV-2__FJ410219__SS-prME
  source 1..9876: mol_type = other RNA
agcgccggaatgataattatgctgataccaaccgtgatggctttccacctcacaactagaaacggggaacctcatatgatcgtcggcattcaggaaaagggtaaatcccttctgtttaagacggaggacggagttaatatgtgcaccttgatggctatggatttaggggaactgtgtgaggacacaatcacttacaaatgcccactactcaggcaaaacgaaccggaggatattgactgttggtgcaattctacctcaacatgggtgacctatggaacttgtacaaccacgggagagcaccggcgcgaaaagcgaagtgtagccctggtgccacatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatactaatgtcaagcggaaatctgctctttactggtcatctgaagtgccggcttcgtatggacaaactgcaattgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacctcgaaaagagatacgtgctggggaggttaattactgtcaacccgatagtgaccgagaaagatagccctgttaacatcgaagctgagcccccatttggcgactcgtacattatcatcggagtggagcctggccagctgaagctaaattggttcaagaaagggtcttccattggacaaatgtttgaaacgaccatgcggggtgccaagcgaatggctatactcggcgatacagcctgggacttcgggtcactgggaggcgtatttacaagtatcggtaaagcacttcatcaggtcttcggggccatttatggcgctgcgtttagcggagtgtcctggaccatgaagatcttgattggcgttatcataacatggatcgggatgaactctcgcagcacttcactgagtgtgtccctcgtcctggtgggaattgtaaccctttacctgggcgtgatggttcaggcagatagcggttgtgtcgtgtcttggaaaaataaggagttgaagtgcgggtcaggaatcttcattacggacaacgtgcacacatggaccgaacagtataaatttcaacccgagagtccaagcaagctcgcctccgctatccagaaagcccaggaagagggcatatgtggtattagatctgtcactaggctggagaatttaatgtggaagcagatcacacccgaactgaaccacattctagcagagaatgaagttaaactcaccatcatgactggcgatataaaggggatcatgcaagccggaaaacggttcctgcgccctcagccaaccgagcttaagtactcgtggaagacatggggcaaagctaagatgttgagcacggaatcctataaccagacctttctgattgacgggccggagactgccgagtgccccaatacaaacagagcatggaactcactcgaagtggaggattacggattcggcgtgtttaccacaaacatctggctgaaattaaaggaaaaacaggacgcgttctgtgacagtaagctgatgtctgctgccattaaggataatagggcagtacatgccgacatgggttattggatcgagagcgctcttaacgatacttggaaaatagagaaggcctccttcattgaagtcaaaaattgccactggcctaagtcacataccttgtggagcaacggggtgctcgagtctgaaatgatcatccccaagaatctggcaggacccgtttcccaacacaattaccgtcctggctaccacacgcagattgctggtccatggcatctaggcaagctggagatggactttgatttctgtgacgggacaaccgtgatcgtcactgaagattgcggaaaccggggccccagtctccgaaccacaactgccagcgggaagctgattaccgagtggtgctgtagatcttgcacacttccgcctttgaggtatcgcggagaggacggctgttggtacggtatggaaatacggccactgaaagagaaggaagagaatttagtgaactccctcgttacggcggggcacggacaggtggataatttttcactgggcgtacttggtatggccctgttcttggaagagatgctcagaaccagggtcggcatgaaacatgctatcctgctagtggcagtgagttttgtcactctgattacagggaacatgagcttcaaggacctcggacgcgttgtggtaatggtgggcgccaccatgactgatgacatcgggatgggagtcacatatctggctcttttggccgcatttaaagtgcgacccaccttcgcggccggcctgttactccggaagctgacgtcgaaggagcttatgatgattactatcggtatagttctgctatcccaatctaccatccctgaaacagtgctcgagctgaccgatgctttggccctggggatgatggtcttaaaaattgtgcgtaatatggaaaagtaccagctcgcagttactatcatggctattctgtgcgtgcccaacgccgtcatccttcagaatgcatggaaagtaagctgtacaatactggccgtggtttcagtgagtccattgctcctgacctcctctcagcaaaagacagactggattcctctagctctgactatcaaaggacttaaccccaccgcgatctttctcacgacactgagcagaaccaataagaaaaggtcctggccattgaacgaggccattatggcagtcggcatggtgtcaatactggctagcagtttactcaagaatgacatcccgatgactggccctctggtagccgggggacttctgaccgtgtgctatgtcttgacaggtcgctctgccgatctcgaactggagcgggttactgacgtgaagtgggaggatcaggctgaaatttccggcagctcgcccatcctatcaattaccatctctgaggacgggagtatgtccatcaaaaatgaagaggaggaacagacgctgacaatccttattagaaccggactcctggtgatcagcggcttgttcccaatttctatccccataactgcagccgcgtggtacttatgggaggtcaagaaacagagggctggtgtgctgtgggatgttcctagcccaccccctatggggaaggccgaactcgaggacggagcatatcgaattaaacaaaagggcatcctgggctactcccagatcggggccggagtatacaaggaaggtacatttcacaccatgtggcatgtgactcgcggcgctgtccttatgcacaaagggaagcggattgagccgtcatgggcagatgtgaaaaaggacctgatcagttatggaggcggttggaaattggagggggaatggaaggagggagaagaggttcaggtgctagccctggaaccaggcaagaatcccagagcggtccagacaaaacctggcctcttcaagaccaacacggggactataggagctgtgagcctggatttttctccaggtacctccggctcacccattatcgacaaaaaggggaaagtagtcggactttacggcaacggtgtggttacaaggagtggggcctatgtgagcgcaattgcccaaaccgagaagtccatcgaggataatcctgaaatagaggacgatattttccgtaagcgccggttaacaatcatggacctgcacccgggagctggcaaaactaagagatacctccccgccatcgtcagggaagcaattaaacgaggcttgcggaccctgatcctcgctccaacgcgcgtggttgccgcggagatggaagaggccctgagagggcttcctattaggtatcagacacccgcaatacgggctgagcatactggacgagaaatcgtggacctgatgtgtcacgccaccttcacaatgagattgctatctccagtccgcgtgcctaactacaatctgattatcatggatgaggctcattttaccgaccccgcatcgatcgccgccaggggttatattagcactcgtgtagaaatgggcgaggctgcggggatattcatgaccgcaacaccaccgggatcacgggatccttttccccagtccaacgccccaatcattgacgaggaaagagagatccccgaaaggagttggaactctggccacgagtgggtgacggatttcaagggtaaaactgtttggtttgtccctagcattaaggctgggaacgacatcgccgcatgcctccgcaagaatggcaaaaaggtgatacaattatcccgaaaaaccttcgattcagaatacgtgaagacaagaaccaacgactgggattttgtcgtaactacagacatctctgagatgggcgccaatttcaaagctgagcgggtgattgatccaaggcgctgtatgaagcccgttatcctgaccgacggcgaagaacgtgtgattcttgcggggcctatgccggtcacgcatagcagtgccgcacagagacggggaaggatcggtcgcaaccccaaaaatgaaaacgaccagtacatatatatgggcgagcccctggaaaatgatgaggactgcgctcactggaaggaggccaagatgctcttggataacattaatactcctgaagggatcattccctccatgtttgagccagaacgagagaaagtggacgcaatcgatggagaatacagactgcggggcgaggccaggaagacattcgttgacctcatgcgcagaggtgatctgcctgtgtggcttgcttataaagtcgccgcggaggggataaactacgcagacaggcggtggtgttttgatggcatcaagaacaatcagattctagaagagaacgtggaagtagagatctggaccaaagagggagaacgtaagaagctgaaaccccgctggttggacgcccgaatttatagcgatccattagctctgaaggagttcaaagagttcgccgctggcagaaagtctctcaccctgaatcttatcactgagatggggaggctgcctacatttatgacccagaaaactcgggacgcactcgataacttggccgtgctgcacactgctgaagccggaggtcgcgcatacaatcatgcgctatcagagctgccggagacgctcgaaacccttctgttattgacactgctcgccactgttaccggcgggatattcctgtttcttatgtccggaagaggcattggtaagatgacactggggatgtgctgcatcatcaccgctagtattctcttgtggtatgcccaaatccagccccactggatagcagctagcattatcctggagttctttttaattgtcctactgatcccagaacctgagaagcagaggactccccaagacaaccagctcacgtacgtggtgatagccatccttaccgtcgttgcagccacaatggctaatgaaatgggcttcctggagaaaactaagaaagacttgggactgggctcgattgcgacccagcagccagagtctaacatcctcgatattgacctgcggcctgcctccgcatggacactttacgctgtggccaccacttttgtaacacccatgctccgacatagcatcgaaaattcaagtgtgaacgtctctctgacggccattgcaaatcaagctaccgtgttgatggggctgggaaagggttggccgttatccaaaatggatatcggcgttccactactggccatagggtgttatagccaggtgaaccctattactctcacagcggcacttctgttgctggtcgcccactacgcaatcatcggacccggcctccaggccaaggctaccagagaggcacagaagcgcgccgcggctggtattatgaaaaatccaaccgtagacgggataacagtgatcgatctggaccccattccttatgatccgaagttcgaaaaacaacttggccaggttatgttactgatcctctgcgtgactcaggtcttgatgatgaggacgacctgggccctgtgtgaggcactaacactggccactggacccatttcaaccctctgggaaggcaacccagggcggttttggaatacaaccatcgctgtgagtatggccaacatattccgtggaagctaccttgcaggcgctggtctgttgttttccatcatgaagaatactacgaacacaagaagggggaccggaaacatgggcgagactctgggtgagaaatggaagtctcgcctcaatgccctgggcaaaagcgagttccaaatttataagaagtccgggatccaggaggtcgaccggaccttagcgaaagaaggaattaagcgaggcgagacagatcaccatgccgtgtcaagagggtctgcaaaacttaggtggtttgttgagcgcaacatggtgactcctgaaggaaaggtagtggacctgggctgcggtagagggggatggagttactattgtggcggtctcaaaaatgtccgggaggttaagggcctaaccaaagggggacccggccacgaagaacctatcccaatgtcgacatacgggtggaacctggtgcgtttgcagagcggagtcgatgtgttcttcataccccctgaaaaatgcgacacgctgctctgtgatattggcgagtcctctccaaatcccaccgtagaggctggtaggactcttcgggtgctgaacttggttgaaaattggctgaacaataacacacagttttgcatcaaggtgctcaatccgtacatgccttcagtcatcgagaaaatggaagccttacaacgcaagtatgggggagcactggtgcgaaacccacttagcagaaattccacccatgagatgtactgggtcagtaacgcttctggcaatattgtgagctcagttaacatgatatccaggatgctgatcaaccggttcactatgcgccacaaaaaggccacatatgaacccgacgtagacctaggcagtgggaccagaaatattggaatcgagagcgagattcctaacctcgatatcataggtaagaggatcgagaaaattaagcaggagcatgaaacgtcttggcactacgaccaggatcacccatataaaacctgggcctaccatggctcctatgagacaaagcagactgggtcagcgagctcgatggtgaatggagtcgtgcgactgttgaccaaaccctgggacgttctgccgacagtgactcaaatggctatgaccgatacaaccccttttggccagcagcgggtcttcaaggaaaaggtggacactcgtacgcaggagcccaaagagggtacaaagaaactcatgaagatcaccgcagaatggctttggaaagagctggggaagaaaaagactccaagaatgtgtacccgcgaagagtttacaaggaaggtacggtctaacgccgctttaggagccattttcacggatgagaataaatggaagagtgcaagagaagccgtggaggactcccgcttttgggaactggttgataaagagaggaacttgcacctcgaaggcaagtgcgagacctgtgtctacaatatgatgggcaaacgagagaagaagctgggggagttcggaaaagctaagggtagccgggcgatctggtacatgtggctaggcgccagatttcttgagttcgaagcactggggtttctcaacgaggaccattggttctcaagggaaaattccctgtctggagtggagggcgagggtttgcacaaactggggtatattctccgcgatgtgagcaagaaagaaggaggcgctatgtacgccgacgacactgcaggctgggatacacgtataacccttgaggacctgaagaacgaagagatggtcactaatcacatggaaggggagcataagaaattagccgaggctatctttaagctgacatatcaaaacaaagttgtgcgggtacagagacctacccccaggggaacagtgatggatattatcagtcgccgagaccagcggggttccggccaagtcgggacttacggattgaataccttcacgaacatggaagcccagctcatcagacagatggagggcgaaggtgtgttcaagaatattcagcacctgaccgttacagaggaggtggcggtcaaaaactggctagcaagggtggggcgcgaaagacttagccggatggccatatctggagatgactgcgtagttaagccactggatgacaggtttgctaacgccctcactgcactgaatgatatgggcaagatccgtaaagacattcaacagtgggagccctcaaagggctggaacgattggacccaggtgcctttctgcagtcatcactttcatgaattgatcatgaaagacgggcgagtcttagtggtgccatgtcgcaatcaggatgagctgattggcagagctcggatctcccaaggtgccggctggagcctcagggaaacagcttgccttgggaagtcttatgcccagatgtggtcgctgatgtacttccaccgcagagacctacggctggcagcgaacgccatatgttcagctgtcccgagccactgggttcccacttccaggaccacgtggagtatccatgccaaacacgagtggatgacaaccgaggacatgctcactgtgtggaatcgagtatggattcgtgaaaacccttggatggaggataagacaccagtggaatcttgggaggaaatcccctatttgggaaagagagaggaccagtggtgcggcagcctgattggtcttacctcccgcgcaacttgggctaaaaatatccaggccgcaataaaccaagtccggtcactgattgggaatgaggaatacaccgattacatgcctagtatgaagaggtttagacgcgaggaagaggaagccggagtgctctggtga

SEQ ID NO: 14808 - RNA, 9876 nt, synthetic construct
  misc_feature 1..9876: note = derived and/or modified CDS sequence (opt3) from DENV-2__FJ461314__SS-prME
  source 1..9876: mol_type = other RNA
agcgccggaatgatcattatgctgataccaaccgtgatggctttccacctcactactcggaacggggagcctcatatgatcgtcggcattcaggaaaagggtaaatcccttctgtttaagacggaggacggagttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccaattaaagctgaattggttcaagaaagggtcttccattggacagatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggacccttaagatcttgattggcgttatcataacatggatcgggatgaactctcgcagcacttcactgagtgtgtccctcgtcctggtgggaattgtaaccctttacctgggcgtgatggttcaggcagatagcggttgtgtcgtgtcttggaaaaataaggagttgaagtgcgggtcaggaatcttcattacggacaacgtgcacacatggaccgaacaatataaatttcagcccgagagtccaagcaagctcgcctccgctatccagaaagcccaggaagagggcatatgtggtattagatctgtcactaggctggagaatttaatgtggaagcaaatcacacccgaactgaaccacattctagcagagaatgaagttaaactcaccatcatgactggcgatataaaggggatcatgcaggccggaaaacggtcgctgcgccctcagccaaccgagcttaagtacagctggaagacatggggcaaagctaagatgttgtccacggaatcatataaccagaccttcctgattgacgggccggagactgccgagtgccccaatacaaacagagcatggaatagtctcgaagtggaggattacggatttggcgtgttcaccacaaacatctggctgaaattaaaggaaaaacaagacgcgttttgtgactctaagctgatgagcgctgccattaaggataatagggcagtacatgccgacatgggttattggatcgagtccgctcttaacgatacttggaaaatagagaaggcctcattcattgaagtcaaaaattgccactggcctaagagccataccttgtggtctaacggggtgctcgagtccgaaatgatcatccccaagaacctggcaggacccgttagtcagcacaattaccgtcctggctaccacacgcagattgctggtccatggcatctaggcaagctggagatggacttcgatttttgtgacgggacaaccgtgatcgtcactgaagattgcggaaaccggggccccagcctccgaaccacaactgcctctgggaagctgattaccgagtggtgctgtagatcctgcacacttccgcctttgaggtatcgcggagaggacggctgttggtacggtatggaaatacggccactgaaagagaaggaagagaatttagtgaactcactcgttacggcggggcacggacaagtggataatttcagtctgggcgtacttggtatggccctgtttttggaagagatgctcagaaccagggtcggcactaaacatgctatcctgctagtggcagtgagcttcgtcacactgattaccgggaacatgtcgtttaaggacctcggacgcgttgtggtaatggtgggcgccactatggctgatgacatcgggatgggagtcacatatctggcccttttggcagcgttcaaagtgcgacccacctttgccgctggcctgttactccggaagctgacgtccaaggagcttatgatgactaccattggtatcgttctgctatctcagagcacaatacctgaaaccgtgctcgagctgactgatgccttggcactggggatgatggtcttaaaaatcgtgcgtaatatggaaaagtaccagctcgctgttacaattatggccatcctgtgcgtgcccaacgcagtcattcttcagaatgcctggaaagtatcatgtaccatcctggctgtggttagtgtgtccccattgctcctgacatctagccaacagaagactgactggatacctctagcgctgaccattaaaggacttaaccccacggccatcttcctcacaaccctgtccagaactaataagaaaaggtcatggccattgaacgaggcaatcatggctgtcggcatggtgagcattctggccagttctttactcaagaatgacataccgatgaccggccctctggtagccgggggacttctgacagtgtgctatgtcttgactggtcgctccgctgatctcgaactggagcgggcaaccgacgttaagtgggaggatcaggccgaaatcagcggctcgtcacccattctatctatcacgattagtgaggacgggtccatgagcatcaaaaacgaagaggaggaacagacactgaccatacttatcagaactggactcctggtgatttctggcttgtttccaatcagcattcccatcacagcggctgcctggtacttatgggaggtgaagaaacaaagggccggtgtcctgtgggatgtgccttccccaccccctatggggaaggccgaactcgaggacggagcttatcgaataaaacagaagggcattctgggctactcacagatcggggcaggagtttacaaggaaggtaccttccacactatgtggcatgtaacacgcggcgccgtgcttatgcacaaagggaagcggatcgagccgagttgggcggatgtcaaaaaggacctgattagctatggaggcggttggaaattggagggggaatggaaggagggagaagaggtgcaggttctagctctggaaccaggcaagaatcccagagccgtgcaaaccaaacctggcctctttaagacgaacactgggaccatcggagcagtctctctggatttctccccaggtacatcaggcagtcccataattgacaaaaaggggaaagtggtaggactttacggcaacggtgtcgtgaccaggagcggggcctatgtttccgctatcgcccagacagagaagtctattgaggataatcctgaaatcgaggacgatatatttcgtaagcgccggttaactattatggacctgcacccgggagcaggcaaaaccaagagatacctccccgctatcgtgagggaagccatcaaacgaggcttgcggacgctgattctcgcgccaacacgcgtcgtggccgcagagatggaagaggctctgagagggcttcctatcaggtatcagactcccgccattcgggctgagcataccggacgagaaatagttgacctgatgtgtcacgcaacattcaccatgagattgctatcgccagtgcgcgtccctaactacaatctgatcattatggatgaggcccatttcactgaccccgccagcatcgctgcgaggggttatatctcaacccgtgtggaaatgggcgaggcagccgggatttttatgacagctacgccaccgggatcccgggatcctttcccccaaagtaacgccccaataatcgacgaggaaagagagattcccgaaaggtcttggaatagcggccacgagtgggtaactgattttaagggtaaaaccgtgtggttcgttccttccatcaaggcagggaacgacattgccgcttgcctccgcaagaatggcaagaaggtcatccagttatcacgaaaaacatttgattctgaatacgtgaagaccagaactaacgactgggatttcgtggtcacaaccgacataagcgagatgggcgcgaattttaaagccgagcgggtaatcgatccaaggcgctgtatgaagcccgtgattctgacggacggcgaagaacgtgttatccttgcagggcctatgccggtgactcatagttccgctgcccagagacggggaaggattggtcgcaaccccaaaaatgaaaacgaccagtacatctatatgggcgagcccctggaaaatgatgaggactgcgcacactggaaggaggccaagatgctcttggataacataaatacacctgaagggattatccccagcatgttcgagccagaacgagagaaagtcgacgctattgatggagaatacagactgcggggcgaggccaggaagacctttgtggacctcatgcgcagaggtgatctgcctgtttggcttgcgtataaagtggcagccgaggggatcaactacgctgacaggcggtggtgtttcgatggcataaagaacaatcaaatcctagaagagaacgtcgaagtggagatttggaccaaagagggagaacgtaagaagctgaaaccccgctggttggacgcccgaatctattctgatccattagctctgaaggagtttaaagagttcgcagccggcagaaagtcactcactctgaatcttattacagagatggggaggctgcctaccttcatgacacagaaaactcgggacgctctcgataacttggccgtactgcacacggcagaagcgggaggtcgcgcctacaatcatgctctatccgagctgccggagaccctcgaaacacttctgttattgactctgctcgccaccgtgacaggcgggatctttctgttccttatgagtggaagaggcataggtaagatgaccctggggatgtgctgcattatcactgcaagcatcctcttgtggtatgctcagattcagccccactggatcgccgcatcgataattctggagtttttcttaatcgttctactgattccagaacctgagaagcaaaggacgccccaggacaaccagctcacctacgtcgtgatcgccatacttacagtggtcgctgcgactatggccaatgaaatgggctttctggagaaaaccaagaaagacttgggactgggctctatcgcaacacagcaaccagagtccaacattctcgatatcgacctgcggcctgctagcgcctggaccctttacgccgttgcaactacattcgtgacgcccatgctccgacattcaattgaaaatagttctgtaaacgtgtccctgaccgctatcgccaatcaggcgactgtcttgatggggctgggaaagggttggccgttaagcaaaatggatattggcgtgccactactggctatcgggtgttattcacaggttaaccctataacactcaccgccgcacttctgttgctggtggcccactacgctattatcggacccggcctccaggcaaaggccaccagagaggcgcaaaagcgcgctgccgcaggtatcatgaaaaatccaacagtcgacgggattactgtaatagatctggaccccatcccttatgatccgaagtttgaaaaacagcttggccaggtgatgttactgattctctgcgttacgcaagtgttgatgatgaggaccacatgggccctgtgtgaggctctaactctggccaccggacccatcagtacactctgggaaggcaacccagggcggttctggaataccactattgcagtcagcatggctaacatctttcgtggatcctaccttgccggcgcgggtctgttgttctctataatgaagaatacgacaaacaccagaagggggactggaaacatgggcgagaccctgggtgagaaatggaaaagccgcctcaatacactgggcaaatccgaatttcagatctataagaagtcagggattcaggaggtggaccggactttagccaaagaaggaatcaagcgaggcgagaccgatcaccatgcagtctctagagggagtgctaaacttaggtggttcgtggagcgcaacatggttacacctgaaggaaaggtggtagacctgggctgcggtagagggggatggtcgtactattgtggcggtctcaaaaatgtgagagaggtcaagggcctaacgaaagggggacccggccacgaggaacctattccaatgagcacctacgggtggaacctggttcgtttgcagtccggagtggatgtctttttcatcccacctgaaaaatgcgacactctgctctgtgatataggcgagtcttcaccaaatcccacagtggaggccggtaggacccttcgggtactgaacttggtggaaaattggctgaacaataacactcaattctgcattaaggttctcaatccgtacatgcctagcgtgatcgagaaaatggaagcattacagcgcaagtatgggggagctctggtccgaaacccactttccagaaatagtacacatgagatgtactgggtgtctaacgccagcggcaatatcgtctcatccgtgaacatgattagtaggatgctgataaaccggtttaccatgcgccacaaaaaggccacgtatgaacccgacgttgacctaggcagcgggaccagaaatatcggaattgagtctgagatccctaacctcgatattatcggtaagaggatagagaaaatcaagcaggagcatgaaacatcctggcactacgaccaggatcacccatataaaacttgggcgtaccatggctcatatgagaccaagcaaacagggagcgcttcgtctatggtaaatggagtggtccgactgttgactaaaccctgggacgtgctgccgaccgttacacagatggcaatgaccgatactacgcctttcggccagcagcgggtgtttaaggaaaaggtcgacacacgtacccaagagcccaaagagggtactaagaaactcatgaagattaccgccgaatggctttggaaagagctggggaagaaaaagacaccaagaatgtgtacgcgcgaagagttcaccaggaaggtgcggagtaacgctgccttaggagcaatctttactgatgagaataaatggaagtccgccagagaagctgtagaggacagccgcttctgggaactggtggataaagagaggaacttgcacctcgaaggcaagtgcgagacatgtgtttacaatatgatgggcaaacgagagaagaagctgggggaatttggaaaagcgaagggttcacgggccatttggtacatgtggctaggcgcaagattccttgagtttgaagctctggggttcctcaacgaggaccattggttttccagggaaaattctctgagcggagtcgagggcgagggtttgcacaaactggggtatatcctccgcgatgtgagtaagaaagaaggaggcgccatgtacgcagacgacaccgccggctgggatactcgtattacacttgaggacctgaagaacgaagagatggtgaccaatcacatggaaggggagcataagaaattagctgaggccatattcaagctgacatatcagaacaaagtcgttcgggtgcagagacctactcccaggggaaccgtaatggatatcatttcccgccgagaccaacggggtagcggccaggtggggacgtacggattgaatacctttacaaacatggaagcgcagctcatcagacagatggagggcgaaggtgtcttcaagaatatccaacacctgactgtgaccgaggaggttgcagtgcagaactggctagccagggtcgggcgcgaaagactttctcggatggctatttcaggagatgactgcgtggtaaaaccactggatgacaggttcgccaacgcactcacagctctgaatgatatgggcaagatacgtaaggacatccagcagtgggagcccagtaaaggctggaacgattggactcaagttcctttttgctcccatcacttccatgaattgattatgaaggacgggcgagtgttagtcgtgccatgtcgcaatcaggatgagctgatcggtagagcacggattagccagggagctggctggtctctcagggaaaccgcctgccttgggaaatcgtatgcacagatgtggtcactgatgtactttcaccgcagagacctacggctggcggccaacgctatctgtagcgccgtgccgtcccactgggtccccacgagtaggacaacctggtctatacatgcaaagcacgagtggatgactacagaggacatgctcaccgtttggaatcgagtgtggatccgtgaaaacccttggatggaggataaaactccagtagaaagctgggaggaaattccctatttgggaaagagagaggaccaatggtgcggctccctgatcggtcttacctcacgcgctacatgggccaagaatattcaggcagccatcaaccaggtgcggagtctgatagggaatgaggaatacacggattacatgccttctatgaaaaggttcagacgcgaggaagaggaagcgggagtcctctggtga

SEQ ID NO: 14809 - RNA, 9876 nt, synthetic construct
  misc_feature 1..9876: note = derived and/or modified CDS sequence (opt3) from DENV-2__FJ410221__SS-prME
  source 1..9876: mol_type = other RNA
agcgccggaatgatcattatgctgatccccaccgtgatggctttccacctcacaactagaaatggggagcctcatatgatcgtcggcattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactgccgagtgccccaatacaaacagagcatggaatagtctggaagtggaggattacggatttggcgtgttcaccacaaacatctggctcaagctgaaagaaaagcaggacgcgttttgtgactctaagttaatgagcgctgccattaaagataatagggcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaaactcattaccgagtggtgctgtagatcctgcacactgccgcctcttaggtatcgcggagaggacggctgttggtacggtatggaaatacggccattgaaggagaaagaagagaatctggtgaactcattagttacggcggggcacggacaggtggataatttcagtctcggcgtactgggtatggccctttttctggaagagatgttgagaaccagggtcggcactaagcatgctatcctcctggtggcagtgagcttcgtcacactaattaccgggaacatgtcgtttaaagacctgggacgcgttgtggtaatggtgggcgccatcatggctgatgacattgggatcggagtcacttatctcgccctgcttgcagcgttcaaggtgcgacccacatttgccgctggcttgctgttacggaagctcacctccaaagagctgatgatgacgactataggtatcgttcttctgtctcaaagcaccattcctgaaacagtgctagagctcaccgatgccctggcattggggatgatggtcctgaagatcgtgcgtaatatggaaaaataccagttagctgttactattatggccatcctctgcgtgcccaacgcagtcatactgcagaatgcctggaaggtatcatgtacaattcttgctgtggttagtgtgtccccactgttgctcacctctagccagcagaaaactgactggatccctctggcgctaactatcaagggactgaaccccaccgccattttccttacgacactctccagaaccaataaaaagaggtcatggccactgaacgaggcaataatggctgtcggcatggtgagcatcttggccagttctctgttaaagaatgacattccgatgactggccctctcgtagccgggggactgcttaccgtgtgctatgtcctgacaggtcgctccgctgatttggaactcgagcgggcaactgacgttaaatgggaggatcaagccgaaatcagcggctcgtcacccattctgtctatcaccataagtgaggacgggtccatgagcatcaagaacgaagaggaggaacagacgctaacaattctgatcagaaccggacttctcgtgatttctggcctgtttccaatcagcatacccattactgcggctgcctggtacttgtgggaggtgaaaaagcagagggccggtgtcttatgggatgtgccttccccaccccctatggggaaagccgaactggaggacggagcttatcgaatcaagcaaaagggcatcctcggctactcacagattggggcaggagtttacaaagaaggtacattccacaccatgtggcatgtaactcgcggcgccgtgctgatgcacaaggggaaacggatcgagccgagttgggcggatgtcaagaaagaccttataagctatggaggcggttggaagctggagggggaatggaaggagggagaagaggtgcaggttttggctctagaaccaggcaaaaatcccagagccgtgcagacaaagcctggcctgtttaaaaccaacacggggactattggagcagtctctctcgatttctccccaggtacctcaggcagtcccatcattgacaagaaagggaaggtggtaggactgtacggcaacggtgtcgtgacaaggagcggggcctatgtttccgctatcgcccaatctgagaagtcgatagaggataatcctgaaattgaggacgatatctttcgtaaacgccggcttaccatcatggacttacacccgggagcaggcaagacaaaaagatacctgcccgctattgtgagggaagccatcaagcgaggcctccggactttgattctggcgccaacccgcgtcgtggccgcagagatggaagaggctctcagagggctgcctataaggtatcagacgcccgccatccgggttgagcatacaggacgagaaattgtggaccttatgtgtcacgctactttcaccatgagactgttgagcccagtccgcgtgcctaactacaatctaatcatcatggatgaggcacatttcacagaccccgcctcaattgccgctaggggttatatatccacccgtgtagaaatgggcgaggcggcagggatctttatgactgccaccccaccgggaagtcgggatcctttcccccagtctaacgctccaattatcgacgaggaaagagagattcccgaaaggagctggaactccggccacgagtgggtgacagattttaaaggtaagacggtttggttcgtcccttcaatcaaggccgggaacgacatagcagcctgcctgcgcaaaaatggaaagaaagtgatccaactctctcgaaagacttttgatagcgaatacgtgaaaaccagaacaaacgactgggatttcgtcgtaaccactgacattagtgagatgggcgctaattttaaggcggagcgggtgatcgatccaaggcgctgtatgaaacccgttattttaacagacggcgaagaacgtgtgatcctggccgggcctatgccggtcacccattccagcgcagctcagagacggggaaggataggtcgcaacccaaagaatgaaaacgaccagtacatttatatgggcgagccccttgaaaatgatgaggactgcgcccactggaaggaggcaaaaatgctgctcgataacatcaatacgcctgaagggattatcccctctatgttcgagccagaacgagagaaggtggacgccatagatggagaatacagattgcggggcgaggctaggaaaacttttgttgacctgatgcgcagaggtgatctccctgtgtggctggcctataaggtcgcggcagaggggatcaactacgccgacaggcggtggtgtttcgatggcattaaaaacaatcagatccttgaagagaacgtggaagtagagatttggacaaaggagggagaacgtaagaaactaaagccccgctggctggacgctcgaatctattcagatccattggccttaaaagagtttaaggagttcgctgcaggcagaaaatccctgaccctcaatctgataaccgagatggggaggcttcctactttcatgacacaaaagacccgggacgccctggataacctcgctgtgttgcacacagccgaagcaggaggtcgcgcgtacaatcatgccctgagtgagctaccggagactctggaaacgctccttctgttaaccttgctggctacagttactggcgggatttttctcttcctgatgagcggaagaggcatcggtaagatgacccttgggatgtgctgcatcattacagcctcgatcctgctctggtatgcacagatacagccccactggattgctgcctctatcattttggagtttttcctgatcgtcttactaataccagaacctgagaaacagaggacaccccaagacaaccagctgacttacgtggtgatcgcaattctcacggtcgttgccgctaccatggcgaatgaaatgggctttcttgagaagaccaaaaaggacctgggattgggctccatcgccactcagcagccagagagcaacattctggatatcgacctccggcctgcatcagcttggaccctgtacgccgtggccacaaccttcgtaactcccatgcttcgacatagtattgaaaattcttccgtgaacgtcagcctcacagcaatcgctaatcaagccacggtgctgatggggttgggaaaaggttggccgctgtcaaagatggatataggcgttccattactagcgattgggtgttatagtcaggtgaaccctatcaccctgactgctgccctccttctgttggtcgcacactacgccatcattggacccggcctgcaggctaaggcaacaagagaggcccagaaacgcgcggctgccggtataatgaagaatccaaccgtagacgggatcaccgtgattgatctcgaccccatcccttatgatccgaaatttgaaaagcaactgggccaggttatgcttttaattctgtgcgtgacacaggtcctcatgatgaggactacgtgggcattgtgtgaggccctgaccctagctacaggacccatcagcactctgtgggaaggcaacccagggcggttctggaataccacaatagccgtgtccatggcaaacatctttcgtggatcttacctcgctggcgccggtcttctgttcagcattatgaaaaataccactaacacgagaagggggacaggaaacatcggcgagaccttgggtgagaagtggaaatcccgcctgaatgcgctcggcaagtcagaatttcaaatttataagaaatctgggatccaggaggtcgaccggactctggccaaggaaggaataaaacgaggcgagaccgatcaccatgcagtgagtagagggtcggctaagttaaggtggttcgttgagcgcaacatggtgacacctgaaggaaaagtagtggaccttggctgcggtagagggggatggagctactattgtggcggtctgaagaatgtcagagaggttaagggcctcactaaagggggacccggccacgaggaacctattccaatgtccacctacgggtggaacctagtgcgtctgcagtctggagtcgatgtgtttttcataccccctgaaaagtgcgacacattgctgtgtgatatcggcgagtcaagcccaaatcccacggtagaggccggtaggaccctccgggtgcttaacctggttgaaaattggttgaacaataacactcagttctgcattaaagtgctgaatccgtacatgccttccgtcatagagaagatggaagcactccaacgcaaatatgggggagctttagtgcgaaacccactgagtagaaattctacacatgagatgtactgggtcagcaacgcctcaggcaatatcgtgtccagtgttaacatgattagcaggatgcttatcaaccggtttaccatgcgccacaagaaggccacttatgaacccgacgtagacctgggctctgggacaagaaatgtgggaattgagtccgagatccctaacctagatataatcggtaaaaggattgaaaagatcaaacaggagcatgaaacctcatggcactacgaccaggatcacccatataagacgtgggcgtaccatggcagctatgagaccaaacagacagggtcggcttctagtatggtcaatggagtggttcgactcctgactaagccctgggacgtgttgccgaccgtcacacaaatggcaatgactgataccacacctttcggccagcagcgggtgtttaaggaaaaagtagacacccgtactcaggagcccaaggagggtacgaaaaagctgatgaaaattacagccgaatggctctggaaggagcttgggaaaaagaagaccccaagaatgtgtactcgcgaagagttcaccaggaaagtgcggtccaacgctgccctgggagcaatctttacagatgagaataagtggaaaagcgccagagaagctgttgaggactcacgcttctgggaattagtcgataaggagaggaacctgcacttggaaggcaaatgcgagacgtgtgtgtacaatatgatgggcaagcgagagaagaaactcggggaatttggaaaggcgaaaggttcccgggccatttggtacatgtggctgggcgcaagattcctagagtttgaagctcttgggttcctgaacgaggaccattggttttctagggaaaatagcctcagtggagtggagggcgagggtctgcacaagttggggtatatactgcgcgatgtctccaaaaaggaaggaggcgccatgtacgcagacgacaccgccggctgggatactcgtatcacactcgaggaccttaagaacgaagagatggttaccaatcacatggaaggggagcataaaaagctggctgaggccattttcaaattaacttatcaaaacaaggtggtacgggtgcagagacctacacccaggggaaccgtcatggatatcatcagccgccgagaccagcggggttctggccaagtggggacatacggactgaatacttttaccaacatggaagcgcagttgattagacagatggagggcgaaggtgttttcaaaaatatacagcacctcacggtgaccgaggaggtcgcagtgcaaaactggctggccagggtagggcgcgaaagactatcacggatggctatcagtggagatgactgcgttgtgaagccacttgatgacaggttcgccaacgcactgacagctctcaatgatatgggcaagattcgtaaagacatccagcagtgggagccctccaagggctggaacgattggactcaggtccctttttgcagccatcacttccatgaactgattatgaaagacgggcgagtgttggtggtcccatgtcgcaatcaagatgagttaatcggacgggcacggatatctcagggtgctggctggtcgctgagggaaaccgcctgcctcgggaagtcatatgcacagatgtggagccttatgtactttcaccgcagagacctgcggctagcggccaacgctatctgttccgccgttccgagtcactgggtgcccacatctaggactacctggagcattcatgcaaaacacgagtggatgacgacagaggacatgctgaccgtatggaatcgagtgtggatccgtgaaaacccttggatggaggataagactccagtcgaatcctgggaggaaattccctatctcggaaagagagaggaccagtggtgcggctcattgatcggtctgacaagtcgcgctacctgggccaaaaatatacaagcagccattaaccaggtgcggtctcttatcgggaatgaggaatacactgattacatgcctagcatgaagaggttcagacgcgaggaagaggaagcgggagttctgtggtga

SEQ ID NO: 14810 - RNA, 9876 nt, synthetic construct
  misc_feature 1..9876: note = derived and/or modified CDS sequence (opt3) from DENV-2__FJ547064__SS-prME
  source 1..9876: mol_type = other RNA
agcgccggcatgatcattatgctgatacccaccgtgatggctttccacctcacaactagaaacggggagcctcatatggtcgttggaatccaggaaaagggtaaatcccttctgtttaagacggaggacggcgtgaatatgtgcaccttgatggcaatggatttaggggaactgtgtgaggacacaattacttacaaatgcccactactcaggcaaaacgaaccggaggatatcgactgttggtgcaattctacctcaacatgggtaacctatggaacttgtacaaccacgggcgagcaccggcgcgaaaagcgaagtgtggccctggtcccccatgtgggtatggggcttgagactcgtaccgaaacatggatgagctccgagggagcgtggaaacacgctcagagaattgagacttggatcctgaggcatcctggcttcaccataatggccgcaatcttggcctacacaattggcaccacgcactttcagcgggttctcatcttcattctgctgactgctgtggcaccatctatgacaatgcgctgcatcgggatatcgaacagagattttgtcgaaggagtgtcaggtggcagctgggtagacattgttctcgagcacgggagttgtgtgaccactatggccaagaataagcccacattagatttcgaactgatcaaaaccgaggctaagcagcctgccacgcttaggaaatattgcattgaagcgaagttgaccaacacaactaccgagtcccggtgtccaacacaaggagagccctctctgaaagaagagcaggacaagcgctttgtctgcaagcatagcatggtggatcgaggctggggtaatgggtgtggactattcggcaaaggcgggatcgtgacttgcgcaatgtttacctgcaagaaaaacatggaaggaaagatcgtccagcctgagaatctcgaatacacaattgttgtgaccccacactccggtgaggagcatgccgtaggcaacgacactgggaaacacggacaggaaataaaggtgacgccgcaatcaagtatcacagaggctgaactgaccggctatggtactgtcaccatggagtgtagccccagaacagggcttgatttcaatgaaatggtgctgttgcagatggagaacaaagcctggctcgttcacaggcagtggtttctggacttacctctgccatggctccccggcgcagataagcaggagtctaattggattcaaaaggaaacccttgtgactttcaaaaaccctcatgctaagaaacaggacgtcgtggtactgggatcccaggagggcgccatgcacacagcgttgacgggggccaccgaaatccaaatgtcaagcggaaatctactgtttactggtcatctcaagtgccggctgcgtatggacaaacttcagctgaagggcatgagttactctatgtgtacagggaagttcaaagttgtgaaggagatagcagagacccagcacggaacaattgtcatccgcgtgcagtatgaaggcgatggttccccatgcaaaatccccttcgagattatggacttggaaaagagatacgtcctcgggaggctgatcactgtgaacccgattgttaccgagaaagatagccctgtgaacatagaagctgagcccccatttggcgactcgtacatcattatcggagtagagcctggccaattaaagctgaattggttcaagaaagggtcttccatcggacagatgtttgaaacgaccatgcggggtgccaagcgaatggctattctaggcgatacagcctgggacttcgggtcactcggaggcgtctttactagtataggtaaagcactgcatcaggtgttcggggccatctatggcgctgcgtttagcggagtttcctggaccatgaagattcttatcggcgtgattatcacatggatagggatgaactctcgcagcacttcattgagtgtctccctggtgctcgtaggaatcgtgaccctgtaccttggcgttatggtccaggcagatagcggttgtgtggtgtcttggaaaaataaggagctgaagtgcgggtcaggaattttcatcacggacaacgtccacacatggaccgaacaatataaatttcagcccgagagtccaagcaagttggcctccgctattcagaaagcccaggaagagggcatctgtggtataagatctgttactaggctcgagaatctgatgtggaagcaaattacacccgaattaaaccacatcctggcagagaatgaagtgaaactaaccattatgactggcgatatcaaggggataatgcaggccggaaaacggtcgctccgccctcagccaaccgagctgaagtacagctggaagacatggggcaaagctaagatgctttccacggaatcatataaccagaccttcttgatcgacgggccggagactgccgagtgccccaatacaaacagagcatggaatagtctggaagtggaggattacggatttggcgtattcaccacaaacatttggctcaaactgaaggaaaaacaagacgcgttttgtgactctaagttaatgagcgctgccatcaaggataatagggcagtccatgccgacatgggttattggattgagtccgctctgaacgatacttggaaaatcgagaaggcctcattcatagaagtgaaaaattgccactggcctaagagccataccctttggtctaacggggttttggagtccgaaatgattatcccaaaaaacctcgcaggacccgtgagtcagcacaattaccgtcctggctaccacacgcagatcgctggtccatggcatctgggcaagctagagatggacttcgatttttgtgacgggacaaccgtcattgtgactgaagattgcggaaaccggggccccagcctgcgaaccacaactgcctctgggaagctcatcaccgagtggtgctgtagatcctgcacactgccgcctcttaggtatcgcggagaggacggctgttggtacggtatggaaattcggccattgaaagagaaggaagagaatctggttaactcattagtgacggcggggcacggacaagtagataatttcagtctcggcgtcctgggtatggccctttttctggaagagatgttgagaaccagggtgggcactaaacatgctatactcctggtggcagtcagcttcgttacactaatcaccgggaacatgtcgtttaaggacctgggacgcgtggtagtgatggtcggcgccactatgacagatgacattgggatgggagtgacctatctcgctctgcttgccgcattcaaagttcgacccacgtttgcggccggcttgctgttacggaagctcacttccaaggagctgatgatgaccacaatcggtattgtgcttctgtctcagagcaccatccctgaaactgtcctagagctcacagatgctctggccttggggatgatggtgctgaaaatagttcgtaatatggaaaagtaccagttagcagtgaccatcatggctattctctgcgtccccaacgccgtaatcctgcagaatgcatggaaagtgtcatgtacaattcttgccgttgtgagtgtctccccactgttgctcacttctagccaacagaagaccgactggatccctctggctctaacgataaaaggactgaaccccacagcgattttccttaccactctctccagaaccaataagaaaaggtcatggccactgaacgaggccatcatggcagtgggcatggtaagcatcttggctagttctctgttaaagaatgacattccgatgacaggccctctcgtggccgggggactgcttactgtctgctatgttctgaccggtcgctccgccgatttggaactcgagcgggctacggacgtgaagtgggaggatcaggcagaaataagcggctcgtcacccatcctgtctattacaatcagtgaggacgggtccatgagcattaaaaacgaagaggaggaacagaccctaactatcctgataagaacaggacttctcgtgatctctggcctgtttccaattagcatccccattaccgccgcggcttggtacttgtgggaggtcaagaaacaaagggccggtgtgttatgggatgttccttccccaccccctatggggaaggcagaactggaggacggagcctatcgaatcaaacagaagggcatactcggctactcacagattggggctggagtataccgcgaaggtactttccacacaatgtggcatgtgacccggggcgcagtcctgatgcacaaggggaaaagaatcgagccgagttgggccgatgtgaagaaagaccttatcagctatggaggcggttggaagctggagggggaatggaaagagggagaagaggttcaggtgttggcgctagaaccaggcaagaatcccagggctgtccaaacgaagcctggcctgtttaaaactaacaccgggacaattggagccgtgtctctcgatttctccccaggtacctcaggcagtcccatcatagacaagaaagggaaggtagtcggactgtacggcaacggtgtggttacacgtagcggggcatatgtgtccgccattgctcagactgagaaatctatcgaggataatcctgaaattgaggacgatatctttcgcaagcggagacttaccataatggacttacacccgggagccggcaagacgaaaaggtacctgcccgcaattgtccgagaagctatcaagcggggcctccgcacattgatcctggccccaactagagtggttgcggccgagatggaagaggcactcagggggctgcctattcggtatcagacccccgctatccgagccgagcatacaggaagagaaattgtggaccttatgtgtcacgctaccttcactatgcgcctgttgtcgccagtcagggtgcctaactacaatctaataatcatggatgaggcacatttcaccgaccccgccagcattgccgctcgtggttatatctcaacacgggtagaaatgggcgaggcggcagggatctttatgacggccactccaccgggatccagagatcctttcccccaaagtaacgctccaattatagacgaggaaagggagatccccgaacgctcttggaatagcggccacgagtgggtgaccgattttaaaggtaagacagtttggttcgtcccttccattaaagccgggaacgacatcgtggcatgcctgcgaaagaatggaaagaaagtgattcagctctcaagaaagacctttgattctgaatacgtcaaaactcggacaaacgactgggatttcgtagtgaccacggacatcagcgagatgggcgccaattttaaggctgagagggttatagatccacgccgttgtatgaaacccgtgatcttaactgacggcgaagagagagtcattctggcggggcctatgccggtgacacatagttccgccgcacagcggaggggacgcatcggtcgaaacccaaagaatgaaaacgaccagtacatttatatgggcgagccccttgaaaatgatgaggactgcgctcactggaaagaggccaagatgctgctcgataacatcaatacccctgaagggataattcccagcatgttcgagccagaaagagagaaggttgacgcaatcgatggagaataccggttgaggggcgaggcccgcaaaacctttgtggacctgatgagaaggggtgatctccctgtctggctggcttataaggtggccgcggaggggattaactacgcagaccggcgttggtgtttcgatggcatcaaaaacaatcaaatacttgaagagaacgtagaagtggagatctggactaaggagggagaacgcaaaaagctaaagccccgatggctggacgccagaatttattctgatccattggctttaaaagagtttaaggaattcgccgctggcaggaaatcactgacactcaatctgatcaccgagatggggcggcttcctacattcatgactcagaagacgcgcgacgcactggataacctcgccgttttgcacaccgctgaagccggaggtagagcatacaatcatgcgctgtccgagctaccggagacactggaaactctccttctgttaaccttgctggccacagtcaccggcgggatttttctcttcctgatgagtggaaggggcatcggtaaaatgactcttgggatgtgctgcataattacggctagcatcctgctctggtatgcccagatccagccccactggattgcagcttcgatcatattggagtttttcctgattgtgttactaatcccagaacctgagaagcaacggaccccccaggacaaccagctgacatacgtggtcattgccatcctcactgttgtggcagccaccatggctaatgaaatgggctttcttgagaagacaaaaaaggacctgggattgggctctatagcgacccagcaaccagagtccaacatcctggatattgacctccgacctgccagcgcatggactctgtacgctgtagccacaacgttcgtgacccccatgcttagacattcaatcgaaaatagttctgtcaacgtgtccctcactgccattgcaaatcaggctacagttctgatggggttgggaaaaggttggccgctgagcaagatggatatcggcgtgccattactagccattgggtgttattcacaggtcaaccctatcaccctgaccgcggctctccttctgttggtagcccactacgcaataattggacccggcctgcaggccaaagctacacgcgaggcacaaaagagggccgcggctggtatcatgaagaatccaactgtggacgggatcacggttattgatctcgaccccataccttatgatccgaaatttgaaaagcagctgggccaggtgatgcttttaatcctgtgcgtcacccaagtgctcatgatgcggacaacttgggccttgtgtgaggcactgaccctagccacaggacccattagtaccctgtgggaaggcaacccagggcgtttctggaatactacgatcgctgtcagcatggccaacatttttagaggatcctacctcgcaggcgctggtcttctgttctctatcatgaaaaatacaaccaacactaggcgcgggaccggaaacatgggcgagacattgggtgagaagtggaaaagccggctgaatgccctcggcaagtccgaatttcagatatataaaaagtcagggatccaggaggtggaccgaactctggcgaaggaaggaattaaaagaggcgagaccgatcaccatgccgtttctagggggagtgcaaagttacgctggttcgtggagcggaacatggtaacacctgaaggaaaagtggtcgaccttggctgcggtagagggggatggtcgtactattgtggcggtctgaagaatgttcgtgaggtgaaaggcctcacgaaggggggacccggccacgaagagcctatcccaatgagcacctacgggtggaacctagtcaggctgcagtccggagtggatgtatttttcattccccctgaaaagtgcgacactttgctgtgtgatatcggcgagtcttcaccaaatcccacagtggaggctggtcggaccctccgcgttcttaacctggtggaaaattggttgaacaataacatacaattctgcattaaagtcctgaatccgtacatgcctagcgtgatcgagaagatggaagccctccagcgaaaatatgggggagcattagtcagaaacccactgtccaggaatagtactcatgagatgtactgggtgtctaacgctagcggcaatatcgtttcatccgtaaacatgattagtcggatgcttataaaccgctttacaatgagacacaagaaagccacctatgaacccgacgtggacctgggcagcgggacgaggaatatcggaaccgagtctgagattcctaacctagatatcattggtaagcgaatcgaaaagataaaacaggagcatgaaacatcctggcactacgaccaggatcacccatataagacttgggcctaccatggctcatatgagaccaaacaaacagggagcgcgtcgtctatggtcaatggagtggttcggctcctgactaagccctgggacgtgttgccgatggtcacccagatggctatgacagataccactcctttcggccagcagcgtgtgtttaaagaaaaggtagacacgagaacacaagagcccaaggagggtaccaaaaagctgatgaaaatcactgcagaatggctctggaaggagcttgggaaaaagaaaaccccacgcatgtgtacaagggaagagttcacgcggaaggtgagaagtaacgccgctctgggagccatttttaccgatgagaataagtggaaatccgcacgcgaagccgttgaggacagcaggttctgggaattagtcgataaggagcgaaacctgcacttggaaggcaaatgcgagacttgtgtgtacaatatgatgggcaagcgggagaaaaagctcggggaatttggaaaggctaaaggttcaagagcgatctggtacatgtggctgggcgccaggttcctagagtttgaagcacttgggttcctgaacgaggaccattggttttcccgcgaaaattctctcagcggagtggagggcgagggtctgcacaagttggggtatattctgcgtgatgtcagtaaaaaggaaggaggcgctatgtacgccgacgacacagcaggctgggatacccggatcactctcgaggaccttaaaaacgaagagatggttacaaatcacatggaaggggagcataagaagctggccgaggctattttcaaattaacctatcagaacaaggtggtaagagtgcagaggcctacaccccgcggaactgtcatggatataatctcccgacgggaccaaagaggtagcggccaggtggggacctacggactgaatacgtttaccaacatggaagcccagttgattaggcagatggagggcgaaggtgttttcaaaaatatccaacacctcacagtgactgaggaggtcgcggtgaagaactggctggcacgcgtagggagagaacggctatctaggatggccatctcaggagatgactgcgttgtgaaaccacttgatgaccgtttcgctaacgccctgaccgcactcaatgatatgggcaagattcgaaaggacatacagcagtgggagcccagtaaaggctggaacgattggacacaggtccctttttgctcccatcacttccatgaactgatcatgaaggacgggcgcgtgttggtggtcccatgtagaaatcaagatgagttaattggacgggctaggatcagccagggtgccggctggtctctgcgcgaaactgcttgcctcgggaaatcgtatgcccagatgtggtcacttatgtactttcacagacgggacctgaggctagcagcgaacgccatttgtagcgctgttccgtcccactgggtgcccaccagtcgaacgacatggtctatccatgccaagcacgagtggatgaccactgaggacatgctgacagtatggaatcgtgtgtggataagagaaaacccttggatggaggataaaaccccagtcgaaagctgggaggaaatcccctatctcggaaagcgcgaggaccagtggtgcggctccttgattggtctgacttcacgggcaacctgggctaagaatatccaagccgcaattaaccaggtgaggagtcttatcgggaatgaggaatacacagattacatgccttctatgaaaagattccgccgggaggaagaggaagccggagttctgtggtga

SEQ ID NO: 14811 - RNA, 9876 nt, synthetic construct
  misc_feature 1..9876: note = derived and/or modified CDS sequence (opt3) from DENV-2__FJ410223__SS-prME
  source 1..9876: mol_type = other RNA
agcgcaggaatgatcattatgctgatacccaccgtgatggctttccacctcacaactagaaacggggagcctcatatgatcgtcggcattcaggaaaagggtaaatcccttctgtttaagacggaggacggagttaatatgtgcaccttgatggcaatggatttaggggaactgtgtgaggacacaatcacttacaaatgcccattactcaggcaaaacgaaccggaggatattgactgttggtgcaattctacctcaacatgggtgacctatggaacttgtacaaccacgggagagcaccggcgcgaaaagcgaagtgtagcactggtgccccatgtcggtatggggcttgagactcgtaccgaaacatggatgagctccgagggagcgtggaaacacgctcagcggatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccaattaaagctgaattggttcaagaaagggtcttccattggacagatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacaatataaatttcagcccgagagtccaagcaagttggcctccgctatccagaaagcccaggaagagggcatatgtggtattagatctgtcactaggctcgagaatctgatgtggaagcaaatcacacccgaattaaaccacattctggcagagaatgaagttaaactaaccatcatgactggcgatataaaggggatcatgcaggccggaaaacggtcgctccgccctcagccaaccgagctgaagtacagctggagaacatggggcaaggctaaaatgctttccacggaatcatataaccagaccttcttgattgacgggccggagactgccgagtgccccaatacaaacagggcatggaatagtctggaagtggaggattacggatttggcgtgttcaccacaaacatctggctcaagctgaaagaaaagcaagacgcgttttgtgactctaaattaatgagcgctgccattaaggataatcgtgcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcagcacaattaccggcctggctaccacacgcagattgctggtccatggcatctgggcaaactagagatggacttcgatttttgtgacgggacaaccgtgatcgtcactgaagattgcggaaaccgaggccccagcctgagaaccacaactgcctctgggaagctcattaccgagtggtgctgtaggtcctgcacactgccgcctcttcgctatcggggagaggacggctgttggtacggtatggaaataagaccattgaaggagaaagaagagaatctggtgaactcattagttacggcggggcacggacaagtggataatttcagtctcggcgtactgggtatggccctttttctggaagagatgttgaggacccgcgtcggcactaagcatgctatcctcctggtggcagtgagcttcgtcacactaattaccgggaacatgtcgtttaaagacctgggacgagttgtggtaatggtgggcgccactatggctgatgacatcgggatgggagtcacatatctcgccctgcttgcagcgttcaaggtgcggcccacctttgccgctggcttgctgttacgtaaactcacgtccaaggagctgatgatgactaccattggtatcgttcttctgtctcagagcacaatacctgaaaccgtgctagagctcactgatgccctggcattggggatgatggtcctgaagatcgtgagaaatatggaaaaataccagttagctgttacaattatggccatcctctgcgtgcccaacgcagtcattctgcagaatgcctggaaggtatcatgtaccatccttgctgtggttagtgtgtccccactgttgctcacatctagccaacagaaaactgactggatacctctggcgctaaccattaagggactgaaccccacggccatcttccttacaaccctctccaggactaataaaaagcgctcatggccactgaacgaggcaatcatggctgtcggcatggtgagcattttggccagttctctgctaaagaatgacataccgatgaccggccctctcgtagccgggggactgcttacagtgtgctatgtcctgactggtcggtccgctgatttggaactcgagagagcaaccgacgttaagtgggaggatcaggccgaaatcagcggctcgtcacccattctgtctatcacgattagtgaggacgggtccatgagcatcaagaacgaagaggaggaacagacactaaccatactgatcaggactggacttctcgtgatttctggcctgtttccaatcagcattcccatcacagcggctgcctggtacttgtgggaggtgaaaaagcaacgagccggtgtcttatgggatgtgccttccccaccccctatggggaaagccgaactggaggacggagcttatcgcataaagcagaaaggcattctcggctactcacagatcggggcaggagtttacaaggaaggtaccttccacactatgtggcatgtaacacggggcgccgtgctgatgcacaaggggaaaagaatcgagccgagttgggcggatgtcaagaaagaccttattagctatggaggcggttggaagctggagggggaatggaaagagggagaagaggtgcaggttttggctctagaaccaggcaagaatcccagggccgtgcaaaccaagcctggcctgtttaaaacgaacactgggaccatcggagcagtctctctcgatttctccccaggtacatcaggcagtcccataattgacaagaaagggaaggtggtaggactgtacggcaacggtgtcgtgacccgtagcggggcctatgtttccgctatcgcccagacagagaaatctattgaggataatcctgaaatcgaggacgatatatttcgcaagaagcggcttactattatggacttacacccgggagcaggcaaaaccaagagatacctgcccgctatcgtgagggaagccatcaaacgaggcctccggacgttgattctggcgccaacacgcgtcgtggccgcagagatggaagaggctctcagagggctgcctatcaggtatcagactcccgccattcgggctgagcataccggacgagaaatagttgaccttatgtgtcacgcaacattcaccatgagactgttgtcgccagtgcgcgtccctaactacaatctaatcattatggatgaggcccatttcactgaccccgccagcatcgctgcgaggggttatatctcaacccgtgtggaaatgggcgaggcagccgggatttttatgacagctacgccaccgggatcccgggatcctttcccccaaagtaacgccccaataatcgacgaggaaagagagattcccgaaaggtcttggaatagcggccacgagtgggtaactgattttaagggtaaaaccgtgtggttcgttccttccatcaaggcagggaacgacattgccgcttgcctgcgcaagaatggcaagaaggtcatccagctctcacgaaaaacatttgattctgaatacgtgaagaccagaactaacgactgggatttcgtggtcacaaccgacataagcgagatgggcgcgaattttaaagccgagcgggtaatcgatccaaggcgctgtatgaagcccgtgattttaacggacggcgaggaacgtgttatcctggcagggcctatgccggtgactcatagttccgctgcccagagacggggaaggattggtcgcaaccccaaaaatgaaaacgaccagtacatctatatgggcgagccccttgaaaatgatgaggactgcgcacactggaaggaggccaagatgctgctcgataacataaatacacctgaagggattatccccagcatgttcgagccagaacgagagaaagtcgacgctattgatggagaatacagattgcggggcgaggccaggaagacctttgtggacctgatgcgcagaggtgatctccctgtttggctggcgtataaagtggcagccgaggggatcaactacgctgacaggcggtggtgtttcgatggcataaagaacaatcaaatccttgaagagaacgtcgaagtggagatttggaccaaagagggagaacgtaagaagctaaaaccccgctggctggacgcccgaatctattctgatccattggctttaaaggagtttaaagagttcgcagccggcagaaagtcactgactctcaatctgattacagagatggggaggcttcctaccttcatgacacagaaaactcgggacgctctggataacctcgccgtattgcacacggcagaagcgggaggtcgcgcctacaatcatgctctgtccgagctaccggagaccctggaaacactccttctgttagccttgctggcaactgtgaccggcgggatctttctcttcctgatgagtggaagaggcataggtaagatgacacttgggatgtgctgcattatcaccgctagcatcctgctctggtatgcccagattcagccccactggatcgcagcctcgataattttggagtttttcctgatcgttttactaattccagaacctgagaagcaaaggactccccaggacaaccagctgacgtacgtcgtgatcgctatactcaccgtggtcgcggccacaatggcaaatgaaatgggctttcttgagaaaactaagaaagacctgggattgggctctatcgctacccagcaaccagagtccaacattctggatatcgacctccggcctgccagcgcctggacactgtacgcagttgctaccactttcgtgacacccatgcttcgacattcaattgaaaatagttctgtaaacgtgtccctcacggccatcgcgaatcaggctaccgtcctgatggggttgggaaagggttggccgctgagcaaaatggatattggcgtgccattactagccatcgggtgttattcacaggttaaccctataactctgacagcagccctccttctgttggtggctcactacgcaattatcggacccggcctgcaggccaaggcgaccagagaggctcaaaagcgcgccgcagccggtatcatgaaaaatccaaccgtcgacgggattacagtaatagatctcgaccccatcccttatgatccgaagtttgaaaaacagctgggccaggtgatgcttttaattctgtgcgttactcaagtgctcatgatgaggacgacctgggctttgtgtgaggccctgacactagcaactggacccatcagtaccctgtgggaaggcaacccagggcggttctggaatacaaccattgctgtcagcatggccaacatctttcgtggatcctacctcgcgggcgccggtcttctgttctctataatgaagaatactacgaacacaagaagggggaccggaaacatgggcgagactttgggtgagaaatggaaaagccgcctgaatgcactcggcaaatccgaatttcagatctataagaagtcagggattcaggaggtggaccggaccctggctaaagaaggaatcaagcgaggcgagacagatcaccatgccgtctctagagggagtgcaaaattaaggtggttcgtggagcgcaacatggttactcctgaaggaaaggtggtagaccttggctgcggtagaggcgggtggtcgtactattgtgggggtctgaaaaatgtgagagaggtcaagggcctcaccaaagggggacccggccacgaggaacctattccaatgagcacatacgggtggaacctagttcgtctgcagtccggagtggatgtctttttcatcccacctgaaaaatgcgacacgttgctgtgtgatataggcgagtcttcaccaaatcccaccgtggaggctggtaggactctccgggtacttaacctggtggaaaattggttgaacaataacacacaattctgcattaaggttctgaatccgtacatgcctagcgtgatcgagaaaatggaagccctccagcgcaagtatgggggagccttagtccgaaacccactgtccggcaatcttaaaaacgagatgtactgggtgagtaatgcgtctggcaacatcgtcagctcagtgaacatgatttccagaatgctgataaataggtttaccatgcggcataagaaggctacttatgaacccgacgttgacctagggagtggaacacgcaacatcggtattgagagcgagacccctaatctcgatatcattggcaaaagaatcgaaaagataaaacaggagcacgaaacgtcttggcattacgaccaggatcacccatataagacctgggcataccacgggtcctatgagacaaaacaaactggatcagccagctcgatggtaaacggcgtggtcaggctgttgaccaagccctgggacgtgctgccgacagttactcagatggctatgaccgatacaacccctttcggtcagcagcgagtgtttaaggaaaaagtcgacactcggacgcaagagcccaaggaggggactaaaaagctcatgaaaatcaccgccgaatggctttggaaggagctgggcaaaaagaagactccacgtatgtgtaccagagaagagttcacacgcaaagtgaggtctaatgcagccttaggcgctatttttacggatgagaacaagtggaaaagtgcgcgggaagccgtagaggactccagattctgggaactggtggataaggagcgcaatttgcatctcgaaggcaaatgcgagacctgtgtttacaacatgatggggaagagggagaagaaactgggagaatttggtaaggcaaaaggcagccgagctatctggtacatgtggctaggggcccggttccttgagtttgaagcactgggattcctcaatgaggaccactggttttcaagagaaaactccctgtctggcgtcgagggtgaggggttgcataagctgggatatattctcagggatgtgagcaaaaaggaaggcggcgccatgtacgctgacgacactgccgggtgggatacacgcatcacccttgaggacctgaagaatgaagagatggtgactaaccacatggaaggagagcacaaaaagttagcggaggcaattttcaaactgacatatcagaataaggtcgttcgtgtgcagcggcctacccccagaggtacagtaatggatataatcagtaggcgcgaccaacgaggctccggacaggtgggaacttacggcttgaacacctttacgaatatggaagcccagctcattcggcagatggagggtgaaggggtcttcaaaaacatccaacatctgaccgtgacagaggaggttgctgtgcagaactggctagccagagtcggaagggaacgccttagcagaatggcaatctctggcgatgactgcgtggtaaagccactggatgaccggttcgctaatgccctcactgctctgaacgatatgggcaagattaggaaagacatacagcagtgggagccctcaaaggggtggaatgattggacccaagttcctttttgcagtcaccatttccacgaattgatcatgaaagacggacgtgtgttagtcgtgccatgtcgaaaccaggatgagctgattggtcgcgccagaatctcccagggcgcagggtggagcctccgggaaacagcgtgccttggaaagtcttatgcccagatgtggtcgctgatgtactttcataggcgcgacctaagactggtggctaatgccatttgttcagcagtcccgagccactgggttcccacttcccggaccacgtggagtatccacgctaaacatgagtggatgacaaccgaggacatgctcactgtgtggaacagggtatggatacgagaaaatccttggatggaggataagacaccagtggaatcttgggaggaaatcccctatttgggcaagcgtgaggaccaatggtgcggtagcctgattgggcttacctccagagccacttgggccaaaaacatccaggccgcgattaatcaggtccgctcactgatcggaaacgaggaatacaccgattacatgcctagtatgaagcggttcaggagagaggaagaggaagctggcgtgctctggtga

SEQ ID NO: 14812 - RNA, 9876 nt, synthetic construct
  misc_feature 1..9876: note = derived and/or modified CDS sequence (opt3) from DENV-2__FJ410224__SS-prME
  source 1..9876: mol_type = other RNA
agcgcaggcatgatcattatgctgatccccaccgtgatggctttccacctcaccactagaaacggggagcctcatatgatcgtcggtattcaagaaaagggaaaatcccttctgtttaagacggaggacggcgttaatatgtgcaccttgatggcaatggatttaggggaactgtgtgaggacacagtgacttacaaatgcccactactcaggcaaaacgaaccggaggatatcgactgttggtgcaattctacctcaacatgggtaacctatggaacttgtacaaccacgggcgagcaccggcgcgaaaagcgaagtgtggcactggtcccccatgtgggtatggggcttgagactcgtaccgaaacatggatgagctccgagggagcgtggaaacacgctcagagaattgagacttggatcctgaggcatcctggcttcaccataatggccgcaatcttggcctacacaattggcaccacgcactttcagcgggttctcatcttcattctgctgactgctgtggcaccatctatgacaatgcgctgcatcgggatatcgaacagagattttgtcgaaggagtgtcaggtggcagctgggtagacattgttctcgagcacgggagttgtgtgaccactatggccaagaataagcccacattagatttcgaactgatcaaaaccgaggctaagcagcctgccacgcttaggaaatattgcattgaagcgaagttgaccaacacaactaccgagtcccggtgtccaacacaaggagagccctctctgaaagaagaacaggacaagcgctttgtctgcaagcatagcatggtggatcgaggctggggtaatgggtgtggactattcggcaaaggcgggatcgtgacttgcgcaatgtttacctgcaagaaaaacatggaaggaaagatcgtccagcctgagaatctcgaatacacaattgttgtgaccccacactccggtgaggagcatgccgtaggcaacgacactgggaaacacggaaaggaaataaaagtgacgccgcagtcaagtatcacagaggctgaactgaccggctatggtactgtcaccatggagtgtagccccagaacagggcttgatttcaatgaaatggtgctgttgcaaatggagaacaaggcctggctcgttcacaggcagtggtttctggacttacctctgccatggctccccggcgcagataagcaggagtctaattggattcagaaagaaacccttgtgactttcaagaaccctcatgctaaaaagcaagacgtcgtggtactgggatcccaggagggcgccatgcacacagcgttgacgggggccaccgaaatccagatgtcaagcggaaatctactgtttactggtcatctcaaatgccggctgcgtatggacaaacttcaactgaagggcatgagttactctatgtgtacagggaaattcaaggttgtgaaagagatagcagagacccagcacggaacaattgtcatccgcgtgcagtatgaaggcgatggttccccatgcaagatccccttcgagattatggacttggagaagagatacgtcctcgggaggctgatcactgtgaacccgattgttaccgagaaggatagccctgtgaacatagaagctgagcccccatttggcgactcgtacatcattatcggagtagagcctggccagttaaagctgaattggttcaaaaaggggtcttccatcggacaaatgtttgaaacgaccatgcggggtgccaaacgaatggctattctaggcgatacagcctgggacttcgggtcactcggaggcgtctttacaagtataggtaaggcactgcatcaggtgttcggggccatctatggcgctgcgtttagcggagtttcctggaccatgaaaattcttatcggcgtgattatcacatggatagggatgaactctcgcagcacttcattgagtgtctccctggtgctcgtaggaaccgtgacgctgtaccttggcgttatggtccaggcagatagcggttgtgtggtgtcttggaagtcaaaggagctgaaatgcgggagtggaatcttcattacagacaatgtccacacctggactgaacagtataagtttcaacccgagagcccatccaaattggcctctgctatccagaaggcccaggaagagggcatttgtggtatcagatcggttacaaggctcgagaacctgatgtggaaacagataacccccgaattaaatcacattctggcagagaacgaagtgaagctaactatcatgaccggcgatattaaagggatcatgcaagccggaaagcggagcctccgccctcagccaacagagctgaagtactcctggaaaacgtggggcaaggctaaaatgctttcaaccgaaagttataatcagactttcttgatagacgggccggagacagccgagtgccccaacaccaatagagcatggaactctctggaagtggaggattacggatttggcgtattcacaactaatatctggctcaagctgaaagaaaagcaggacgcgttttgtgacagcaagttaatgtccgctgccattaaagataacagggcagtccatgccgacatgggttattggatcgagtcagctctgaatgatacctggaagattgagaaagccagcttcatcgaagtgaagaactgccactggcctaaatctcatacgctttggtccaatggggttttggagagtgaaatgataattccaaagaacctcgcaggacccgtgagccaacacaactaccgtcctggctaccacacacagatcgctggtccatggcatctgggcaagctagagatggacttcgatttttgtgacgggaccactgtcatcgtgaccgaagattgcggaaatcggggcccctctctgcgaacaactaccgcctccgggaaactcattacagagtggtgctgtagatcatgcacgctgccgcctcttaggtatcgcggagaggacggctgttggtacggtatggaaatccggccattgaaggagaaagaagagaacctggttaatagtttagtgaccgcggggcacggacaggtagataacttcagcctcggcgtcctgggtatggccctttttctggaagagatgttgagaactagggtgggcacaaagcatgctattctcctggtggcagtctcgttcgttaccctaataactgggaatatgtcctttaaagacctgggacgcgtggtagtgatggtcggcgccacaatggctgatgacatcgggatgggagtgacctatctcgccctgcttgcagcgttcaaggttcgacccacgtttgccgctggcttgctgttacggaagctcacttctaaagagctgatgatgaccacaattggtatcgtgcttctgagccaatcaaccattcctgaaactgtcctagagctcacagatgccctggcattggggatgatggtgctgaagatcgttcgtaacatggaaaaataccagttagctgtgaccataatggccatcctctgcgtccccaatgcagtaattctgcagaacgcctggaaggtgagttgtacaatccttgctgttgtgtccgtctctccactgttgctcactagctcccagcagaaaaccgactggattcctctggcgctaacgatcaagggactgaatcccacagccatattccttaccactctctcaagaaccaacaaaaagaggagctggccactgaatgaggcaattatggctgtgggcatggtaagtatcttggcctcttccctgttaaagaacgacatcccgatgacaggccctctcgtggccgggggactgcttactgtctgctatgttctgaccggtcgcagcgctgatttggaactcgagcgggcaacggacgtgaaatgggaggatcaggccgaaatttcgggctcatctcccatactgagtatcacaatttccgaggacgggagcatgtctatcaagaatgaagaggaggaacagaccctaactattctgatcagaacaggacttctcgtgataagcggcctgtttccaatctccattcccatcaccgcggctgcctggtacttgtgggaggtcaaaaagcagagggccggtgtgttatgggatgttccttcaccaccccctatggggaaagccgaactggaggacggagcttatcgaattaagcaaaagggcatcctcggctacagtcagataggggcaggagtatacaaagaaggtactttccacacaatgtggcatgtgacccgcggcgccgtcctgatgcacaaggggaaacggattgagccgagctgggcggatgtgaagaaagaccttatctcttatggaggcggttggaagctggagggggaatggaaggagggagaagaggttcaggtgttggctctagaaccaggcaaaaaccccagagccgtccagacgaagcctggcctgtttaaaactaataccgggacaatcggagcagtgtccctcgatttctcaccaggtaccagtggcagccccattatcgacaagaaagggaaggtagtcggactgtacggcaacggtgtggttacaaggtccggggcctatgtgtctgctatagcccaaactgagaagtcgattgaggataaccctgaaatcgaggacgatatttttcgtaaacgccggcttaccatcatggacttacacccgggagcaggcaagacgaaaagatacctgcccgctatagtcagggaagccattaagcgaggcctccggacattgatcctggcgccaactcgcgtggttgccgcagagatggaagaggctctcagagggctgcctatcaggtatcagacccccgccattcgggctgagcatacaggacgagaaatcgtggaccttatgtgtcacgcaaccttcactatgagactgttgagcccagtccgcgtgcctaattacaacctaattataatggatgaggcccatttcaccgaccccgcctcaatcgctgcgaggggttatatttccacacgtgtagaaatgggcgaggcagccgggatctttatgacggctactccaccgggaagtcgggatcctttcccccagtctaatgccccaatcattgacgaggaaagagagatacccgaaaggagctggaactccggccacgagtgggtgaccgattttaaaggtaagacagtttggttcgtcccttcaatcaaggcagggaatgacattgccgcttgcctgcgcaaaaacggaaagaaagtgatccaactctctcgaaagacctttgatagcgaatacgtgaaaactagaacaaatgactgggatttcgtcgtaaccacggacattagtgagatgggcgcgaactttaaggccgagcgggtgatcgatccaaggcgctgtatgaaacccgttatattaactgacggcgaagaacgtgtgatcctggcagggcctatgccggtcacacattccagcgctgcccagagacggggaaggattggtcgcaatccaaagaacgaaaatgaccagtacatctatatgggcgagccccttgaaaacgatgaggactgcgcacactggaaggaggccaaaatgctgctcgataatattaacacccctgaagggatcataccctctatgttcgagccagaacgagagaaggtggacgctattgatggagaatacagattgcggggcgaggccaggaaaacctttgttgacctgatgcgcagaggtgatctccctgtgtggctggcgtataaggtcgcagccgaggggatcaattacgctgacaggcggtggtgtttcgatggcattaaaaacaaccagatccttgaagagaatgtggaagtagagatatggactaaggagggagaacgtaagaaactaaagccccgctggctggacgcccgaatctattcagatccattggctttaaaagagtttaaggagttcgcagccggcagaaaatccctgacactcaacctgattaccgagatggggaggcttcctacattcatgactcaaaagacgcgggacgctctggataatctcgccgtgttgcacaccgcagaagcgggaggtcgcgcctacaaccatgctctgagtgagctaccggagacactggaaactctccttctgttaaccttgctggccacagttaccggcgggatctttctcttcctgatgagcggaagaggcattggtaagatgactcttgggatgtgctgcatcataacggcatcgattctgctctggtatgctcagatccagccccactggatcgccgcatctattatcttggagtttttcctgatagtcttactaattccagaacctgagaaacagaggacaccccaagacaatcagctgacatacgtggtgatcgccattctcactgtcgttgctgcgaccatggccaacgaaatgggctttcttgagaagactaaaaaggacctgggattgggctccatcgcaacccagcagccagagagcaatatactggatatcgacctccggcctgcttcagcctggactctgtacgccgtggcaacaacgttcgtaacccccatgcttcgacatagtattgaaaactcttccgtgaatgtcagcctcactgctatcgccaaccaagcgacagtgctgatggggttgggaaaaggttggccgctgtcaaagatggatattggcgttccattactagctatcgggtgttatagtcaggtgaatcctattaccctgaccgccgcactccttctgttggtcgcccactacgctatcataggacccggcctgcaggcaaaggccacaagagaggcgcagaaacgcgctgccgcaggtattatgaagaacccaactgtagacgggatcacggtgatcgatctcgaccccattccttatgatccgaaatttgaaaagcaactgggccaggttatgcttttaatactgtgcgtgacccaggtcctcatgatgaggacaacttgggccttgtgtgaggctctgaccctagccacaggacccatcagcaccctgtgggaaggcaatccagggcggttctggaacactacgattgcagtgtccatggctaatatctttcgtggatcttacctcgccggcgcgggtcttctgttcagcattatgaaaaacacaaccaatactagaagggggaccggaaacatcggcgagacattgggtgagaagtggaaatcccgcctgaacgccctcggcaagtcagaatttcaaacttataagaaatctgggatacaggaggtcgaccggaccctggcaaaggaaggaatcaaacgaggcgagacagatcaccatgctgtgagtagagggtcggccaagttaaggtggttcgttgagcgcaatatggtgacgcctgaaggaaaagtagtggaccttggctgcggtagagggggatggagctactattgtggcggtctgaagaacgtcagagaggttaagggcctcaccaaagggggacccggccacgaggaacctattccaatgtccacttacgggtggaatctagtgcgtctgcagtctggagtcgatgtgtttttcataccccctgaaaagtgcgacacattgctgtgtgatattggcgagtcaagcccaaaccccaccgtagaggcaggtaggactctccgggtgcttaatctggttgaaaactggttgaataacaatacacagttctgcatcaaagtgctgaacccgtacatgccttccgtcatagagaagatggaagctctccaacgcaaatatgggggagccttagtgcgaaatccactgagtagaaactctacccatgagatgtactgggtcagcaatgcctcaggcaacattgtgtccagtgttaatatgatcagcaggatgcttatcaaccggtttacgatgcgccacaagaaggcgacctatgaacccgacgtagacctgggctctgggacaagaaacattggaatagagtccgagatccctaatctagatattatcggtaaaaggattgaaaagatcaaacaggagcatgaaacttcatggcactacgaccaggatcacccatataagacctgggcttaccatggcagctatgagacaaaacagactgggtcggcatctagtatggtgaacggagtcgtgcgactcctgaccaagccctgggacgttttgccgacagtgacccaaatggccatgactgatacgacacctttcggccagcagcgggtctttaaggaaaaagtggacacccgtactcaggagcccaaggagggtaccaaaaagctgatgaaaataacagctgaatggctctggaaggagcttgggaaaaagaagacgccaagaatgtgtacccgcgaagagttcactaggaaagtacggtccaatgccgcactgggagccatctttacagatgagaacaagtggaaaagcgctagagaagcggtggaggactcacgcttctgggaattagttgataaggagaggaatctgcacttggaaggcaaatgcgagacctgtgtctacaacatgatgggcaagcgagagaagaaactcggggaatttggaaaggccaaaggttcccgggcaatttggtacatgtggctgggcgctagattcctagagtttgaagcccttgggttcctgaatgaggaccattggttttctagggaaaacagcctcagtggagtggagggcgagggtctgcacaagttggggtatatcctgcgcgatgtgtccaaaaaggaaggaggcgcaatgtacgccgacgacactgctggctgggatacacgtattaccctcgaggaccttaagaatgaagagatggtcacaaaccacatggaaggggagcataaaaagctggccgaggcgatcttcaaattaacttatcaaaataaggttgtgcgggtacagagacctacccccaggggaacggtgatggatattataagccgccgagaccagcggggttctggccaagtcgggacctacggactgaacacatttactaatatggaagcacagttgatcagacagatggagggcgaaggtgtgttcaaaaacattcagcacctcaccgttacagaggaggtggccgtccaaaattggctggctagggtggggcgcgaaagactatcacggatggccatcagtggagatgactgcgtagttaagccacttgatgacaggttcgcaaacgctctgactgccctcaacgatatgggcaagatccgtaaagacattcagcagtgggagccctccaagggctggaatgattggacccaggtgcctttttgcagccatcacttccatgaactgataatgaaagacgggcgagtcttggtggtgccatgtcgcaaccaagatgagttaatcggacgggctcggatttctcagggtgccggctggtcgctgagggaaacggcatgcctcgggaagtcatatgcgcagatgtggagccttatgtactttcaccgcagagacctgcggctagccgctaatgccatctgttccgcagtcccgagtcactgggttcccacatctaggaccacttggagcattcatgctaaacacgagtggatgacaaccgaggacatgctgactgtgtggaaccgagtatggatccgtgaaaatccttggatggaggataagaccccagtggaatcctgggaggaaataccctatctcggaaagagagaggaccagtggtgcggctcattgatcggtctgacaagtcgcgccacgtgggccaaaaacattcaagccgcgatcaatcaggtccggtctcttattgggaacgaggaatacaccgattacatgcctagcatgaagaggttcagacgcgaggaagaggaagctggagtgctgtggtga

SEQ ID NO: 14813 - RNA, 9876 nt, synthetic construct
  misc_feature 1..9876: note = derived and/or modified CDS sequence (opt3) from DENV-2__FJ461321__SS-prME
  source 1..9876: mol_type = other RNA
agcgccggcatgataattatgctgatacccaccgtgatggctttccacctcactactagaaacggggagcctcatatgatcgtcgggattcaagaaaagggtaaatcccttctgtttaagacggaggacggcgttaatatgtgcaccttgatggcaatggatttaggggaactgtgtgaggacacgatcacttacaaatgcccattactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcattcagtgggcaacgacactgggaaacacggaatggaaatcaaggtaacgccgcagagtagcattacagaggccgaactgaccggctatggtactgtgaccatggagtgttctcccagaacagggcttgatttcaatgaaatggtcctgttgcaaatggagaacaaggcttggctcgtgcacaggcagtggtttctggacttacctctgccatggctccccggcgccgataagcaggagtccaattggatccagaaggaaacccttgttactttcaaaaaccctcatgcaaagaaacaagacgtggtcgtgctgggatcacaggagggcgctatgcacacagccttgacgggggcgaccgaaatacagatgagcagtggaaatctactgtttactggtcatctcaagtgccggctgcgtatggacaaacttcaactgaagggcatgtcttactccatgtgtacagggaagttcaaagtagttaaggagattgccgagacccagcacggaacaatcgtgatccgcgtccagtatgaaggcgatggtagcccatgcaaaattcccttcgagatcatggacttggaaaagagatacgtgctcgggaggctgattactgtcaacccgatagtgaccgagaaagattcgcctgttaacatcgaagcagagcccccatttggcgactcttacattatcatcggagtggagcctggccagttaaagctgaattggttcaagaaagggtcctcaattggacaaatgtttgaaacgaccatgcggggtgctaagcgaatggccatactaggcgatacagcttgggacttcgggagtctcggaggcgtatttactagcatcggtaaagccctgcatcaggtcttcggggcaatttatggcgccgctttttccggagtgtcttggaccatgaagatccttattggcgttatcataacatggatcgggatgaacagccgctcaacaagtttgtccgtgagcctggtcctcgtgggaattgtaaccctgtaccttggcgtgatggttcaggcggattctggttgtgtcgtgtcatggaaaaataaggagctgaagtgcgggagtggaatcttcattacggacaacgtgcacacatggaccgaacagtataaatttcaacccgagagcccatccaagttggcatctgccatccagaaagctcaggaagagggcatatgtggtattagatcggtcactaggctcgagaatctgatgtggaagcagatcacacccgaattaaaccacattctggccgagaatgaagttaaactaaccatcatgactggcgatatacgggggatcatgcaagcaggaaagcgcagcctcagacctcagccaaccgagctgaaatactcctggaagacatggggcaaggccaaaatgctttcaacggaaagttataaccagaccttcttgattgacgggccggagactgctgagtgccccaatacaaacagggcctggaactctctggaagtggaggattacggatttggcgtgttcaccacaaacatctggctcaagctgaaagaaaagcaggacgcattttgtgacagcaaattaatgtccgcggctattaaggataatcgtgccgtacatgcagacatgggttattggatcgagtcagccctgaacgatacttggaagatagagaaagctagcttcattgaagtcaagaattgccactggcctaaatctcataccctttggtccaacggggtgttggagagtgaaatgatcatcccaaagaacctcgccggacccgttagccaacacaattaccggcctggctaccacacgcagattgcaggtccatggcatctgggcaaactagagatggacttcgatttttgtgacgggacaaccgtgatcgtcactgaagattgcggaaaccgaggcccctctctgagaaccacaactgcttccgggaagctcattaccgagtggtgctgtaggtcatgcacactgccgcctcttcgctatcggggagaggacggctgttggtacggtatggaaataagaccattgaaggagaaagaagagaatctggtgaacagtttagttacggccgggcacggacaggtggataatttcagcctcggcgtactgggtatggcgctttttctggaagagatgttgaggacccgcgtcggcactaagcatgccatcctcctggtggctgtgtcgttcgtcacactaattaccgggaacatgtcctttaaagacctgggacgagttgtggtaatggtgggcgcaactatggccgatgacatcgggatgggagtcacatatctcgctctgcttgccgcattcaaggtgcggcccacctttgcggccggcttgctgttacgtaaactcacgtctaaggagctgatgatgactaccattggtatcgttcttctgagccaatcaacaatacctgaaaccgtgctagagctcactgatgctctggccttggggatgatggtcctgaagatcgtgagaaatatggaaaaataccagttagcagttacaattatggctatcctctgcgtgcccaacgccgtcattctgcagaatgcatggaaggtaagttgtaccatccttgccgtggtttccgtgtctccactgttgctcacaagctcccagcagaaaactgactggatacctctggctctaaccattaagggactgaaccccacggcgatcttccttacaaccctctcaaggactaataaaaagcgcagctggccactgaacgaggccatcatggcagtcggcatggtgagtattttggcttcttccctgctcaaaaatgacataccgatgaccggccctctagtagccgggggactgcttacagtgtgctatgtcctgactggtcggagcgccgatttggaactcgagagagctaccaacgttaagtgggaggaccaggcagaaatctcgggctcatctcccattctgagtatcacgatttccgaggatgggagcatgtctatcaagaatgaagaggaggaacagacactaaccatactgatcaggactggacttctcgtgattagcggcctgtttccaatctccattcccatcacagccgcggcttggtacttgtgggaggtgaaaaagcagcgagccggtgtcttatgggacgtgccttcaccaccccctatggggaaagcagaactggaggatggagcctatcgcataaagcaaaaaggcattctcggctacagtcagatcggggctggagtttacaaggaaggtaccttccacactatgtggcatgtaacacggggcgcagtgctgatgcacaaggggaaaagaatcgagccgagctgggccgacgtcaagaaagatcttatttcttatggaggcggttggaagctggagggggaatggaaagagggagaagaggtgcaggttttggcgctagaaccaggcaagaaccccagggctgtgcagaccaagcctggcctgtttaaaacgaacactgggaccatcggagccgtctccctcgacttctcaccaggtacaagtggcagccccataattgataagaaagggaaggtggtaggactgtacggcaatggtgtcgtgacccgttccggggcatatgtttctgccatcgctcaaacagagaaatcgattgaggacaaccctgaaatcgaggatgacatatttcgcaagcggagacttactattatggatttacacccgggagccggcaagaccaaaaggtacctgcccgcaatcgtgcgagaagctatcaagcggggcctccgcacgttgattctggccccaacaagagtcgtggcggccgagatggaagaggcactcagggggctgcctatccggtatcagactcccgctattcgagccgagcataccggaagagaaatagttgaccttatgtgtcacgctacattcaccatgcgcctgttgagcccagtgagggtccctaattacaacctaatcattatggacgaggcacatttcactgatcccgcctcaatcgccgctcgtggttatatctccacccgggtggaaatgggcgaggcggcagggatttttatgacagccacgccaccgggaagtagagaccctttcccccagtctaatgctccaataatcgatgaggaaagggagattcccgaacgcagctggaactccggccacgagtgggtaactgactttaaaggtaagaccgtgtggttcgttccttcaatcaaagccgggaatgatattgcagcctgcctgcgaaagaacggaaagaaagtcatccaactctctagaaagacatttgacagcgaatacgtgaaaacccggactaatgattgggacttcgtggtcacaaccgatataagtgagatgggcgctaactttaaggcggagagggtaatcgacccacgccgttgtatgaaacccgtgattttaacggatggcgaagagagagttatcctggccgggcctatgccggtgactcattccagcgcagctcagcggaggggacgcattggtcgaaatccaaagaacgaaaatgaccagtacatctatatgggcgagccccttgaatctgacgaggattgcgcccactggaaagaggcaaagatgctgctcgacaacataaatacacctgaagggattatcccctcaatgttcgagccagaaagagagaaggtcgatgccattgacggagaataccggttgaggggcgaggctcgcaaaacctttgtggatctgatgagaaggggtgacctccctgtttggctggcctataaggtggcggcagaggggatcaactacgccgatcggcgttggtgtttcgacggcatcaaaaataatcagatccttgaagagaacgtcgaagtggagatttggaccaaggagggagaacgcaaaaagctaaagccccgatggctggatgctagaatctattccgacccattggccttaaaagagtttaaggagttcgctgcaggcaggaaaagtctgactctcaatctgattacagagatggggcggcttcctaccttcatgacacaaaagactcgcgatgccctggacaacctcgctgtattgcacacggccgaagcaggaggtagagcgtacaatcatgccctgagcgagctaccggagaccctggaaacactccttctgttaactttgctggctaccgtgacaggcgggatctttctcttcctgatgtcgggaaggggcataggtaaaatgacccttgggatgtgctgcattatcactgcctctatcctgctctggtatgcacagattcagccccactggatcgctgcctccataattttggagtttttcctgatcgttttactaattccagaacctgagaagcagcggacgccccaagataaccagctgacctacgtcgtgatcgcaatactcacagtggtcgccgctactatggcgaatgaaatgggctttcttgagaagaccaaaaaggacctgggattgggcagcatcgccacacagcagccagagtcaaacattctggacatcgatctccgacctgcaagtgcttggaccctgtacgccgttgccactacattcgtgacgcccatgcttagacattctattgaaaattccagcgtaaacgtgtcactcaccgcaatcgctaatcaagccactgtcctgatggggttgggaaaaggttggccgctgagtaagatggacattggcgtgccattactagcgatcgggtgttatagccaggttaaccctataacactgaccgctgccctccttctgttggtggcacactacgccattatcggacccggcctgcaggctaaagcaacccgcgaggcccagaagagggcggctgccggtatcatgaagaatccaacagtcgatgggattactgtaatagacctcgatcccatcccttatgacccgaaatttgaaaagcaactgggccaggtgatgcttttaattctgtgcgttacacaggtgctcatgatgcggaccacatgggcattgtgtgaggccctgactctagctaccggacccatctccacactgtgggaaggcaacccagggcgtttctggaataccactattgccgtctctatggcaaacatctttagaggaagctacctcgctggcgccggtcttctgttctccataatgaaaaatacgacaaacaccaggcgcgggactggaaacatcggcgagaccttgggtgagaagtggaaatcacggctgaatgcgctcggcaagtctgaatttcaaatttataaaaagagtgggatccaggaggtggatcgaacactggccaaggaaggaattaaaagaggcgagactgaccaccatgcagtctcgagggggagcgctaagttacgctggttcgtggagcggaacatggttacccctgaaggaaaagtggtagatcttggctgcggtagagggggatggtcctactattgtggcggtctgaagaatgtgcgtgaggtcaaaggcctcacaaaagggggacccggccacgaggaacctatcccaatgtctacgtacgggtggaacctagttaggctgcagtcaggagtggacgtctttttcataccccctgaaaagtgcgataccttgctgtgtgacattggcgagagctccccaaatcccactgtggaggccggtcggacactccgcgtacttaacctggtggaaaattggttgaacaataacacccagttctgcatcaaagttctgaatccgtacatgcctagtgtgatcgagaagatggaagcactccaacgaaaatatgggggagctttagtcagaaacccactgtctaggaatagcactcatgagatgtactgggtgtcaaacgcctccggcaatattgtcagtagcgtgaacatgatatctcggatgcttatcaaccgctttacaatgagacacaagaaagccacctatgaacccgatgttgacctgggctccgggacgaggaatattggaatcgagtcagagattcctaacctagacatcataggtaagcgaatcgaaaagattaaacaggagcatgaaaccagctggcactacgatcaggaccacccatataagacatgggcgtaccatggctcgtatgagactaaacagaccgggtctgctagttccatggtaaatggagtggtccggctcctgacaaagccctgggatgtgttgccgactgttacccaaatggcaatgacagacaccactcctttcggccagcagcgtgtgtttaaagaaaaggtcgatacgagaacacaggagcccaaggagggtaccaaaaagctgatgaaaatcactgccgaatggctctggaaggagcttgggaaaaagaaaaccccacgcatgtgtacaagggaagagttcacgcggaaggtgagaagcaacgctgccctgggagcaatttttaccgacgagaataagtggaaatcagcccgcgaagctgtagaggattccaggttctgggaattagtggacaaggagcgaaacctgcacttggaaggcaaatgcgagacttgtgtttacaatatgatgggcaagcgggagaaaaagctcggggaatttggaaaggcgaaaggttctagagccatctggtacatgtggctgggcgcaaggttcctagagtttgaagctcttgggttcctgaacgaggatcattggtttagccgcgaaaatagtctctccggagtcgagggcgagggtctgcacaagttggggtatattctgcgtgacgtgagcaaaaaggaaggaggcgccatgtacgcagatgacacagccggctgggacacccggataactctcgaggatcttaaaaacgaagagatggtgacaaatcacatggaaggggagcataagaagctggctgaggccatcttcaaattaacctatcaaaacaaggtcgttagagtgcagaggcctacaccccgcggaactgtaatggacattatctctcgacgggatcagagaggttcaggccaagtggggacctacggactgaatacgtttaccaacatggaagcgcagttgatcaggcagatggagggcgaaggtgtcttcaaaaatattcagcacctcacagtgactgaggaggttgcagtgcataactggctggcccgcgtcgggagagaacggctaagtaggatggctatatccggagacgattgcgtggtaaagccacttgacgatcgtttcgccaacgcactgaccgctctcaatgacatgggcaaaatccgaaaggatattcaacagtgggagcccagcaagggctggaacgactggacacaggttcctttttgctctcaccatttccacgaactgatcatgaaagatgggcgcattttggtggtcccatgtagaaatcaggacgagttaatcggacgggccaggatatcgcaaggtgctggctggtcactgcgcgaaactgcctgcctcggaaagagctatgcacagatgtggtcccttatgtactttcacagacgggatctgaggctagcggccaacgctatctgtagtgccgtgccgtctcattgggtgcccaccagccgaacgacatggtccattcacgcaaaacatgagtggatgaccactgaggacatgctgacagtctggaatcgtgtttggatcagagaaaacccttggatggaggacaagaccccagtggaatcatgggaggaaattccctatctcggaaaacgcgaggatcagtggtgcggcagtttgatcggtctgacttctcgggctacctgggccaagaatatacaggcagccattaaccaagtaaggagccttatcgggaatgaggaatacacagactacatgccttccatgaagagattccgccgggaggaagaggaagcgggagtgctgtggtga

SEQ ID NO: 14814 - RNA, 9876 nt, synthetic construct
  misc_feature 1..9876: note = derived and/or modified CDS sequence (opt3) from DENV-2__FJ410228__SS-prME
  source 1..9876: mol_type = other RNA
agcgcaggcatgatcattatgctgataccaaccgtgatggctttccacctcactactcgaaacggggagcctcatatgatcgtcggtattcaagaaaagggaaaatcccttctgtttaagacggaggacggcgttaatatgtgcaccttgatggcaatggatttaggggaactgtgtgaggacacgatcacttacaaatgcccattactcaggcaaaacgaaccggaggatattgactgttggtgcaattctacctcaacatgggtgacctatggaacttgtacaaccacgggcgagcaccggcgcgaaaagcgaagtgtagcactggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaagacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaatggaaatcaaggtaacgccgcagtcaagtattacagaggctgaactgaccggctatggtactgtgaccatggagtgtagccccagaacagggcttgatttcaatgaaatggtcctgttgcaaatggagaacaaagcctggctcgtgcacaggcagtggtttctggacttacctctgccatggctccccggcgcagataagcaggagtctaattggatccagaaggaaacccttgttactttcaaaaaccctcatgctaagaaacaagacgtggtcgtgctgggatcccaggagggcgccatgcacacagcgttgacgggggccaccgaaatacagatgtcaagcggaaatctactgtttactggtcatctcaagtgccggctgcgtatggacaaacttcaactgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccagttaaagctgaattggttcaagaaagggtcttccattggacaaatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacagtataaatttcaacccgagagtccaagcaagttggcctccgctatccagaaagcccaggaagagggcatatgtggtattagatctgtcactaggctcgagaatctgatgtggaagcagatcacacccgaattaaaccacattctggcagagaatgaagttaaactaaccatcatgactggcgatatacgggggatcatgcaagccggaaagcgctcgctcagacctcagccaaccgagctgaaatacagctggaagacatggggcaaggctaaaatgctttccacggaatcatataaccagaccttcttgattgacgggccggagactgccgagtgccccaatacaaacagggcatggaatagtctggaagtggaggattacggatttggcgtgttcaccacaaacatctggctcaagctgaaagaaaagcaggacgcgttttgtgactctaaattaatgagcgctgccattaaggataatcgtgcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcaacacaattaccggcctggctaccacacgcagattgctggtccatggcatctgggcaaactagagatggacttcgatttttgtgacgggacaaccgtgatcgtcactgaagattgcggaaaccgaggccccagcctgagaaccacaactgcctctgggaagctcattaccgagtggtgctgtaggtcctgcacactgccgcctcttcgctatcggggagaggacggctgttggtacggtatggaaataagaccattgaaggagaaagaagagaatctggtgaactcattagttacggcggggcacggacaggtggataatttcagtctcggcgtactgggtatggccctttttctggaagagatgttgaggacccgcgtcggcactaagcatgctatcctcctggtggcagtgagcttcgtcacactaattaccgggaacatgtcgtttaaagacctgggacgagttgtggtaatggtgggcgccactatggctgatgacatcgggatgggagtcacatatctcgccctgcttgcagcgttcaaggtgcggcccacctttgccgctggcttgctgttacgtaaactcacgtccaaggagctgatgatgactaccattggtatcgttcttctgtctcaaagcacaatacctgaaaccgtgctagagctcactgatgccctggcattggggatgatggtcctgaagatcgtgagaaatatggaaaaataccagttagctgttacaattatggccatcctctgcgtgcccaacgcagtcattctgcagaatgcctggaaggtatcatgtaccatccttgctgtggttagtgtgtccccactgttgctcacatctagccagcagaagactgactggatacctctggcgctaaccattaagggactgaaccccacggccatcttccttacaaccctctccaggactaataaaaagcgctcatggccactgaacgaggcaatcatggctgtcggcatggtgagcattttggccagttctctgctcaaaaatgacataccgatgaccggccctctagtagccgggggactgcttacagtgtgctatgtcctgactggtcggtccgctgatttggaactcgagagagcaaccgacgttaagtgggaggatcaggccgaaatcagcggctcgtcacccattctgtctatcacgattagtgaggacgggtccatgagcatcaagaacgaagaggaggaacagacactaaccatactgatcaggactggacttctcgtgatttctggcctgtttccaatcagcattcccatcacagcggctgcctggtacttgtgggaggtgaaaaagcagcgagccggtgtcttatgggatgtgccttccccaccccctatggggaaagccgaactggaggacggagcttatcgcataaagcaaaaaggcattctcggctactcacagatcggggcaggagtttacaaggaaggtaccttccacactatgtggcatgtaacacggggcgccgtgctgatgcacaaggggaaaagaatcgagccgagttgggcggatgtcaagaaagaccttattagctatggaggcggttggaagctggagggggaatggaaagagggagaagaggtgcaggttttggctctagaaccaggcaagaatcccagggccgtgcagaccaagcctggcctgtttaaaacgaacactgggaccatcggagcagtctctctcgatttctccccaggtacatcaggcagtcccataattgacaagaaagggaaggtggtaggactgtacggcaacggtgtcgtgacccgtagcggggcctatgtttccgctatcgcccaaacagagaaatctattgaggataatcctgaaatcgaggacgatatatttcgcaagcggagacttactattatggacttacacccgggagcaggcaagaccaaaaggtacctgcccgctatcgtgcgagaagccatcaagcggggcctccgcacgttgattctggcgccaacaagagtcgtggccgcagagatggaagaggctctcagggggctgcctatccggtatcagactcccgccattcgagctgagcataccggaagagaaatagttgaccttatgtgtcacgcaacattcaccatgcgcctgttgtcgccagtgagggtccctaactacaatctaatcattatggatgaggcccatttcactgaccccgccagcatcgctgcgcgtggttatatctcaacccgggtggaaatgggcgaggcagccgggatttttatgacagctacgccaccgggatccagagatcctttcccccagagtaacgccccaataatcgacgaggaaagggagattcccgaacgctcttggaatagcggccacgagtgggtaactgattttaacggtaaaaccgtgtggttcgttccttccatcaaggcagggaatgacattgccgcttgcctgcggaaaaacggaaagaaggtcatccaactctcaagaaaaacatttgattctgaatacgtgaagaccagaactaatgactgggatttcgtggtcacaaccgacataagcgagatgggcgcgaactttaaagccgagagggtaatcgatccacgccgttgtatgaagcccgtgattttaacggacggcgaagagagagttatcctggcagggcctatgccggtgactcatagttccgctgcccagcggaggggacgcattggtcgaaatcccaaaaacgaaaatgaccagtacatctatatgggcgagccccttgaaaacgatgaggactgcgcacactggaaggaggccaaaatgctgctcgataatataaacacacctgaagggattatccccagcatgttcgagccagaaagagagaaggtcgacgctattgatggagaataccggttgaggggcgaggcccgcaagacctttgtggacctgatgagaaggggtgatctccctgtttggctggcgtataaagtggcagccgaggggatcaactacgctgaccggcgttggtgtttcgatggcataaagaataaccagatccttgaagagaatgtcgaagtggagatttggaccaaagagggagaacgcaagaaactaaagccccgatggctggacgccagaatctattctgatccattggctttaaaggagtttaaagagttcgcagccggcaggaagtcactgactctcaacctgattacagagatggggcggcttcctaccttcatgacacagaaaactcgcgacgctctggataatctcgccgtattgcacacggcagaagcgggaggtagagcctacaaccatgctctgtccgagctaccggagaccctggaaacactccttctgttaactttgctggccaccgtgacaggcgggatctttctcttcctgatgagtggaaggggcataggtaagatgacccttgggatgtgctgcattatcactgcaagcatcctgctctggtatgctcagattcagccccactggatcgccgcatcgataattttggagtttttcctgatcgttttactaattccagaacctgagaaacagcggacgccccaagacaatcagctgacctacgtcgtgatcgccatactcacagtggtcgctgcgactatggccaacgaaatgggctttcttgagaagaccaagaaagacctgggattgggctctatcgcaacacagcagccagagtccaatattctggatatcgacctccgacctgctagcgcctggaccctgtacgccgttgcaactacattcgtgacgcccatgcttagacattcaattgaaaacagttctgtaaatgtgtccctcaccgctatcgccaaccaagcgactgtcctgatggggttgggaaagggttggccgctgagcaaaatggatattggcgtgccattactagctatcgggtgttattcacaggttaatcctataacactgaccgccgcactccttctgttggtggcccactacgctattatcggacccggcctgcaggcaaaggccacccgcgaggcgcagaaaagggctgccgcaggtatcatgaagaacccaacagtcgacgggattactgtaatagatctcgaccccatcccttatgatccgaagtttgaaaaacaactgggccaggtgatgcttttaattctgtgcgttacacaggtgctcatgatgcggaccacatgggccttgtgtgaggctctgactctagccaccggacccatcagtacactgtgggaaggcaatccagggcgtttctggaacaccactattgcagtcagcatggctaatatctttagaggatcctacctcgccggcgcgggtcttctgttctctataatgaagaacacgacaaacaccaggcgcgggactggaaatatcggcgagaccttgggtgagaaatggaaaagccggctgaacgccctcggcaaatccgaatttcaaatttataagaaatcagggatccaggaggtggaccgaacactggcaaaggaaggaattaagagaggcgagactgatcaccatgctgtctctagggggagtgccaaattacgctggttcgtggagcggaatatggttacccctgaaggaaaggtggtagaccttggctgcggtagagggggatggtcgtactattgtggcggtctgaaaaacgtgcgtgaggtcaagggcctcacaaaagggggacccggccacgaggaacctatcccaatgagcacgtacgggtggaatctagttaggctgcagtccggagtggatgtctttttcataccccctgaaaagtgcgacaccttgctgtgtgatattggcgagtcttcaccaaaccccactgtggaggcaggtcggacactccgcgtacttaatctggtggaaaactggttgaataacaatacccagttctgcatcaaggttctgaacccgtacatgcctagcgtgatcgagaaaatggaagctctccaacgaaagtatgggggagccttagtcagaaatccactgtccaggaacagtactcatgagatgtactgggtgtctaatgccagcggcaacattgtctcatccgtgaacatgataagtcggatgcttatcaatcgctttacaatgagacacaaaaaggcgacctatgaacccgacgttgacctgggcagcgggacgaggaacattggaatcgagtctgagattcctaatctagatatcataggtaaacgaatcgaaaagattaagcaggagcatgaaacctcctggcactacgaccaggatcacccatataaaacatgggcttaccatggctcatatgagactaagcagaccgggagcgcatcgtctatggtaaacggagtggtccggctcctgacaaaaccctgggacgtgttgccgactgttacccaaatggccatgacagataccactcctttcggccagcagcgtgtgtttaaggaaaaagtcgacacgagaacacaggagcccaaggagggtaccaagaaactgatgaagatcactgctgaatggctctggaaagagcttgggaagaaaaagaccccacgcatgtgtacaagggaagagttcacgcggaaagtgagaagtaatgccgcactgggagccatttttaccgatgagaacaagtggaagtccgctcgcgaagcggtagaggacagcaggttctgggaattagtggataaagagcgaaatctgcacttggaaggcaagtgcgagacttgtgtttacaacatgatgggcaaacgggagaagaaactcggggaatttggaaaggccaagggttcaagagcaatctggtacatgtggctgggcgctaggttcctagagtttgaagcccttgggttcctgaatgaggaccattggttttcccgcgaaaactctctcagcggagtcgagggcgagggtctgcacaaattggggtatattctgcgtgatgtgagtaagaaagaaggaggcgcaatgtacgccgacgacacagctggctgggatacccggataactctcgaggaccttaagaatgaagagatggtgacaaaccacatggaaggggagcataaaaagctggccgaggcgatcttcaagttaacctatcaaaataaagtcgttagagtgcagaggcctacaccccgcggaactgtaatggatattatctcccgacgggaccagagaggtagcggccaagtggggacctacggactgaacacgtttaccaatatggaagcacagttgatcaggcagatggagggcgaaggtgtcttcaagaacattcagcacctcacagtgactgaggaggttgccgtgcataactggctggctcgcgtcgggagagaacggctatctaggatggccatatcaggagatgactgcgtggtaaaaccacttgatgaccgtttcgcaaatgctctgaccgccctcaacgatatgggcaagatccgaaaagacattcaacagtgggagcccagtaagggctggaatgattggacacaggttcctttttgctcccaccatttccacgaactgatcatgaaggacgggcgcattttggtggtcccatgtagaaaccaggatgagttaatcggacgggctaggataagccaaggtgccggctggtctctgcgcgaaactgcatgcctcgggaaatcgtatgcgcagatgtggtcacttatgtactttcacagacgggacctgaggctagccgctaatgccatctgtagcgcagtgccgtcccattgggtgcccaccagtcgaacgacatggtctattcacgctaagcatgagtggatgaccactgaggacatgctgacagtctggaaccgtgtttggatcagagaaaatccttggatggaggataaaaccccagtggaaagctgggaggaaattccctatctcggaaagcgcgaggaccagtggtgcggctccttgatcggtctgacttcacgggccacctgggccaaaaacatacaggccgcgattaatcaagtaaggagtcttatcgggaacgaggaatacacagattacatgccttctatgaagagattccgccgggaggaagaggaagctggagtgctgtggtga

SEQ ID NO: 14815 - RNA, 9876 nt, synthetic construct
  misc_feature 1..9876: note = derived and/or modified CDS sequence (opt3) from DENV-2__FJ410233__SS-prME
  source 1..9876: mol_type = other RNA
agcgccggcatgatcattatgctgatacccaccgtgatggctttccacctcacaactagaaacggggagcctcatatgatcgtcggaattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagagcaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccaattaaagctgaattggttcaagaaagggtcttccattggacagatgtttgaaacgaccatgcggggtgccaagcgaatggctatactaggcgatacagcctgggacttcgggtcactcggaggcgtatttactagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacaatataaatttcagcccgagagtccaagcaagttggcctccgctatccagaaagcccaggaagagggcatatgtggtattagatctgtcactaggctcgagaatctgatgtggaagcaaatcacacccgaattaaaccacattctggcagagaatgaagttaaactaaccatcatgactggcgatataaaggggatcatgcaggccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaagacgcgttttgtgactctaagttaatgagcgctgccattaaggataatagggcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatcccaaaaaacctcgcaggacccgttagtcagcacaattaccgtcctggctaccacacgcagattgctggtccatggcatctgggcaagctagagatggacttcaacttttgtgatgggacaaccgtgatcgtcactgaagactgcggaaatcggggccccagcctgcgaaccacaactgcctctgggaagctcattaccgagtggtgctgtagatcctgcacactgccgcctcttaggtatcgcggagaggatggctgttggtacggtatggaaatacggccattgaaagagaaggaagagaacctggtgaattcattagttacggcggggcacggacaagtggacaacttcagtctcggcgtactgggtatggccctttttctggaagagatgttgagaaccagggtcggcactaaacatgctatcctcctggtggcagtgagcttcgtcacactaattaccgggaatatgtcgtttaaggatctgggacgcgttgtggtaatggtgggcgccactatgacagacgatatcgggatgggagtcacctatctcgctctgcttgccgcattcaaagtgcgacccacgtttgcggccggcttgctgttacggaagctcacttccaaggagctgatgatgaccacaattggtatcgttcttctgtctcagagcaccatacctgaaactgtgctagagctcacagacgctctggccttggggatgatggtcctgaaaatcgtgcgtaacatggaaaagtaccagttagcagttaccattatggctatcctctgcgtgcccaatgccgtcattctgcagaacgcatggaaagtatcatgtacaatccttgccgtggttagtgtgtccccactgttgctcacttctagccaacagaagaccgattggatacctctggctctaacgattaaaggactgaatcccacagcgatcttccttaccactctctccagaaccaacaagaaaaggtcatggccactgaatgaggccatcatggcagtcggcatggtgagcattttggctagttctctgttaaagaacgacataccgatgacaggccctctcgtagccgggggactgcttactgtgtgctatgtcctgaccggtcgctccgccgacttggaactcgagcgggctacggatgttaagtgggaggaccaggcagaaatcagcggctcgtcacccattctgtctatcacaattagtgaggatgggtccatgagcatcaaaaatgaagaggaggaacagaccctaactatactgatcagaacaggacttctcgtgatttctggcctgtttccaatcagcattcccatcaccgccgcggcttggtacttgtgggaggtgaagaaacaaagggccggtgtcttatgggacgtgccttccccaccccctatggggaaggcagaactggaggatggagcctatcgaataaaacagaagggcattctcggctactcacagatcggggctggagtttacaaggaaggtactttccacacaatgtggcatgtaacccgcggcgcagtgctgatgcacaaagggaagcggatcgagccgagttgggccgacgtcaaaaaggatcttattagctatggaggcggttggaaactggagggggaatggaaggagggagaagaggtgcaggttttggcgctagaaccaggcaagaaccccagagctgtgcaaacgaaacctggcctgtttaagactaacaccgggacaatcggagccgtctctctcgacttctccccaggtacctcaggcagtcccataattgataaaaaggggaaagtggtaggactgtacggcaatggtgtcgtgacaaggagcggggcatatgtttccgccatcgctcagactgagaagtctattgaggacaaccctgaaatcgaggatgacatatttcgtaagcgccggcttaccattatggatttacacccgggagccggcaaaacgaagagatacctgcccgcaatcgtgagggaagctatcaaacgaggcctccggacattgattctggccccaactcgcgtcgtggcggccgagatggaagaggcactcagagggctgcctatcaggtatcagacccccgctattcgggccgagcatacaggacgagaaatagttgaccttatgtgtcacgctaccttcactatgagactgttgtcgccagtgcgcgtccctaattacaacctaatcattatggacgaggcacatttcaccgatcccgccagcatcgccgctaggggttatatctcaacacgtgtggaaatgggcgaggcggcagggatttttatgacggccactccaccgggatcccgggaccctttcccccaaagtaatgctccaataatcgatgaggaaagagagattcccgaaaggtcttggaacagcggccacgagtgggtaaccgactttaagggtaaaacagtgtggttcgttccttccatcaaggccgggaatgatattgcagcctgcctgcgcaagaacggaaaaaaggtcatccagctctcacgaaaaacctttgactctgaatacgtgaagactagaacaaatgattgggacttcgtggtcaccacggatataagcgagatgggcgctaactttaaagcggagcgggtaatcgacccaaggcgctgtatgaagcccgtgattttaactgatggcgaagagcgtgttatcctggccgggcctatgccggtgacacatagttccgcagctcagagacggggaaggattggtcgcaatccaaaaaacgaaaatgaccagtacatctatatgggcgagccccttgaaaacgacgaggattgcgcccactggaaggaggcaaagatgctgctcgacaatataaacacccctgaagggattatccccagcatgttcgagccagaacgagagaaagtcgatgccattgacggagaatacagattgcggggcgaggctaggaagacctttgtggatctgatgcgcagaggtgacctccctgtttggctggcctataaagtggcggcagaggggatcaactacgccgataggcggtggtgtttcgacggcataaagaataaccaaatccttgaagagaatatggaagtcgagatttggactaaagagggagaacgtaagaagctaaaaccccgctggctggatgctcgaatctattctgacccattggccttaaaggagtttaaagaattcgctgcaggcagaaagtcactgacactcaacctgattaccgagatggggaggcttcctacattcatgactcagaaaacgcgggatgccctggacaatctcgctgtgttgcacaccgccgaagcaggaggtcgcgcgtacaaccatgccctgtccgagctaccggagacactggaaactctccttctgttaaccttgctggctacagtaaccggcgggatctttctcttcctgatgagtggaagaggcataggtaagatgactcttgggatgtgctgcattatcacggccagcatcctgctctggtatgcacagattcagccccactggatcgctgcctcgataattttggagtttttcctgatcgtgttactaattccagaacctgagaagcaaaggaccccccaggataatcagctgacatacgttgtcatcgcaatactcactgtggtggccgctaccatggcgaacgaaatgggctttcttgagaaaacaaagaaagacctgggattgggctctatcgccacccggcagccagagtccaatattctggacatcgatctccgacctgcaagcgcttggactctgtacgccgtcgccacaacgttcgttacccccatgcttagacattcaattgaaaacagttctgtgaatgtatccctcactgcaatcgctaaccaagccacagtgctgatggggttgggaaagggttggccgctgagcaaaatggacattggcgtcccattactagcgatcgggtgttattcacaggtgaatcctataaccctgaccgctgccctccttctgttggttgcacactacgccattatcggacccggcctgcaggctaaggcaacacgcgaggcccagaagagggcggctgccggtatcatgaaaaacccaactgtggatgggattacggtcatagacctcgatcccatcccttatgacccgaagtttgaaaaacaactgggccaggtaatgcttttagtgctgtgcgttacccaggtgctcatgatgcggacaacttgggcattgtgtgaggccctgaccctagctacaggacccattagtaccctgtgggaaggcaatccagggcgtttctggaacactacgatcgccgtcagcatggcaaatatttttagaggatcctacctcgctggcgccggtcttctgttctctatcatgaagaacacaaccaacactaggcgcgggaccggaaatatgggcgagacattgggtgagaaatggaagagccggctgaacgcgctcggcaaatccgaatttcaaatatataagaagtcagggatccaggaggtggatcgaactctggccaaagaaggaattaagagaggcgagaccgaccaccatgcagtctctagggggagtgctaaattacgctggttcgtggagcggaatatggttacacctgaaggaaaggtggtagatcttggctgcggtagagggggatggtcgtactattgtggcggtctgaaaaacgtgcgtgaggtcaagggcctcacgaaggggggacccggccacgaagagcctatcccaatgagcacctacgggtggaatctagttaggctgcagtccggagtggacgtctttttcattccccctgaaaaatgcgatactttgctgtgtgacatcggcgagtcttcaccaaaccccacagtggaggccggtcggaccctccgcgtacttaatctggtggaaaactggttgaataacaatactcagttctgcataaaggttctgaacccgtacatgcctagcgtgattgagaaaatggaagcactccaacgaaagtatgggggagctttagtcagaaatccactgtccaggaacagtacacatgagatgtactgggtgtctaatgccagcggcaacatcgtctcatccgtgaacatgatcagtcggatgcttattaatcgctttaccatgagacacaaaaaggccacgtatgaacccgatgttgacctgggcagcgggaccaggaacataggaatcgagtctgagattcctaatctagacatcattggtaagcgaatcgaaaaaataaagcaggagcatgaaacatcctggcactacgatcaggaccacccatataaaacttgggcgtaccatggctcatatgagaccaagcagacagggagcgcttcgtctatggtaaacggagtggtccggctcctgactaaaccctgggatgtgttgccgaccgttacacaaatggcaatgaccgacactacgcctttcggccagcagcgtgtgtttaaggaaaaggtcgatacaagaacccaggagcccaaagagggtactaagaaactgatgaagatcaccgccgaatggctctggaaagagcttgggaagaaaaagacaccacgcatgtgtacgagggaagagttcacccggaaggtgagaagtaatgctgccctgggagcaatttttactgacgagaacaaatggaagtccgcccgcgaagctgtagaggatagcaggttctgggaattagtggacaaagagcgaaatctgcacttggaaggcaagtgcgagacatgtgtttacaacatgatgggcaaacgggagaagaagctcggggaatttggaaaagcgaagggttcaagagccatctggtacatgtggctgggcgcaaggttcctagagtttgaagctcttgggttcctgaatgaggatcattggttttcccgcgaaaactctctcagcggagtcgagggcgagggtctgcacaaattggggtatattctgcgtgacgtgagtaagaaagaaggaggcgccatgtacgcagatgacaccgccggctgggacactcggatcacactcgaggatcttaagaatgaagagatggtgaccaaccacatggaaggggagcataagaaactggctgaggccattttcaagttaacatatcaaaataaagtcgttagagtgcagaggcctactccccgcggaaccgtaatggacataatctcccgacgggatcagagaggtagcggccaagtggggacgtacggactgaacacctttacaaatatggaagcgcagttgattaggcagatggagggcgaaggtgtcttcaagaacatccagcacctcactgtgaccgaggaggttgcagtgaaaaactggctggcccgcgtcgggagagaacggctatctaggatggctatctcaggagacgattgcgtggtaaagccacttgacgatcgtttcgccaatgcactgacagctctcaacgacatgggcaagattcgaaaagatatacaacagtgggagcccagtaagggctggaatgactggactcaggttcctttttgctcccatcacttccatgaactgatcatgaaagatgggcgcgtgttggtcgtgccatgtagaaaccaggacgagttaattggacgggccaggatcagccaaggtgctggctggtctctgcgcgaaaccgcctgcctcgggaagtcgtatgcacagatgtggtcacttatgtactttcacagacgggatctgaggctagcggccaatgctatttgtagcgccgtgccgtcccactgggtccccacgagtcgaacaacctggtctatccatgcaaaacacgagtggatgactacagaggacatgctgaccgtttggaaccgtgtgtggataagagaaaatccttggatggaggacaagactccagtagaaagctgggaggaaatcccctatctcggaaagcgcgaggatcagtggtgcggctccttgattggtctgacctcacgggctacatgggccaaaaacatccaggcagccattaatcaagtgaggagtcttatcgggaacgaggaatacacggactacatgccttctatgaagagattccgccgggaggaagaggaagcgggagtcctgtggtga

SEQ ID NO: 14816 - RNA, 9876 nt, synthetic construct
  misc_feature 1..9876: note = derived and/or modified CDS sequence (opt3) from DENV-2__FJ410237__SS-prME
  source 1..9876: mol_type = other RNA
agcgccggaatgatcattatgctgatacccaccgtgatggctttccacctcactactcggaacggggagcctcatatgatcgtcggcattcaggaaaagggtaaatcccttctgtttaagacggaggacggagttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccaattaaagctgaattggttcaagaaagggtcttccattggacagatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacaatataaatttcagcccgagagtccaagcaagttggcctccgctatccagaaagcccaggaagagggcatatgtggtattagatctgtcactaggctcgagaatctgatgtggaagcaaatcacacccgaattaaaccacattctggcagagaatgaagttaaactaaccatcatgactggcgatataaaggggatcatgcaggccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaagacgcgttttgtgactctaagttaatgagcgctgccattaaggataatagggcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatccccaagaacctcgcaggacccgttagtcagcacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaagctcattaccgagtggtgctgtagatcctgcacactgccgcctcttaggtatcgcggagaggacggctgttggtacggtatggaaatacggccattgaaagagaaggaagagaatctggtgaactcattagttacggcggggcacggacaagtggataatttcagtctcggcgtactgggtatggccctttttctggaagagatgttgagaaccagggtcggcactaaacatgctatcctcctggtggcagtgagcttcgtcacactaattaccgggaacatgtcgtttaaggacctgggacgcgttgtggtaatggtgggcgccactatgacagatgacatcgggatgggagtcacctatctcgctctgcttgccgcattcaaagtgcgacccacgtttgcggccggcttgctgttacggaagctcacttccaaggagctgatgatgaccacaattggtatcgttcttctgtctcagagcaccatacctgaaactgtgctagagctcacagatgctctggccttggggatgatggtcctgaaaatcgtgcgtaatatggaaaagtaccagttagcagttaccattatggctatcctctgcgtgcccaacgccgtcattctgcagaatgcatggaaagtatcatgtacaatccttgccgtggttagtgtgtccccactgttgctcacttctagccaacagaagaccgactggatacctctggctctaacgattaaaggactgaaccccacagcgatcttccttaccactctctccagaaccaataagaaaaggtcatggccactgaacgaggccatcatggcagtcggcatggtgagcattttggctagttctctgttaaagaatgacataccgatgacaggccctctcgtagccgggggactgcttactgtgtgctatgtcctgaccggtcgctccgccgatttggaactcgagcgggctacggacgttaagtgggaggatcaggcagaaatcagcggctcgtcacccattctgtctatcacaattagtgaggacgggtccatgagcatcaaaaacgaagaggaggaacagaccctaactatactgatcagaacaggacttctcgtgatttctggcctgtttccaatcagcattcccatcaccgccgcggcttggtacttgtgggaggtgaagaaacaaagggccggtgtcttatgggatgtgccttccccaccccctatggggaaggcagaactggaggacggagcctatcgaataaaacagaagggcattctcggctactcacagatcggggctggagtttacaaggaaggtactttccacacaatgtggcatgtaacccgcggcgcagtgctgatgcacaaagggaagcggatcgagccgagttgggccgatgtcaaaaaggaccttattagctatggaggcggttggaaactggagggggaatggaaggagggagaagaggtgcaggttttggcgctagaaccaggcaagaatcccagagctgtgcaaacgaaacctggcctgtttaagactaacaccgggacaatcggagccgtctctctcgatttctccccaggtacctcaggcagtcccataattgacaaaaaggggaaagtggtaggactgtacggcaacggtgtcgtgacaaggagcggggcatatgtttccgccatcgctcagactgagaagtctattgaggataatcctgaaatcgaggacgatatatttcgtaagcgccggcttaccattatggacttacacccgggagccggcaaaacgaagagatacctgcccgcaatcgtgagggaagctatcaaacgaggcctccggacattgattctggccccaactcgcgtcgtggcggccgagatggaagaggcactcagagggctgcctatcaggtatcagacccccgctattcgggccgagcatacaggacgagaaatagttgaccttatgtgtcacgctaccttcactatgagactgttgtcgccagtgcgcgtccctaactacaatctaatcattatggatgaggcacatttcaccgaccccgccagcatcgccgctaggggttatatctcaacacgtgtggaaatgggcgaggcggcagggatttttatgacggccactccaccgggatcccgggatcctttcccccaaagtaacgctccaataatcgacgaggaaagagagattcccgaaaggtcttggaatagcggccacgagtgggtaaccgattttaagggtaaaacagtgtggttcgttccttccatcaaggccgggaacgacattgcagcctgcctgcgcaagaatggcaagaaggtcatccagctctcacgaaaaacctttgattctgaatacgtgaagactagaacaaacgactgggatttcgtggtcaccacggacataagcgagatgggcgctaattttaaagcggagcgggtaatcgatccaaggcgctgtatgaagcccgtgattttaactgacggcgaagaacgtgttatcctggccgggcctatgccggtgacacatagttccgcagctcagagacggggaaggattggtcgcaaccccaaaaatgaaaacgaccagtacatctatatgggcgagccccttgaaaatgatgaggactgcgcccactggaaggaggcaaagatgctgctcgataacataaatacccctgaagggattatccccagcatgttcgagccagaacgagagaaagtcgacgccattgatggagaatacagattgcggggcgaggctaggaagacctttgtggacctgatgcgcagaggtgatctccctgtttggctggcctataaagtggcggcagaggggatcaactacgccgacaggcggtggtgtttcgatggcataaagaacaatcaaatccttgaagagaacgtcgaagtggagatttggactaaagagggagaacgtaagaagctaaaaccccgctggctggacgctcgaatctattctgatccattggccttaaaggagtttaaagagttcgctgcaggcagaaagtcactgacactcaatctgattaccgagatggggaggcttcctacattcatgactcagaaaacgcgggacgccctggataacctcgctgtattgcacaccgccgaagcaggaggtcgcgcgtacaatcatgccctgtccgagctaccggagacactggaaactctccttctgttaaccttgctggctacagtgaccggcgggatctttctcttcctgatgagtggaagaggcataggtaagatgactcttgggatgtgctgcattatcacggccagcatcctgctctggtatgcacagattcagccccactggatcgctgcctcgataattttggagtttttcctgatcgttttactaattccagaacctgagaagcaaaggaccccacaggacaaccagctgacatacgtcgtgatcgcaatactcactgtggtcgccgctaccatggcgaatgaaatgggctttcttgagaaaacaaagaaagacctgggattgggctctatcgccacccagcaaccagagtccaacattctggatatcgacctccggcctgcaagcgcttggactctgtacgccgttgccacaacgttcgtgacccccatgcttcgacattcaattgaaaatagttctgtaaacgtgtccctcactgcaatcgctaatcaggccacagtcctgatggggttgggaaagggttggccgctgagcaaaatggatattggcgtgccattactagcgatcgggtgttattcacaggttaaccctataaccctgaccgctgccctccttctgttggtggcacactacgccattatcggacccggcctgcaggctaaggcaacaagagaggcccaaaagcgcgcggctgccggtatcatgaaaaatccaactgtcgacgggattacggtaatagatctcgaccccatcccttatgatccgaagtttgaaaaacagctgggccaggtgatgcttttaattctgtgcgttacccaagtgctcatgatgaggacaacttgggcattgtgtgaggccctgaccctagctacaggacccatcagtaccctgtgggaaggcaacccagggcggttctggaatactacgattgccgtcagcatggcaaacatctttcgtggatcctacctcgctggcgccggtcttctgttctctataatgaagaatacaaccaacactagaagggggaccggaaacatgggcgagacattgggtgagaaatggaaaagccgcctgaatgcgctcggcaaatccgaatttcagatctataagaagtcagggattcaggaggtggaccggactctggccaaagaaggaatcaagcgaggcgagaccgatcaccatgcagtctctagagggagtgctaaattaaggtggttcgtggagcgcaacatggttacacctgaaggaaaggtggtagaccttggctgcggtagagggggatggtcgtactattgtggcggtctgaaaaatgtgagagaggtcaagggcctcacgaaagggggacccggccacgaggaacctattccaatgagcacctacgggtggaacctagttcgtctgcagtccggagtggatgtctttttcatcccacctgaaaaatgcgacactttgctgtgtgatataggcgagtcttcaccaaatcccacagtggaggccggtaggaccctccgggtacttaacctggtggaaaattggttgaacaataacactcaattctgcattaaggttctgaatccgtacatgcctagcgtgatcgagaaaatggaagcactccagcgcaagtatgggggagctttagtccgaaacccactgtccagaaatagtacacatgagatgtactgggtgtctaacgccagcggcaatatcgtctcatccgtgaacatgattagtaggatgcttataaaccggtttaccatgcgccacaaaaaggccacgtatgaacccgacgttgacctgggcagcgggaccagaaatatcggaattgagtctgagatccctaacctagatattatcggtaagaggatagagaaaatcaagcaggagcatgaaacatcctggcactacgaccaggatcacccatataaaacttgggcgtaccatggctcatatgagaccaagcaaacagggagcgcttcgtctatggtaaatggagtggtccgactcctgactaaaccctgggacgtgttgccgaccgttacacagatggcaatgaccgatactacgcctttcggccagcagcgggtgtttaaggaaaaggtcgacacacgtacccaagagcccaaagagggtactaagaaactgatgaagattaccgccgaatggctctggaaagagcttgggaagaaaaagacaccaagaatgtgtacgcgcgaagagttcaccaggaaggtgcggagtaacgctgccctgggagcaatctttactgatgagaataaatggaagtccgccagagaagctgtagaggacagccgcttctgggaattagtggataaagagaggaacctgcacttggaaggcaagtgcgagacatgtgtttacaatatgatgggcaaacgagagaagaagctcggggaatttggaaaagcgaagggttcacgggccatttggtacatgtggctgggcgcaagattcctagagtttgaagctcttgggttcctgaacgaggaccattggttttccagggaaaattctctcagcggagtcgagggcgagggtctgcacaaattggggtatatcctgcgcgatgtgagtaagaaagaaggaggcgccatgtacgcagacgacaccgccggctgggatactcgtattacactcgaggaccttaagaacgaagagatggtgaccaatcacatggaaggggagcataagaaactggctgaggccatattcaagttaacatatcagaacaaagtcgttcgggtgcagagacctactcccaggggaaccgtaatggatatcatttcccgccgagaccaacggggtagcggccaggtggggacgtacggactgaatacctttacaaacatggaagcgcagttgatcagacagatggagggcgaaggtgtcttcaagaatatccaacacctcactgtgaccgaggaggttgcagtgaaaaactggctggccagggtcgggcgcgaaagactatctcggatggctatttcaggagatgactgcgtggtaaagccacttgatgacaggttcgccaacgcactgacagctctcaatgatatgggcaagatacgtaaagacatccagcagtgggagcccagtaagggctggattgattggactcaggttcctttttgctcccatcacttccatgaactgatcatgaaagacgggcgagtgttggtcgtgccatgtcgcaaccaagatgagttaattggtagagcccggatcagccagggagctggctggtctctgagggaaaccgcctgcctcgggaagtcgtatgcacagatgtggtcacttatgtactttcaccgcagagacctgcggctagcggccaatgctatatgtagcgccgtgccgtcccactgggtccccacgagtaggacaacctggtctatccatgcaaaacacgagtggatgactacagaggacatgctgaccgtttggaaccgagtgtggattcgtgaaaatccttggatggaggataagactccagtagaaagctgggaggaaatcccctatctcggaaagagagaggaccagtggtgcggctccttgattggtctgacctcacgcgctacatgggccaaaaacatccaagcagccataaatcaggtgcggagtcttattgggaacgaggaatacgcggattacatgccttctatgaagaggttcagacgcgaggaagaggaagctggagtcctgtggtga

SEQ ID NO: 14817 - RNA, 9876 nt, synthetic construct
  misc_feature 1..9876: note = derived and/or modified CDS sequence (opt3) from DENV-2__FJ410241__SS-prME
  source 1..9876: mol_type = other RNA
agcgcaggaatgatcattatgctgataccaaccgtgatggctttccacctcactactcggaacggggagcctcatatgatcgtcggcattcaggaaaagggtaaatcccttctgtttaagacggaggacggagttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccaattaaagctgaattggttcaagaaagggtcttccattggacagatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacaatataaatttcagcccgagagtccaagcaagttggcctccgctatccagaaagcccaggaagagggcatatgtggtattagatctgtcactaggctcgagaatctgatgtggaagcaaatcacacccgaattaaaccacattctggcagagaatgaagttaaactaaccatcatgactggcgatataaaggggatcatgcaggccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaagacgcgttttgtgactctaagttaatgagcgctgccattaaggataatagggcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatccccaagaacctcgcaggacccgttagtcagcacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaagctcattaccgagtggtgctgtagatcctgcacactgccgcctcttaggtatcgcggagaggacggctgttggtacggtatggaaatacggccattgaaagagaaggaagagaatctggtgaactcattagttacggcggggcacggacaagtggataatttcagtctcggcgtactgggtatggccctttttctggaagagatgttgaaaaccagagtcggcactaagcatgctatcctcctggtggcagtgagcttcgtcacactaattaccgggaacatgtcgtttaaagacctgggaagggttgtggtaatggtgggcgccactatggctgatgacatcgggatgggagtcacatatctcgccctgcttgcagcgttcaaggtgcgccccacctttgccgctggcttgctgttacgaaagctcacgtccaaagagctgatgatgactaccattggtatcgttcttctgtctcagagcacaatacctgaaaccgtgctagagctcactgatgccctggcattggggatgatggtcctgcggatcgtgcgtaatatggaaaagtaccagttagctgttacaattatggccatcctctgcgtgcccaacgcagtcattctgcagaatgcctggaaagtatcatgtaccatccttgctgtggttagtgtgtccccactgttgctcacatctagccaacagaagactgactggatacctctggcgctaaccattaaaggactgaaccccacggccatcttccttacaaccctctccagaactaataagaaaaggtcatggccactgaacgaggcaatcatggctgtcggcatggtgagcattttggccagttctctgttaaagaatgacataccgatgaccggccctctcgtagccgggggactgcttacagtgtgctatgtcctgactggtcgctccgctgatttggaactcgagcgggcaaccgacgttaagtgggaggatcaggccgaaatcagcggctcgtcacccattctgtctatcacgattagtgaggacgggtccatgagcatcaaaaacgaagaggaggaacagacactaaccatactgatcagaactggacttctcgtgatttctggcctgtttccaatcagcattcccatcacagcggctgcctggtacttgtgggaggtgaagaaacaaagggccggtgtcttatgggatgtgccttccccaccccctatggggaaggccgaactggaggacggagcttatcgaataaaacagaagggcattctcggctactcacagatcggggcaggagtttacaaggaaggtaccttccacactatgtggcatgtaacacgcggcgccgtgctgatgcacaaagggaagcggatcgagccgagttgggcggatgtcaaaaaggaccttattagctatggaggcggttggaaactggagggggaatggaaggagggagaagaggtgcaggttttggctctagaaccaggcaagaatcccagagccgtgcaaaccaaacctggcctgtttaagacgaacactgggaccatcggagcagtctctctcgatttctccccaggtacatcaggcagtcccataattgacaaaaaggggaaagtggtaggactgtacggcaacggtgtcgtgaccaggagcggggcctatgtttccgctatcgcccagacagagaagtctattgaggataatcctgaaatcgaggacgatatatttcgtaagcgccggcttactattatggacttacacccgggagcaggcaaaaccaagagatacctgcccgctatcgtgagggaagccatcaaacgaggcctccggacgttgattctggcgccaacacgcgtcgtggccgcagagatggaagaggctctcagagggctgcctatcaggtatcagactcccgccattcgggctgagcataccggacgagaaatagttgaccttatgtgtcacgcaacattcaccatgagactgttgtcgccagtgcgcgtccctaactacaatctaatcattatggatgaggcccatttcactgaccccgccagcatcgctgcgaggggttatatctcaacccgtgtggaaatgggcgaggcagccgggatttttatgacagctacgccaccgggatcccgggatcctttcccccaaagtaacgccccaataatcgacgaggaaagagagattcccgaaaggtcttggaatagcggccacgagtgggtaactgattttaagggtaaaaccgtgtggttcgttccttccatcaaggcagggaacgacattgccgcttgcctgcgcaagaatggcaagaaggtcatccagctctcacgaaaaacatttgattctgaatacgtgaagaccagaactaacgactgggatttcgtggtcacaaccgacataagcgagatgggcgcgaattttaaagccgagcgggtaatcgatccaaggcgctgtatgaagcccgtgattttaacggacggcgaagaacgtgttatcctggcagggcctatgccggtgactcatagttccgctgcccagagacggggaaggattggtcgcaaccccaaaaatgaaaacgaccagtacatctatatgggcgagccccttgaaaatgatgaggactgcgcacactggaaggaggccaagatgctgctcgataacataaatacacctgaagggattatccccagcatgttcgagccagaacgagagaaagtcgacgctattgatggagaatacagattgcggggcgaggccaggaagacctttgtggacctgatgcgcagaggtgatctccctgtttggctggcgtataaagtggcagccgaggggatcaactacgctgacaggcggtggtgtttcgatggcataaagaacaatcaaatccttgaagagaacgtcgaagtggagatttggaccaaagagggagaacgtaagaagctaaaaccccgctggctggacgcccgaatctattctgatccattggctttaaaggagtttaaagagttcgcagccggcagaaagtcactgactctcaatctgattacagagatggggaggcttcctaccttcatgacacagaaaactcgggacgctctggataacctcgccgtattgcacacggcagaagcgggaggtcgcgcctacaatcatgctctgtccgagctaccggagaccctggaaacactccttctgttaactttgctggccaccgtgacaggcgggatctttctcttcctgatgagtggaagaggcataggtaagatgacccttgggatgtgctgcattatcactgcaagcatcctgctctggtatgctcagattcagccccactggatcgccgcatcgataattttggagtttttcctgatcgttttactaattccagaacctgagaagcaaaggacgccccaggacaaccagctgacctacgtcgtgatcgccatactcacagtggtcgctgcgactatggccaatgaaatgggctttcttgagaaaaccaagaaagacctgggattgggctctatcgcaacacagcaactggagtccaacattctcgatatcgacctgcggccagctagcgcctggaccctttacgccgttgcaactacattcgtgacgcctatgctccgacattcaattgaaaatagttctgtaaacgtgtccctgaccgctatcgccaatcaggcgactgtcttgatggggctgggaaagggttggcccttaagcaaaatggatattggcgtgccgctactggctatcgggtgttattcacaggttaacccaataacactcaccgccgcacttctgttgctggtggcccactacgctattatcggacctggcctccaggcaaaggccaccagagaggcgcaaaagcgcgctgccgcaggtatcatgaaaaatcccacagtcgacgggattactgtaatagatctggacccaatcccctatgatcctaagtttgaaaaacagcttggccaggtgatgttactgattctctgcgttacgcaagtgttgatgatgaggaccacatgggccctgtgtgaggctctaactctggccaccggaccgatcagtacactctgggaaggcaaccccgggcggttctggaataccactattgcagtcagcatggctaacatctttcgtggatcctaccttgccggcgcgggtctgttgttctctataatgaagaatacgacaaacaccagaagggggactggaaacatgggcgagaccctgggtgagaaatggaaaagccgcctcaatgccctgggcaaatccgaatttcagatctataagaagtcagggattcaggaggtggaccggacattagcaaaagaaggaatcaagcgaggcgagactgatcaccatgctgtctctagagggagtgccaaacttaggtggttcgtggagcgcaacatggttaccccagaaggaaaggtggtagacctgggctgcggtagagggggatggtcgtactattgtggcggtctcaaaaatgtgagagaggtcaagggcctaacaaaagggggacctggccacgaagaaccaattcctatgagcacgtacgggtggaacctggttcgtttgcagtccggagtggatgtctttttcatcccacccgaaaaatgcgacaccctgctctgtgatataggcgagtcttcacctaatccaactgtggaggcaggtaggacacttcgggtactgaacttggtggaaaattggctgaacaataacacccaattctgcattaaggttctcaatccctacatgccgagcgtgatcgagaaaatggaggctttacagcgcaagtatgggggagccctggtccgaaaccctctttccagaaatagtactcatgagatgtactgggtgtctaacgccagcggcaatatcgtctcatccgtgaacatgattagtaggatgctgataaaccggtttacaatgcgccacaaaaaggcgacctatgaaccagacgttgacctaggcagcgggacgagaaatatcggaattgagtctgagatccccaacctcgatattatcggtaagaggatagagaaaatcaagcaggagcatgaaacctcctggcactacgaccaggatcacccttataaaacatgggcttaccatggctcatatgagactaagcaaaccgggagcgcatcgtctatggtaaatggagtggtccgactgttgacaaaaccatgggacgtgctgcccactgttacccagatggccatgacagataccactccgttcggccagcagcgggtgtttaaggaaaaggtcgacacgcgtacacaagagcctaaagagggtaccaagaaactcatgaagattactgctgaatggctttggaaagagctggggaagaaaaagacccccagaatgtgtacacgcgaagagttcacgaggaaggtgcggagtaacgccgcattaggagccatctttaccgatgagaataaatggaagtccgctagagaagcggtagaggacagccgcttctgggaactggtggataaagagaggaacttgcacctcgaaggcaagtgcgagacttgtgtttacaatatgatgggcaaacgagagaagaagctgggggaatttggaaaagccaagggttcacgggcaatttggtacatgtggctaggcgctagattccttgagtttgaagccctggggttcctcaacgaggaccattggttttccagggaaaattctctgagcggagtcgagggcgagggtttgcacaaactggggtatatcctccgcgatgtgagtaagaaagaaggaggcgcaatgtacgccgacgacacagctggctgggatacccgtattactcttgaggacctgaagaacgaagagatggtgacaaatcacatggaaggggagcataagaaattagccgaggcgatattcaagctgacctatcagaacaaagtcgttcgggtgcagagaccaacacctaggggaactgtaatggatatcatttcccgccgagaccaacggggtagcggccaggtggggacctacggattgaatacgtttaccaacatggaagcacagctcatcagacagatggagggcgaaggtgtcttcaagaatatccaacacctgacagtgactgaggaggttgccgtgcagaactggctagctagggtcgggcgcgaaagactttctcggatggccatttcaggagatgactgcgtggtaaaacccctggatgacaggttcgcaaacgctctcaccgccctgaatgatatgggcaagatacgtaaggacatccagcagtgggagccaagtaaaggctggaacgattggacacaagttcccttttgctcccatcacttccatgaattgattatgaaggacgggcgagtgttagtcgtgccttgtcgcaatcaggatgagctgatcggtagagctcggattagccagggagccggctggtctctcagggaaactgcatgccttgggaaatcgtatgcgcagatgtggtcactgatgtactttcaccgcagagacctacggctggccgctaacgccatctgtagcgcagtgccatcccactgggtcccgaccagtaggacgacatggtctatacatgctaagcacgagtggatgaccactgaggacatgctcacagtttggaatcgagtgtggatccgtgaaaacccctggatggaggataaaacccctgtagaaagctgggaggaaattccatatttgggaaagagagaggaccaatggtgcggctccctgatcggtcttacttcacgcgccacctgggcaaagaatattcaggccgcgatcaaccaggtgcggagtctgatagggaatgaggaatacacagattacatgccctctatgaaaaggttcagacgcgaggaagaggaagctggagtcctctggtga

SEQ ID NO: 14818 - RNA, 9876 nt, synthetic construct
  misc_feature 1..9876: note = derived and/or modified CDS sequence (opt3) from DENV-2__FJ410259__SS-prME
  source 1..9876: mol_type = other RNA
agcgccggcatgatcattatgctgatccccaccgtgatggctttccacctcaccactagaaacggggagcctcatatgatcgtcggtattcaagaaaagggaaaatcccttctgtttaagacggaggacggcgttaatatgtgcaccttgatggcaatggatttaggggaactgtgtgaggacacaatcacttacaaatgcccattactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaatggaaatcaaggtaacgccgcagtcaagtacaaccgaggctgaactgactggctatggtaccgtgacaatggagtgtagccccagaaccgggcttgatttcaatgaaatggtcctgttgcaaatggagaacaaagcctggctcgtgcacaggcagtggtttctggacttacctctgccatggctccccggcgcagataagcaggagtctaattggattcagaaggaaactcttgttacattcaaaaaccctcatgctaagaaacaagacgtggtcgtgctgggatcccaggagggcgccatgcacacggcgttgaccggggccactgaaatccagatgtcaagcggaaatctactgtttacaggtcatctcaagtgccggctgcgtatggacaaacttcaactgaagggcatgagttactctatgtgtaccgggaagttcaaagtagttaaggagatagcagagacacagcacggaactattgtgatccgcgtccagtatgaaggcgatggttccccatgcaaaatccccttcgagattatggacttggaaaagagatacgtgctcgggaggctgatcaccgtcaacccgattgtgacggagaaagatagccctgttaacatagaagctgagcccccatttggcgactcgtacatcattatcggagtggagcctggccagttaaagctgaattggttcaagaaagggtcttccatcggacaaatgtttgaaaccacaatgcggggtgccaagcgaatggctattctaggcgatactgcctgggacttcgggtcactcggaggcgtatttaccagtataggtaaagcactgcatcaggtcttcggggccatctatggcgctgcgtttagcggagtgtcctggacaatgaagattcttatcggcgttattatcacttggatagggatgaactctcgcagcacctcattgagtgtgtccctggtcctcgtgggaatcgtaacgctgtaccttggcgtgatggttcaggcagatagcggttgtgtcgtgtcttggaaaaataaggagctgaagtgcgggtcaggaattttcatcacagacaacgtgcacacctggactgaacagtataaatttcaacccgagagtccaagcaagttggcctccgctattcagaaagcccaggaagagggcatctgtggtataagatctgtcacaaggctcgagaatctgatgtggaagcagattacccccgaattaaaccacatcctggcagagaatgaagttaaactaactattatgaccggcgatatccgggggataatgcaagccggaaagcgctcgctcagacctcagccaacagagctgaaatacagctggaagacgtggggcaaggctaaaatgctttccaccgaatcatataaccagactttcttgatcgacgggccggagacagccgagtgccccaataccaacagggcatggaatagtctggaagtggaggattacggatttggcgtgttcacaactaacatttggctcaagctgaaagaaaagcaggacgcgttttgtgactctaaattaatgagcgctgccatcaaggataatcgtgcagtacatgccgacatgggttattggattgagtccgctctgaacgatacctggaagatcgagaaagcctcattcatagaagtcaagaattgccactggcctaaaagccatacgctttggtctaacggggtgttggagtccgaaatgattatcccaaagaacctcgcaggacccgttagtcaacacaattaccggcctggctaccacacacagatcgctggtccatggcatctgggcaaactagagatggacttcgatttttgtgacgggaccactgtgattgtcaccgaagattgcggaaaccgaggccccagcctgagaacaactaccgcctctgggaagctcatcacagagtggtgctgtaggtcctgcacgctgccgcctcttcgctatcggggagaggacggctgttggtacggtatggaaattagaccattgaaggagaaagaagagaatctggtgaactcattagttaccgcggggcacggacaggtggataatttcagtctcggcgtactgggtatggccctttttctggaagagatgttgaggactcgcgtcggcacaaagcatgctatactcctggcagccgtgagcttcgtgaccctaatcactgggaacatgtcgtttaaagacctgggacgagtcgttgtgatggtaggcgctacaatggccgatgacattgggatgggagtgacctatctcgcactgcttgcggccttcaaggtccggcccacgtttgctgccggcttgctgttacgtaaactcacttccaaggagctgatgatgaccacaatcggtattgtgcttctgtctcaaagcaccatccctgaaactgttctagagctcacagatgcactggctttggggatgatggtgctgaagatagtcagaaatatggaaaaataccagttagccgtgaccatcatggcaattctctgcgttcccaacgccgtgatcctgcagaatgcttggaaggtctcatgtacaattcttgcggtagtgagtgtttccccactgttgctcacttctagccagcagaagacagactggatccctctggccctaacgataaagggactgaaccccacagcaattttccttaccactctctccaggaccaataaaaagcgctcatggccactgaacgaggctatcatggccgtgggcatggtcagcatcttggccagttctctgctcaaaaatgacattccgatgacaggccctctagtggctgggggactgcttactgtatgctatgtgctgaccggtcggtccgcagatttggaactcgagagagccacggacgtcaagtgggaggatcaggcggaaataagcggctcgtcacccatcctgtctattacaatcagtgaggacgggtccatgagcattaagaacgaagaggaggaacagaccctaactatcctgataaggacaggacttctcgttatctctggcctgtttccaattagcatccccattaccgctgccgcatggtacttgtgggaggtgaaaaagcagcgagccggtgtgttatgggatgtcccttccccaccccctatggggaaagctgaactggaggacggagcatatcgcatcaagcaaaaaggcatactcggctactcacagattggggccggagtgtacaaggaaggtactttccacacaatgtggcatgttacccggggcgcggtactgatgcacaaggggaaaagaatcgagccgagttgggctgatgtgaagaaagaccttatcagctatggaggcggttggaagctggagggggaatggaaagagggagaagaggtccaggtgttggccctagaaccaggcaagaatcccagggcagttcagacgaagcctggcctgtttaaaactaacaccgggacaattggagccgtgtctctcgatttctccccaggtacctcaggcagtcccatcatagacaagaaagggaaggtcgtgggactgtacggcaacggtgtagtcacacgtagcggggcttatgtgtccgccattgcacaaactgagaaatctatcgaggataatcctgaaattgaggacgatatctttcgcaagcggagacttaccataatggacttacacccgggagctggcaagacgaaaaggtacctgcccgccattgttcgagaagcgatcaagcggggcctccgcacattgatcctggccccaactagagtggtcgcagctgagatggaagaggccctcagggggctgcctattcggtatcagacccccgctatccgagcagagcatacaggaagagaaattgtggaccttatgtgtcacgccaccttcactatgcgcctgttgtcgccagttagggtgcctaactacaatctaataatcatggatgaggcccatttcaccgaccccgctagcattgcggcacgtggttatatctcaacacgggtcgaaatgggcgaggccgctgggatctttatgacggccactccaccgggatccagagatcctttcccccagagtaacgcaccaattatagacgaggaaagggagatccccgaacgctcttggaatagcggccacgagtgggtgaccgattttaaaggtaagacagtatggttcgtgccttccattaaagccgggaacgacatcgctgcgtgcctgcgaaagaatggaaagaaagttattcaactctcaagaaagacctttgattctgaatacgtcaaaactcggacaaacgactgggatttcgtggtgaccacggacatcagcgagatgggcgccaattttaaggcagagagggtcatagatccacgccgttgtatgaaacccgtaatcttaactgacggcgaagagagagtgattctggctgggcctatgccggttacacatagttccgccgcacagcggaggggacgcatcggtcgaaacccaaagaatgaaaacgaccagtacatttatatgggcgagccccttgaaaatgatgaggactgcgcccactggaaagaggctaagatgctgctcgataacatcaatacccctgaagggataattcccagcatgttcgagccagaaagagagaaggtggacgccatcgatggagaataccggttgaggggcgaggcgcgcaaaacctttgtcgacctgatgagaaggggtgatctccctgtgtggctggcatataaggttgccgctgaggggattaactacgccgaccggcgttggtgtttcgatggcatcaaaaacaatcagatacttgaagagaacgtggaagtcgagatctggactaaggagggagaacgcaaaaagctaaagccccgatggctggacgctagaatttattctgatccattggcattaaaagagtttaaggagttcgccgctggcaggaaatcactgacactcaatctgatcaccgagatggggcggcttcctacattcatgactcaaaagacgcgcgacgccctggataacctcgcagtgttgcacaccgcggaagccggaggtagagcttacaatcatgccctgtccgagctaccggagacactggaaactctccttctgttaaccttgctggcaacagtaaccggcgggatttttctcttcctgatgagtggaaggggcatcggtaaaatgactcttgggatgtgctgcataattacggctagcatcctgctctggtatgcccagatccagccccactggattgcagcctcgatcatattggagtttttcctgattgtgttactaatcccagaacctgagaagcagcggacaccccaagacaaccagctgacatacgttgtcattgctatcctcactgtggtggcggccaccatggcaaatgaaatgggctttcttgagaagaccaaaaaggacctgggattgggctctatagctacccagcagccagagtccaacatcctggatattgacctccgacctgccagcgcctggactctgtacgcagtcgctacaacgttcgttacccccatgcttagacattcaatcgaaaatagttctgtgaacgtatccctcactgccattgcgaatcaagctacagtgctgatggggttgggaaaaggttggccgctgagcaagatggatatcggcgtcccattactagccattgggtgttattcacaggtgaaccctatcaccctgaccgcagccctccttctgttggttgctcactacgcaataattggacccggcctgcaggccaaagcgacacgcgaggctcagaagagggccgcagccggtatcatgaagaatccaactgtggacgggatcacggtcattgatctcgaccccataccttatgatccgaaatttgaaaagcaactgggccaggtaatgcttttaatcctgtgcgtgacccaggttctcatgatgcggacaacttgggctttgtgtgaggccctgaccctagcaacaggacccattagtaccctgtgggaaggcaacccagggcgtttctggaatactacgatcgctgtgagcatggccaacatttttagaggatcctacctcgcgggcgccggtcttctgttctctatcatgaaaaatacaaccaacactaggcgcgggaccggaaacataggcgagacattgggtgagaagtggaaaagccggctgaatgcactcggcaagtccgaatttcaaatctataaaaagtcagggattcaggaggtcgaccgaactctggctaaggaaggaatcaaaagaggcgagaccgatcaccatgccgtgtctagggggagtgcaaagttacgctggttcgtcgagcggaacatggtgacacctgaaggaaaagttgtggaccttggctgcggtagagggggatggtcgtactattgtggcggtctgaagaatgtacgtgaggtgaaaggcctcacgaaagggggacccggccacgaggaacctattccaatgagcacctacgggtggaacctagtcaggctgcagtccggagttgatgtgtttttcataccccctgaaaagtgcgacactttgctgtgtgatataggcgagtcttcaccaaatcccacagtcgaggctggtcggaccctccgcgtgcttaacctggtagaaaattggttgaacaataacactcagttctgcattaaagtgctgaatccgtacatgcctagcgttatcgagaagatggaagccctccaacgaaaatatgggggagccttagtgagaaacccactgtccaggaatagtacacatgagatgtactgggtctctaacgcgagcggcaatatcgtgtcatccgtcaacatgattagtcggatgcttataaaccgctttaccatgagacacaagaaagctacgtatgaacccgacgtggacctgggcagcgggaccaggaatatcggaattgagtctgagatccctaacctagatattatcggtaagcgaatagaaaagatcaaacaggagcatgaaacatcctggcactacgaccaggatcacccatataagacttgggcataccatggctcatatgagaccaaacagacagggagcgcctcgtctatggttaatggagtagtgcggctcctgactaagccctgggacgtcttgccgaccgtgacacaaatggctatgaccgatactacgcctttcggccagcagcgtgtttttaaagaaaaggtggacacaagaacccaggagcccaaggagggtactaaaaagctgatgaaaattaccgccgaatggctctggaaggagcttgggaaaaagaaaacaccacgcatgtgtacgagggaagagttcacccggaaggtcagaagtaacgcagccctgggagctatctttactgatgagaataagtggaaatccgcgcgcgaagccgtggaggacagcaggttctgggaattagtagataaggagcgaaacctgcacttggaaggcaaatgcgagacatgtgtgtacaatatgatgggcaagcgggagaaaaagctcggggaatttggaaaggcaaaaggttcaagagctatttggtacatgtggctgggcgccaggttcctagagtttgaagcacttgggttcctgaacgaggaccattggttttcccgcgaaaattctctcagcggagttgagggcgagggtctgcacaagttggggtatatcctgcgtgatgtcagtaaaaaggaaggaggcgccatgtacgctgacgacaccgccggctgggatactcggattacactcgaggaccttaaaaacgaagagatggtgaccaatcacatggaaggggagcataagaagctggcggaggcaatattcaaattaacatatcaaaacaaggtggtcagagttcagaggcctactccccgcggaaccgtgatggatatcatttcccgacgggaccagagaggtagcggccaagtagggacgtacggactgaatacctttacaaacatggaagcccagttgatcaggcagatggagggcgaaggtgtgttcaaaaatatccagcacctcactgtcaccgaggaggtggctgttcataactggctggcccgcgtggggagagaacggctatctaggatggcaatttcaggagatgactgcgtcgtgaagccacttgatgaccgtttcgctaacgccctgacagctctcaatgatatgggcaaaatacgaaaggacatccaacagtgggagcccagtaagggctggaacgattggactcaggtacctttttgctcccaccatttccacgaactgattatgaaagacgggcgcatcttggttgtgccatgtagaaatcaggatgagttaattggacgggccaggatcagccaaggtgcaggctggtctctgcgcgaaaccgcgtgcctcgggaagtcgtatgcccagatgtggtcacttatgtactttcacagacgggacctgaggctagctgccaacgcaatatgtagcgctgtcccgtcccattgggtgcccacgagtcgaacaacctggtctatccacgccaaacatgagtggatgactacagaggacatgctgaccgtgtggaatcgtgtctggattagagaaaacccttggatggaggataagactccagttgaaagctgggaggaaatcccctatctcggaaaacgcgaggaccagtggtgcggctccttgattggtctgacctcacgggcaacatgggccaagaatatccaggcggctataaaccaagtgaggagtcttattgggaatgaggaatacacggattacatgccttctatgaagagattccgccgggaggaagaggaagccggagtactgtggtga

SEQ ID NO: 14819 - RNA, 9876 nt, synthetic construct
  misc_feature 1..9876: note = derived and/or modified CDS sequence (opt3) from DENV-2__FJ547067__SS-prME
  source 1..9876: mol_type = other RNA
agcgccggaatgatcattatgctgataccaaccgtgatggctttccacctcactactagaaacggggagcctcatatgatcgtaggcattcaggaaaagggtaaatcccttctgtttaagacggaggacggagttaatatgtgcaccttgatggcaatggatttaggggaactgtgtgaggacactatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagcggatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccaattaaagctgaattggttcaagaaagggtcttccattggacagatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacaatataaatttcagcccgagagtccaagcaagttggcctccgctatccagaaagcccaggaagagggcatatgtggtattagatctgtcactaggctcgagaatctgatgtggaagcaaatcacacccgaattaaaccacattctggcagagaatgaagttaaactaaccatcatgactggcgatataaaggggatcatgcaggccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaagacgcgttttgtgactctaagttaatgagcgctgccattaaggataatagggcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatccccaagaacctcgcaggacccgttagtcagcacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaagctcattaccgagtggtgctgtagatcctgcacactgccgcctcttaggtatcgcggagaggacggctgttggtacggtatggaaatacggccattgaaagagaaggaagagaatctggtgaactcattagttacggcggggcacggacaagtggataatttcagtctcggcgtactgggtatggccctttttctggaagagatgttgagaaccagggtcggcactaaacatgctatcctcctggtggcaattagcttcgtgacactaatcaccgggaacatgtcgtttaaggacctgggacgcgtcgttgtgatggtaggcgccactatggctgatgacattgggatgggagtgacatatctcgccctgcttgcagcgttcaaagtccgacccacctttgccgctggcttgctgttacggaagctcacgtccaaggagctgatgatgactaccatcggtatagtgcttctgtctcagagcacaatccctgaaaccgttctagagctcactgatgccctggcattggggatgatggtgctgaaaattgtccgtaatatggaaaagtaccagttagctgtgacaatcatggccattctctgcgttcccaacgcagtgatcctgcagaatgcctggaaagtctcatgtaccatacttgctgcggtaagtgtgtccccactgttgctcacatctagccaacagaagactgactggattcctctggccctaaccatcaaaggactgaaccccacggcaatcttccttacaaccctctccagaactaataagaaaaggtcatggccactgaacgaggctattatggccgttggcatggtgagcatattggccagttctctgttaaagaatgacatcccgatgaccggccctctcgtcgctgggggactgcttacagtgtgctatgtactgactggtcgctccgcagatttggaactcgagcgggccaccgacgtgaagtgggaggaacaggcggagattagcggctcgtcacccatcctgtctattacgatcagtgaagatgggtccatgagcatcaagaacgaggaggaggaacagacactaaccatcctgattagaactggacttctcgtcatctctggcctgtttccaattagcatccccataacagctgccgcatggtacttgtgggaagttaagaaacaaagggccggtgtgttatgggacgtgccttccccaccccctatggggaaggctgagctggaagatggagcatatcgaattaaacagaagggcatcctcggctactcacagatcggggccggagtctacaaggagggtaccttccacactatgtggcatgtgacacgcggcgcggttctgatgcacaaagggaagcggattgagccgagttgggctgacgtcaaaaaggatcttatcagctatggaggcggttggaaactggaaggggagtggaaggaaggagaggaagtgcaggtcttggccctagagccaggcaagaatcccagagcagtgcaaaccaaacctggcctgtttaagacgaacactgggaccataggagccgtttctctcgacttctccccaggtacatcaggcagtcccattatcgataaaaaggggaaagtggtcggactgtacggcaacggtgtggtaaccaggagcggggcttatgtctccgccattgcacagacagagaagtctatcgaagacaatcctgagatagaagatgacatttttcgtaagcgccggcttactatcatggatttacacccgggagctggcaaaaccaagagatacctgcccgccatcgtgagggaggcgattaaacgaggcctccggacgttgatcctggccccaacacgcgttgtggcagctgaaatggaggaggccctcagagggctgcctattaggtatcagactcccgctatacgggcagaacataccggacgagagatcgtcgaccttatgtgtcacgccacattcaccatgagactgttgtcgccagtgcgcgttcctaactacaatctaattatcatggacgaagcccatttcactgatcccgctagcatcgcggcaaggggttatatttcaacccgtgtggagatgggcgaggccgctgggatatttatgacagccacgccaccgggatcccgggaccctttcccccaaagtaacgcaccaatcattgatgaagagagagaaatccccgagaggtcttggaatagcggccacgaatgggtcactgactttaagggtaaaaccgtgtggttcgtaccttccattaaggccgggaacgatatcgctgcgtgcctgcgcaagaatggcaaaaaggtgatacagctctcacgaaaaacatttgactctgagtacgttaagaccagaactaacgattgggacttcgtcgtgacaaccgatatcagcgagatgggcgccaattttaaagcagaacgggtgattgacccaaggcgctgtatgaagcccgtcatcttaacggatggcgaggaacgtgtaattctggctgggcctatgccggtgactcatagttccgccgcacagagacggggaaggatcggtcgcaaccccaaaaatgagaacgaccagtacatatatatgggcgaaccccttgagaatgacgaggattgcgcccactggaaggaagctaagatgctgctcgacaacattaatacacctgaggggatcattcccagcatgttcgaaccagagcgagaaaaagttgatgccatcgacggagagtacagattgcggggcgaggcgaggaagacctttgtggatctgatgcgcagaggtgacctccctgtctggctggcatataaagtggccgctgaagggataaactacgccgataggcggtggtgtttcgacggcatcaagaacaatcaaattcttgaggaaaacgttgaggtggagatctggaccaaagaaggagagcgtaagaagctaaaaccccgctggctggatgctcgaatttattctgacccattggcattaaaggaatttaaagagttcgccgctggcagaaagtcactgactctcaatctgatcacagaaatggggaggcttcctaccttcatgacacagaaaactcgggatgccctggacaacctcgcagtcttgcacacggcggaggccggaggtcgcgcttacaatcatgccctgtccgagctaccggaaaccctggagacactccttctgttaactttgctggcaaccgtgacaggcgggatatttctcttcctgatgagtggaagaggcattggtaagatgacccttgggatgtgctgcatcatcactgctagcattctgctctggtatgcccagatccagccccactggatagcagcctcgattatcttggaatttttcctgattgtattactaatcccagagcctgaaaagcaaaggacgccccaggataaccagctgacctacgtggttatagctatcctcacagtcgtggcggccactatggcaaatgagatgggctttcttgagaaaaccaagaaagacctgggattgggctctattgctacacagcaaccagaatccaacatcctggacattgatctccggcctgccagcgcctggaccctgtacgcagtggctactacattcgtcacgcccatgcttcgacattcaatcgagaatagttctgttaacgtgtccctcaccgccattgcgaatcaggctactgtactgatggggttgggaaagggttggccgctgagcaaaatggacatcggcgtgccattactagccatagggtgttattcacaggtcaaccctattacactgaccgcagccctccttctgttggtggctcactacgcaatcatcggacccggcctgcaggccaaggcgaccagagaagctcaaaagcgcgccgcagccggtattatgaaaaatccaacagttgatgggataactgtgatcgacctcgatcccattccttatgacccgaagtttgagaaacagctgggccaggtcatgcttttaatcctgtgcgtaacgcaagtgctcatgatgaggaccacatgggctttgtgtgaagccctgactctagcaaccggacccattagtacactgtgggagggcaacccagggcggttctggaataccactatcgctgttagcatggccaacatatttcgtggatcctacctcgcgggcgccggtcttctgttctctatcatgaagaatacgacaaacaccagaagggggactggaaacatgggcgagaccttgggtgaaaaatggaaaagccgcctgaatgcactcggcaaatccgagtttcaggtgtataagaagtcagggattcaggaagtcgatcggacactggctaaagagggaatcaagcgaggcgagactgaccaccatgccgtgtctagagggagtgcaaaattaaggtggttcgtcgaacgcaacatggtgacccctgagggaaaggttgtggatcttggctgcggtagagggggatggtcgtactattgtggcggtctgaaaaatgtaagagaagtgaagggcctcacaaaagggggacccggccacgaggaacctattccaatgagcacgtacgggtggaacctagtccgtctgcagtccggagttgacgtgtttttcataccacctgagaaatgcgataccttgctgtgtgacataggcgagtcttcaccaaatcccactgtcgaagctggtaggacactccgggtgcttaacctggtagagaattggttgaacaataacacccaattctgcattaaggtgctgaatccgtacatgcctagcgttatcgagaaaatggaggccctccagcgcaagtatgggggagccttagtgcgaaacccactgtccagaaatagtactcatgaaatgtactgggtctctaacgcgagcggcaatatcgtgtcatccgtcaacatgattagtaggatgcttataaaccggtttacaatgcgccacaaaaaggctacctatgagcccgatgtggacctgggcagcgggacgagaaatatcggaattgagtctgaaatccctaacctagacattatcggtaagaggatagagaaaatcaagcaggaacatgagacctcctggcactacgatcaggaccacccatataaaacatgggcataccatggctcatatgaaactaagcaaaccgggagcgcctcgtctatggttaatggagtagtgcgactcctgacaaaaccctgggatgtcttgccgactgtgacccagatggctatgacagacaccactcctttcggccagcagcgggtttttaaggagaaggtggatacgcgtacacaagagcccaaagaaggtaccaagaaactgatgaagattactgccgagtggctctggaaagaacttgggagaaagaaaaccccacgcatgtgtacaagggaggagttcacgcggaaggtcagaagtaacgcagccctgggagctatctttaccgacgaaaataagtggaaatccgcgcgcgaggccgtggaagatagcaggttctgggagttagtagacaaggaacgaaacctgcacttggagggcaaatgcgagacttgtgtgtacaatatgatgggcaagcgggagaaaaagctcggggagtttggaaaggcaaaaggttcaagagctatttggtacatgtggctgggcgccaggttcctagaatttgaggcacttgggttcctgaacgaagatcattggttttcccgcgaaaattctctcagcggagttgagggcgaaggtctgcacaagttggggtatatcctgcgtgacgtcagtaaaaaggagggaggcgccatgtacgctgatgacacagccggctgggacacccggattactctcgaagatcttaaaaacgaggaaatggtgacaaatcacatggagggggagcataagaagctggcggaagcaatattcaaattaacctatcagaacaaggtggtcagagttcagaggcctacaccccgcggaactgtgatggacatcatttcccgacgggatcaaagaggtagcggccaggtagggacctacggactgaatacgtttaccaacatggaggcccagttgatcaggcagatggaaggcgagggtgtgttcaaatctatccaacacctcacagtcactgaggaagtggctgttcagaattggctggcccgcgtggggagagagcggctatcaaggatggcaattagtggagacgattgcgtcgtgaagccacttgacgatcgtttcgctaacgccctgaccgctctcaacgacatgggcaaaatacgaaaggatatccagcagtgggaaccctccaagggctggaatgactggacacaagtacctttttgcagccatcacttccatgagctgattatgaaagatgggcgcgttttggtggtcccatgtagaaaccaggacgaattaatcggacgggccaggatttctcagggtgcaggctggtcgctgcgcgagactgcgtgcctcgggaagtcatatgcccagatgtggagccttatgtactttcacagacgggatctgaggctagctgccaatgcaatctgttccgctgtgccgagtcactgggtgcccacctctcgaacgacatggagcatacatgccaaacacgagtggatgaccactgaagacatgctgacagtctggaaccgtgtttggatcagagagaatccttggatggaagacaagaccccagtggagtcctgggaagagattccctatctcggaaaacgcgaggatcaatggtgcggctcattgatcggtctgacaagtcgggcaacctgggccaagaacattcaggcggctatcaatcaggtaaggtctcttatagggaacgaagagtacacagactacatgcctagcatgaagagattccgccgggaagaggaagaggccggagtgctgtggtga

SEQ ID NO: 14820 - RNA, 9876 nt, synthetic construct
  misc_feature 1..9876: note = derived and/or modified CDS sequence (opt3) from DENV-2__JN819418__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggccgaacttactggctatggtaccgtaacaatggagtgtagtcccaggaccgggctggatttcaacgaaatggtgttgctccagatggaggacaaagcatggctggtccaccggcaatggtttttagatctgcctctcccatggcttcccggcgctgacactcagggaagcaattggatacagaaggagacactggtgacgttcaagaaccctcatgccaaaaagcaggacgttgtggtcttgggctctcaagaaggggcgatgcacaccgccctaactggagcaacagagattcagatgtcctcaggtaatctgctctttaccggccatctgaaatgccgtcttcgcatggataagctgcagttgaaagggatgagctacagtatgtgtacaggaaagttcaagatcgtgaaagaaatcgctgagactcaacacggcaccattgtaatcagagttcagtatgagggtgacgggtctccatgcaagattcccttcgaaataatggatctcgagaaaaggcatgtgctgggccggttaatcacggtcaacccgattgtgaccgaaaaggactcccctgtcaacatcgaggccgaacccccatttggagatagctacatcattataggcgtggagcctgggcagctgaaactaaattggttcaagaagggatcgtctatcggtcagatgtttgagacaactatgcgaggcgctaaacgcatggccattctcggggacaccgcatgggatttcggatccctgggcggtgtttttacatcaatcgggaaggcccttcaccaagtgttcggcgctatttacggagcggcatttagtggcgtaagctggactatgaaaatcttgataggggtcatcattacctggatcggaatgaactccagatctacgagcctgtcagtgagtctcgttctggtgggcgtcgtgacactttatctgggtgccatggtacaggctgactccgggtgtgtggttagctggaagaataaagaattgaagtgcggatctggcattttcatcaccgataacgtccacacttggacagagcagtacaagtttcagcccgaatcaccaagtaaactcgccagcgcaatacaaaaggcccatgaggaaggtatttgtggcatcaggtccgtgacccggctggagaatttaatgtggaaacagattactcccgagctgaaccacatcctatctgaaaatgaggtgaagctcaccataatgacaggggacatcaaaggaattatgcaggctggcaagcgctcgctgagacctcagccaacggaacttaaatatagctggaagacctgggggaaggccaaaatgttgtccactgagtcacataaccaaacattcctgatcgatggaccggaaaccgcagagtgccccaatacaaacagggcgtggaatagtctcgaggtcgaagactacggctttggtgttttctctactaacatttggctgaagttacgtgagaaacaggacgtgttttgtgatagcaagctgatgtccgctgccatcaaagacaatcgggcagtgcacgccgatatggggtattggatagaatcagctcttaacgacacctggaagatggagaaggccagcttcattgaggtaaaatcttgccactggcctaagtcccatacgttgtggagtaatggagtcctcgaaagcgagatgatcatcccaaaaaacttcgcaggccccgtgtctcagcacaactaccgacctggttatcatacacagaccgctggcccatggcacctggggaagctagaaatggattttgacttctgtgagggaactaccgttgtggtcacagaagattgcggcaatagagggccctccctgaggactaccacagcctcaggaaaactcattacggagtggtgctgtcgcagttgcaccctgccgcctcttcggtacagaggcgaggacggttgttggtacgggatggaaatcaggccattgaaggagaaggaagagaacctggtgaatagcttagttactgcgggacatggccaaattgataacttttcgctcggtgtgctgggcatggcccttttcctggaagagatgttgcgcacacgagtagggaccaaacacgctatactcctggtcgcagtgtcctttatgactctaatcacaggaaatatgtctttccgggacctgggccgtgtgatggtcatggttggggccaccatgacggatgacattggaatgggcgtgacttatctcgctctgcttgccgcatttaaggtaagacccaccttcgcggccggtttgctgttaaggaaactcacaagcaaggagctgatgatggctaccatcgggattgcccttctgtcacagagtactatccctgaaacaatactagagctcaccgatgcactggctttgggaatgatggtgctgaaaatcgtccgcaacatggaaaagtaccagttagccgtgacaattatggcaatctcctgcgttcccaatgccgtgattctccaaaacgcttggaaggtctcttgtactatcctggcggccgtgagcgtttccccacttctgttgacctcaagccagcagaaagcagactggatacctctcgctctgacgattaagggcctaaatcccacagccatctttctgaccactcttagtcggacctctaaaaagagatcctggccactcaacgaggccatcatggctgtgggcatggtcagcattctggcatcgtcattgctgaaaaatgacataccgatgacagggcctttagtagccggaggtctcctgactgtgtgctatgttcttaccggcaggtctgcggatctggaattggagcgagctgccgacgtgaagtgggaggatcaggcagaaatcagtgggtccagccccattctctctatcacgattagcgaggacggatccatgtcaatcaaaaacgaagaggaggaacaaacactgaccatactaatccgcactggcctgcttgtcattagtggtctcttcccagtgagcatccccattacagccgctgcatggtacctgtgggaggtaaagaagcagcgggccggggtgttgtgggatgtcccttctccaccccctgttggaaaagcggaattagaggacggcgcttatagaatcaagcagaggggcatactggggtactcccagattggagccggtgtgtataaagaaggcacctttcacactatgtggcatgtgacacgtggggcagtcctcatgcaccgcggaaagcggatcgagccgtcatgggccgatgtgaaaaaggacctgatcagttacggcggtgggtggaagcttgagggagaatggaaagagggcgaagaggttcaagtactggctttggaaccaggcaagaatcccagagccgtgcagaccaaacctgggctattcaagacgaacactggaaccattggtgcagtcagcctggatttttccccaggcacatctgggtcgcccatcgtggacaggaaaggaaaggttgtgggcctctacggtaatggggtcgtgacccgaagcggagcttatgtatcagccatagcgcagacagagaagtccattgaggataaccctgaaatcgaggacgatattttccggaaaaagcgcctgactatcatggaccttcatccgggcgccggcaaaaccaagagatacttacccgcaatagtcagggaagctattaaacgggggctgcgaacgctcatcttggccccaacaagagtggttgctgcagagatggaagaggccctgcgcggactccctatcaggtatcagactcccgccattcgtgctgagcacaccggtcgggaaatcgtggacctgatgtgtcatgcgacattcaccatgagacttctgagtccagtcagggtgcctaactacaatttgattataatggatgaggcacactttactgaccccgcctctatcgctgcccgcggctatattagcacccgagttgaaatgggggaggcagccggaatcttcatgacagctacgccaccgggctccagagatccttttccccaatcaaacgcgccaatcatggacgaggaacgggagattcccgaaaggtcttggaatagcggtcacgagtgggtgactgatttcaaggggaagaccgtctggtttgtgcctagtataaaagccggaaacgacatcgcagcttgcctacgcaagaatggcaaaaaggtaattcagctgtcccgtaaaacattcgatagcgaatacgtgaagaccagagccaacgactgggattttgttgtcactacagacatctctgagatgggcgcaaatttcaaggccgagcgggtgattgatccaaggcgctgtatgaaacccgtgatcctcaccgacggggaagagcgagtcatattagctggacctatgccggtaacgcattcatccgccgcgcagagacggggtaggatcggccgcaacccaaagaatgaaaacgaccaatatatttacatgggggagcccctggaaaatgatgaggactgcgcacactggaaagaggccaagatgcttctggataacatcaatactcctgaaggaattatccccagtatgtttgagccagaaagagagaaagtggacgctatagatggcgaatacaggctccggggtgaggcccgtaagacattcgttgacttgatgcgccgaggggatctgcctgtgtggctcgcttatagagtcgcagccgagggcattaactacgctgacaggcggtggtgttttgatggaatcaaaaataaccagattctggaagagaacgtggaagttgagatctggaccaaggagggcgaacgcaagaaacttaagcccagatggctagacgccaggatatatagcgatccactggcattgaaagagttcaaggaattcgcggccgggcggaaatcgttaaccctgaatctcatcactgagatgggacgactgcctacatttatgacccagaaggctagagacgcccttgataacctggcagtgctccatacagctgaagccggtggccgcgcatacaatcacgccttgtctgagctgccggagactctagaaacgctgctccttctgaccttattggctacagtcactgggggaattttcctgtttctcatgtccggcaagggtatcgggaaaatgaccctgggcatgtgctgcattatcacagcgagcatacttctgtggtatgcccagattcaaccccactggatcgcagcttcaatcattctcgagttctttttgatcgtgctgttaataccagaacctgagaagcagaggaccccccaggacaaccagctaacttacgtagtgattgccatcctgacggttgtcgccgcaaccatggctaatgaaatgggattcctcgagaaaacaaagaaagaccttggcctggggagtattactacccaagagtctgaatccaacatcttggatatagacctgcggccagccagcgcgtggacactctatgctgtggccaccacttttgtgacacctatgctgcgtcattcaatcgagaatagtagcgtcaacgtttcccttacggcaattgccaatcaggctaccgtgctcatgggactgggtaagggctggcccttgtctaagatggatatcggggtaccgctgttagcaattggatgttacagccaggtgaacccaatcactctaacagccgcgctgctccttctggtcgctcactacgccattatcggccctggtttgcaggcaaaagccaccagagaagctcaaaagagggccgcagctgggataatgaaaaatcccaccgtggacggcattacagttatcgatctggacccaatcccctatgatcctaagttcgagaaacagctcggacaggtgatgctgcttattttatgcgtcactcaggtactgatgatgcgcacgacctgggccctctgtgaagcgttgacactggccactggcccgatatccaccctatgggaggggaaccccggacggttttggaatacaaccatcgcagtgtcaatggctaacattttccgaggctcttacctggccggtgcagggctcctttttagtatcatgaagaatactacgaacacaagaaggggaaccggcaatattggtgagactctgggcgaaaagtggaaatcgcgcttgaacgctctggggaagagcgagttccaaatctataaaaagtccggaatacaggaagttgaccggaccctcgccaaagagggcatcaagagaggggagacagatcatcacgccgtgtctcgtggatcagcgaaactgaggtggtttgtcgaacggaacatggtgactccagagggcaaggtcgtggacttaggttgcgggcgcggaggctggagctactattgtggtggccttaagaatgttcgagaagtgaaagggctgaccaagggaggccctgggcatgaggaacccattcctatgtccacatacggatggaacctcgtaagactacagagtggcgtggatgtcttcttcacgccacccgagaaatgcgacaccctgttgtgtgatatcggtgagtctagccctaatccaactattgaagctgggaggacactgcgggttctcaaccttgtggagaattggctgaacaataacacccaattttgcatcaaggtcttgaatccctatatgccgtcagtgatagaaaaaatggagactctgcagcgcaagtacggaggcgcactcgtaagaaaccctttatccaggaatagtacacacgaaatgtactgggtgagcaacgccaccggcaatattgtttcttccgtgaacatgatctcacgaatgctgatcaatcggttcacgatgaagcacaaaaaggctacctatgagccagacgtcgaccttgggagcggaacacgtaacattggtatagagtcggaaatccccaacctggatattatcggcaaaagaattgagaagatcaaacaggaacatgagacttcttggcactacgaccaggatcatccttataagacctgggcctaccacgggagttatgaaacaaagcaaactggatccgcaagctcaatggtgaatggcgtcgtgcgcctactcaccaaaccatgggacgttgtacccatggtgacacagatggccatgaccgatactacgccgtttggtcagcagagggtcttcaaggagaaagtggacacacggacccaagagcctaaggaagggactaaaaagctgatgaagataaccgctgagtggttgtggaaagaactgggaaagaaaaagacacccagaatgtgtacgcgcgaggagtttaccaggaaagttcgatccaacgcggccctcggcgcaatcttcactgatgaaaataagtggaaatctgctcgggaggccgtggaagacggcagattttgggagcttgtcgatagggaacgcaacctgcacttagaggggaagtgcgagacatgtgtgtacaatatgatgggaaagcgtgaaaaaaagctgggtgagttcggcaaagcaaaggggagccgggccatttggtatatgtggttgggagctagatttctcgaattcgaggccctgggctttctaaacgaagaccattggttcagtagggagaattcccttagcggtgtagagggggaaggactgcacaaactcggctacatcctgcgcgatgtgtctaagaaggagggcggggcgatgtacgcagacgacaccgccggatgggatactcgaattacattggaagacctgaaaaacgaggaaatggttaccaatcatatggagggtgagcacaagaaactcgctgaagccatctttaagcttacatatcagaacaaagtcgtgcgggtgcagagaccaactcctaggggcaccgtcatggatattatatcacgcagagaccagcgggggagtggacaagttggcacgtacggtctgaataccttcacaaacatggaggcacagttaatcaggcagatggaaggggagggaattttcaagtccatccaacatctgactgtgaccgaggaaatcgctgtacagaattggttggcccgtgtgggccgagagcgcctcagcagaatggctatttctggcgatgactgcgtcgtgaagcccctggatgaccggtttgcctcggcactaacagcgcttaacgatatggggaaagttaggaaggacatacagcagtgggaaccatcacgcggatggaatgattggactcaagtgcccttctgcagccaccactttcatgagctgatcatgaaagacggtagagtcctcgtggtaccttgtcggaaccaggatgaactgattggcagggcccgaatctcccagggggctggatggagtttgaaggagaccgcctgcttaggcaaatcttatgcacagatgtggacgctgatgtacttccaccgtagagacctccgccttgctgccaacgcaatttgtagcgccgttccatcccattgggtgccgacatcacggaccacttggagtatccacgcgaagcacgagtggatgacaaccgaagacatgctggctgtctggaatagggtgtggatacaagagaacccctggatggaagataagactcctgtggagtcttgggaagaggtcccatatctaggtaaaagagaggaccagtggtgcgggagcctgatcggactcacctcccgcgccacatgggcaaagaatattcagacggccatcaaccaggttcggtcattgattggcaatgaagagtacaccgattatatgcccagcatgaaaaggtttcgaagagaagaggaagaggctggcgtgctgtggtga

SEQ ID NO: 14821 - RNA, 9876 nt, synthetic construct
  misc_feature 1..9876: note = derived and/or modified CDS sequence (opt3) from DENV-2__EU482640__SS-prME
  source 1..9876: mol_type = other RNA
accgccggcatcattataatgatgatcccaactgtgatggctttccacctgactacgaggaacggggaacctcatatgattgtcagcaggcaggaaaagggaaaatccctcctttttaagaccgagaatggtgttaacatgtgcaccctgatggcaatggacttgggcgaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactacagtggcaccatctatgaccatgagatgcatcggcatatcgaacagggactttgtcgaaggggtgtcaggaggtagctgggtagatattgttctggagcacggcagttgtgtgactacaatggccaaaaataagcccaccctcgacttcgaattaatcaagacggaggctaaacaccctgccaccctgcggaagtactgcattgaagcgaaacttacaaacactaccacagcatcccgctgtccaactcagggggagccctctttgaatgaggaacaagataagcgatttgtctgcaaacatagcatggtggacagaggatggggcaacggttgtgggctgttcggaaagggcggcatcgtgacctgcgccatgtttacatgcaagaaaaatatggaggggaagatcgtccagcctgaaaacctagagtataccattgttataactccacactccggagaagagaatgctgtgggtaacgatacgggcaaacatgggaaggagatcaaagtaacaccgcagtcaagtattaccgaagccgagctcactggatacggcaccgtgacaatggaatgtagccccaggaccggtctggacttcaatgagatggtccttctgcagatggaaaacaaggcatggttggtgcaccggcaatggtttctcgatctgcctttaccatggctgcccggggctgacactcagggctctaactggatccagaaagagacactcgttacgttcaagaatcctcacgccaagaaacaggatgtggtcgtgcttggatcccaagagggcgcgatgcataccgccctgactggggcaacagaaatacagatgtcaagcggaaacttgctatttaccggtcacctgaagtgccgtctccgcatggacaaactgcagcttaagggcatgagttattctatgtgtacagggaaattcaaggtagttaaggagattgctgaaactcaacatggaaccatcgtgatcagagtccagtacgagggcgacggttccccatgcaaaattcccttcgagatcatggatctggaaaagaggcacgtgttggggcggctcattacggtcaatccgatagtgaccgagaaagacagccctgttaacatcgaagccgagcccccatttggcgattcgtacattatcatcggagtggaacctggccagctgaagttatcttggttcaaaaaggggtcctcaattggacagatgtttgagacaactatgcgaggtgctaagcgcatggccatactgggcgacaccgcatgggatttcgggagtctaggaggcgtatttacaagcatcggtaaagccctccatcaagtcttcggggctatttatggcgcggcattttccggagtgtcttggactatgaagatcctgattggcgttgtgatcacctggatagggatgaatagcagatcaacgagtctttccgtcagcttggtgctggtaggagtggttacactctacctgggcgtcatggtgcaggccgactctggttgtgtggtctcatggaaaaacaaggagcttaaatgcgggagtggaatcttcattaccgataatgttcacacttggacagaacagtataagtttcagcccgagagcccatccaagctggcttctgccatccaaaaagcacacgaagagggcatttgtggtatcaggtcggtgacccggttggaaaacctcatgtggcgccagataactcccgagctgaatcatattttaagcgagaacgaagtgaagctgaccatcatgacaggcgacattaaagggatcatgcaggccggaaagagatccctaaggcctcagccaacggagctcaaatactcatggaaggcttggggcaaagccaagatgctgagtaccgaacttcacaatcatactttcttgatagatgggccggagacagcagaatgccccaacaccaatcgtgcgtggaactctctggaggtagaggactatggatttggcgtcttcacaactaatatctggctcaagctgaaagaacggcaagatgtgttttgtgacagcaagttaatgtccgctgccattaaagactcacgagcagttcacgccgatatgggttactggatcgagagcgctctgaacgacacctggaagattgaaaaagcctctttcatcgaggtgaagtcctgccactggcctaagagtcatacgctttggagcaacggggtcttggagtctgaaatgataattcccaagaatttcgcaggacccgtgtcccagcacaactatagacctggctaccatacacagaccgctggtccatggcacctcggcaggctggagatggattttgacttctgtgaagggactaccgttgtggtaacagaggattgcggaaatcgcggcccctcactacggactaccacagccagtgggaagctgatcacggaatggtgctgtagaagctgcaccctcccgcctctgaggtaccgcggagaggacggctgttggtatggtatggagatccgaccacttaaagaaaaggaggaaaacttggtcaattcgctggtgactgcggggcatggacagattgataacttttccttaggcgtgctcggtatggccctgttccttgaggaaatgctgcggacacgtatcggcaccaaacacgctattttgctcgtcgcagtttcttttgtgactctgataacagggaatatgagcttcagagacctaggaagggtaatggtgatggtcggcgccaccatgacggatgacatcgggatgggagtgacttacctggctctcctggccgcatttaaggttcgccccaccttcgcggccggccttttgctgcggaagttaacatcaaaagagctcatgatgaccactattggtatcgtgctgcttagtcaatccacagtccctgagaccattctggaactaacagatgctctcgccctggggatgatggtgttgaagatcgttagaaacatggagaaatatcagctggcagtgactataatggctatcttatgcgtccccaatgccgtaattctccagaacgcatggaaggtgtcttgtaccacgctggccgttgtgagcgtctccccacttctgttgacatcaagcaggcaaaaagctgactggatccctctcgcgctgaccattaagggactaaatcccactgccatctttctgaccacacttagtcgaacttctaagaaacgctcctggccactcaacgaagcaataatggctgtgggcatggtaagcattctggcctcgtcattgctgaagaatgatatcccgatgaccggccctttagtggccgggggactcctgacggtctgctacgttcttacaggtcggtctgctgacctggagttggaaagagcagccgacgtgaggtgggaggagcaggcggaaatcagtggctccagccccattctctctataaccatcagcgaggatgggtccatgtcaattaaaaacgaagaggaggaacagactctgacaatcctaattcgtaccggactgcttgtgatcagtggcctcttcccagtcagcatacccatcactgctgccgcatggtatctgtgggaggtgaagaaacagcgcgccggtgttttgtgggacgtaccttctccaccccctgtggggaaggctgaattagaggatggagcataccggattaaacaaaagggcatcctgggctattcccagattggggccggagtctacaaggaaggtacatttcacaccatgtggcatgtgacgagaggcgcggttctcatgcacaaagggaagaggatcgagccgtcatgggctgacgtgaaaaaggatctgataagttacggaggcggttggaaacttgagggggaatggaaggagggagaagaggtccaggtgctggccttggaaccaggcaagaatccccgagcagtacagactaaacctggcctattcaagaccaacacagggaccattggagccgtcagcctggacttttccccaggtacatctggctcgcccatcgtggataaaaaggggaaagttgtgggactctatggcaacggtgtcgtgactcggagcgggacctacgtttcagctatcgcccaaacggagaagtccattgaggacaatcctgaaatcgaggatgacatattccgcaagaaaagactgacaattatggatcttcatccgggagcaggcaagactaaaaggtatttacccgctatcgtgcgggaagccattaagcgaggcctgagaaccctcatcttggcgccaacacgcgtcgtggccgcagagatggaagaggctctgagggggctccctatacgttaccagacccccgccattcgggctgagcacactggaagagaaatcgtagacctgatgtgtcatgcaaccttcacaatgaggcttctgagtccaatccgcgtgcctaactataatttgattatcatggatgaggcccactttacggaccccgcctctattgctgcgcgaggttacataagcactagagttgaaatgggcgaggcagccgggatcttcatgaccgctacaccaccgggatcccgggacccttttccccagtcaaacgccccaattatggatgaggaaagggagatccccgaacgctcttggaatagcggccacgagtgggtcaccgacttcaaaggtaagactgtgtggtttgtgcctagtatcaaggcagggaacgatattgccgcttgcctacgtaaaaatggaaagaaagtcatacagctgtccagaaagacattcgacagcgaatatatcaaaacccggacgaacgattgggactttgtagtgactacagatatttctgagatgggcgcgaatttcaaggccgagagggttatcgacccacgccgatgtatgaagcccgtgattctcaccgatggcgaagagagagtcatcttagcagggcctatgccggtgacccattcatccgctgcccaacggaggggacgcgttggtagaaaccccaagaatgaaaacgaccagtacatatacatgggcgagcccctggaaaatgatgaggactgcgcacactggaaggaggccaaaatgcttctggacaacatcaatactcctgaagggattatccccagtatgtttgagccagaaagggagaaggtggatgctattgacggagaatatcggctccgtggcgaggcccgcaaaacattcgtcgatttgatgcgaagaggtgacctgcctgtgtggctcgcgtacagggtagcagccgaggggatcaactatgctgatcggcgctggtgttttgacggcgtgaagaacaatcagatactggaagagaacgttgaagtcgagatttggaccaaagagggagaaagaaagaaacttaaacccaggtggctagatgcccggatctacagcgacccactggctttgaaggagttcaaagagttcgcagccggccgaaagtcgttaacactgaatctcattactgagatggggagactgcctacgtttatgacccaaaaagctcgcaacgcccttgataatctggcagtgctccatacagcggaagccggaggtagggcttataaccacgccttgtctgagctgccggagactctagaaaccctgctccttctgacattattggcaaccgtgactggcgggatcttcctgtttctcatgtccggaaagggcataggtaagatgacgctggggatgtgctgcatcattaccgctagcatccttctgtggtacgcccagattcagccccactggatcgcagcctcaataattctcgagttctttttgatcgtcctgttaatcccagaacctgagaaacagcggacaccccaagacaatcagctaacttatgttgtgattgctatcctgaccgtagtggcggccacaatggcaaacgaaatgggcttcctcgagaagaccaaaaaggattttggacttggcagtataactacacagcagccagagtctaatattctggacatcgatttgcgtcctgcttccgcctggacgctgtacgccgtcgcaaccactttcattacacccatgctcagacatagcatcgaaaactcaagtgtgaatgttagcctgaccgctatagccaaccaagcgaccgtgcttatggggctcggaaaaggttggccgctgtccaagatggacatcggcgtcccattgctggctattgggtgttactctcaggtaaatcctatcacattaactgccgcactactgctccttgtggcccactatgctattatcggacccggcctgcaggcaaaggccacgagggaggcgcagaaacgcgctgccgcaggtattatgaagaacccaaccgttgacgggatcacagtgatagatttggaccccattccttacgatccgaaatttgaaaagcaactgggccaggtcatgctcctggtgctttgcgtcactcaggtgttaatgatgcggaccacatgggccctgtgtgaggctctcaccttggccactggacccatcagcacgctgtgggaaggcaatccagggcgattctggaacacaaccatcgcagtttccatggctaatatttttagaggatcatatctagccggcgcgggtctactcttctctataatgaaaaacactgccaacaccaggcgcgggacaggaaatactggcgagacccttggtgagaagtggaagaaccggctgaatgcattgggcaaaagtgaatttcagatctacaagaaatcggggattcaagaggtggacagaacactggctaaggaaggaatcaaacgtggcgagacggatcatcacgccgtaagcagggggtccgcaaagctccggtggttcgtggagcgcaacctggtcacccctgaaggaaaagttgtggacttaggctgcggtcgagggggatggtcttattactgtggcggtcttaagaatgtcaaggaggtgaaaggcctgactaaaggcgggcccgggcatgaagaacctattccaatgtcaacatatgggtggaacctcgtaagactacagagcggagtggatgttttctttacaccacctgaaaaatgcgacactctgttgtgtgatatcggcgagtccagtccaaatcccacagtggaggctggtaggaccctgcgggtcctcaaccttgtggaaaattggctgaacaataacacgcagttctgcataaaggtcttgaatccgtacatgccttctgtgatcgagaaaatggaagccctgcaacgcaagtacgggggagccctcgttagaaacccattaagcagaaattcaacccacgagatgtattgggtatccaacgcgagtggcaacattgtgagctctgtcaatatgatctcccgaatgctgattaaccggtttacaatgcgtcacaagaaagctacttacgaacccgacgtggatcttggctcagggaccagaaatatcggaatagagagcgagacacctaacctggacattatcggtaagcgcatcgagaagattaagcaggagcatgaaacttcgtggcactatgatcaggaccatccatacaaaacctgggcatatcacggctcttacgagacaaagcagaccgggagtgcctccagcatggttaatggagtggtcaggctactcactaagccctgggacgtgataccgatggtaacgcaaatggctatgacagataccactcctttcggccagcagcgggtgtttaaagaaaaggttgacaccagaacacaggagcccaaagagggtacgaagaaactgatgaagatcaccgccgaatggttgtggaaggagctggggaaaaagaaaactccacgcatgtgtacaagggaagagttcacccgaaaggtccggtcaaacgcagccctcggagctatttttactgatgagaataaatggaagtccgcgagagaagccgtggaggactctggcttctgggaacttgtggataaagagaggaacctgcacttagaaggcaagtgcgagacatgtgtctataatatgatggggaagcgcgagaaaaagctgggagaatttggtaaagcaaagggcagccgtgctatctggtacatgtggttgggggcccggttcctcgagtttgaagcactgggattcctaaacgaggaccattggtttagtagagaaaattcccttagcggcgttgagggtgaggggctgcacaaactcggatacattctgagggatgtgtctaagaaggaaggcggcgccatgtatgctgacgataccgccgggtgggacacacgcatcactttggaggatctgaaaaacgaagagatggtaaccaatcatatggaaggagagcacaagaaactcgcggaggcaatattcaaacttacgtaccaaaacaaagtggtccgagtgcagcggcctacccccagaggtacagttatggacatcatttcaaggcgcgaccagagaggcagtggacaggtggtcacttatggactgaataccttcacaaacatggaagcccaattaatccggcagatggagggcgaaggtgtgtttaagtccattcagcaactgactgtaaccgaggagatcgctgttaagaactggttggccagggtggggcgtgaacgactcagccgcatggcaatttctggagatgactgcgtcgtgaaaccactggatgacagattcgcttcggccctaacggctcttaatgatatgggcaaggtgcggaaagacatacagcagtgggagccctcaaggggctggaacgattggacacaggtccctttttgcagccatcacttccacgaactgatcatgaaggacgggcgcgttctcgtggtaccatgtagaaatcaagatgagctgattggacgggccaggatctcccagggtgcaggctggagtatgcgagaaaccgcgtgcttggggaaatcttacgcccagatgtggagcttaatgtattttcatcgtagagacctgcgcctcgctgccaacgcaatctgttccgctgtgccgtcacactgggtccccacaagtcggacaacctggtctattcatgccactcacgagtggatgaccacagaggatatgcttacggtgtggaatagggtttggatacaggaaaacccttggatggaggacaagaccccagtggaaagctgggaggaaatcccctacctgggaaagagagaggatcaatggtgcggctccctaattggtctgacttcacgcgcaacatgggccaaaaatatccagaccgcgattaaccaggtccggagcctcatcgggaatgaggaatatactgactacatgccttctatgaagaggttccgaagagaggaagaggaagctggagtgttgtggtga

SEQ ID NO: 14822 - RNA, 9876 nt, synthetic construct
  misc_feature 1..9876: note = derived and/or modified CDS sequence (opt3) from DENV-2__EU482641__SS-prME
  source 1..9876: mol_type = other RNA
agcgcaggaatgatcattatgctgatacccaccgtgatggctttccacctcacaactagaaacggggagcctcatatgatcgtcggcattcaggaaaagggtaaatcccttctgtttaagacggaggacggcgttaatatgtgcaccttgatggcaatggatttaggggaactgtgtgaggacacaatcacttacaaatgcccattactcaggcaaaacgaaccggaggatattgactgttggtgcaattctacctcaacatgggtgacctatggaacttgtacaatcaccggcgagcaccggcgcgaaaagcgaagtgtagccctggtgccccatgtcggtatggggcttgagacgcgtactgaaacctggatgagctccgagggagcgtggaaacacgctcagagaatagagacatggatcctgaggcatcctggcttcactattatggccgcaatcttggcctacaccattggcacaacccactttcagcgggtgctcatcttcatactgctgacggctgttgcaccatctatgactatgcgctgcattgggatctcgaacagagattttgtggaaggagtctcaggtggcagctgggtggacattgtactcgagcacgggagttgtgttacaaccatggccaagaataagcccactttagatttcgaactgatcaaaacagaggctaagcagcctgccacccttaggaaatattgcatcgaagcgaagttgacgaacaccacaactgagtcccggtgtccaacccaaggagagccctctctgaaagaagaacaggacaagcgctttgtgtgcaagcatagcatggtcgatcgaggctggggtaatgggtgtggactattcggcaaaggcgggattgtgacatgcgcaatgtttacttgcaagaaaaacatggaaggaaagatagtgcagcctgagaatctcgaatacaccatcgtcgttacaccacactccggtgaggagcatgccgtgggcaacgacaccgggaaacacggaatggaaattaaggtaactccgcagtcaagtatcacggaggctgaactgacaggctatggtaccgtgactatggagtgtagccccagaaccgggcttgatttcaatgaaatggtcctgttgcaaatggagaacaaagcctggctcgtgcacaggcagtggtttctggacttacctctgccatggctccccggcgcagataagcaggagtctaattggatacagaaggaaacacttgttaccttcaaaaaccctcatgctaagaaacaagacgtggtcgtgctgggatcccaggagggcgccatgcacactgcgttgacaggggccacggaaattcagatgtcaagcggaaatctactgtttaccggtcatctcaagtgccggctgcgtatggacaaacttcaactgaagggcatgagttactctatgtgtactgggaagttcaaagtagttaaggagatcgcagagacacagcacggaaccatcgtgattcgcgtccagtatgaaggcgatggttccccatgcaaaatccccttcgagattatggacttggaaaagagatacgtgctcgggaggctgataacagtcaacccgatcgtgactgagaaagatagccctgttaacattgaagctgagcccccatttggcgactcgtacatcatcattggagtggagcctggccagttaaagctgaattggttcaagaaagggtcttccataggacaaatgtttgaaaccacgatgcggggtgccaagcgaatggctatcctaggcgataccgcctgggacttcgggtcactcggaggcgtatttacaagtattggtaaagcactgcatcaggtcttcggggccatctatggcgctgcgtttagcggagtgtcctggactatgaagattcttatcggcgttataatcacctggattgggatgaactctcgcagcacatcattgagtgtgtccctggtcctcgtgggaatcgtaactctgtaccttggcgtgatggttcaggcagatagcggttgtgtcgtgtcttggaaaaataaggagctgaagtgcgggtcaggaattttcatcaccgacaacgtgcacacgtggacagaacagtataaatttcaacccgagagtccaagcaagttggcctccgctatacagaaagcccaggaagagggcatttgtggtatcagatctgtcaccaggctcgagaatctgatgtggaagcagattactcccgaattaaaccacatcctggcagagaatgaagttaaactaacaataatgaccggcgatatccgggggattatgcaagccggaaagcgctcgctcagacctcagccaactgagctgaaatacagctggaagacctggggcaaggctaaaatgctttccacagaatcatataaccagacgttcttgatcgacgggccggagaccgccgagtgccccaatactaacagggcatggaatagtctggaagtggaggattacggatttggcgtgttcacaaccaacatttggctcaagctgaaagaaaagcaggacgcgttttgtgactctaaattaatgagcgctgccatcaaggataatcgtgcagtacatgccgacatgggttattggatagagtccgctctgaacgatacatggaagattgagaaagcctcattcatcgaagtcaagaattgccactggcctaaaagccatactctttggtctaacggggtgttggagtccgaaatgatcattccaaagaacctcgcaggacccgttagtcaacacaattaccggcctggctaccacacccagatcgctggtccatggcatctgggcaaactagagatggacttcgatttttgtgacgggacgacagtgattgtcaccgaagattgcggaaaccgaggccccagcctgagaactaccacagcctctgggaagctcataactgagtggtgctgtaggtcctgcaccctgccgcctcttcgctatcggggagaggacggctgttggtacggtatggaaatcagaccattgaaggagaaagaagagaatctggtgaactcattagttacagcggggcacggacaggtggataatttcagtctcggcgtactgggtatggccctttttctggaagagatgttgaggacgcgcgtcggcaccaagcatgctattctcctggtggcagtgagcttcgtcactctaatcacagggaacatgtcgtttaaagacctgggacgagttgtggtaatggtgggcgccaccatggctgatgacattgggatgggagtcacttatctcgccctgcttgcagcgttcaaggtgcggcccacatttgccgctggcttgctgttacgtaaactcacctccaaggagctgatgatgacgactatcggtatagttcttctgtctcaaagcaccatccctgaaacagtgctagagctcaccgatgccctggcattggggatgatggtcctgaagattgtgagaaatatggaaaaataccagttagctgttactatcatggccattctctgcgtgcccaacgcagtcatcctgcagaatgcctggaaggtatcatgtacaatacttgctgtggttagtgtgtccccactgttgctcacctctagccagcaaaagactgactggattcctctggcgctaactatcaagggactgaaccccaccgccatcttccttacgacactctccaggaccaataaaaagcgctcatggccactgaacgaggcaattatggctgtcggcatggtgagcatattggccagttctctgctcaaaaatgacatcccgatgactggccctctagtagccgggggactgcttaccgtgtgctatgtcctgacaggtcggtccgctgatttggaactcgagagagcaactgacgttaagtgggaggatcaggccgaaattagcggctcgtcacccatcctgtctattaccatcagtgaggacgggtccatgagcataaagaacgaagaggaggaacagacgctaacaatcctgattaggaccggacttctcgtgatctctggcctgtttccaattagcatccccataactgcggctgcctggtacttgtgggaggtgaaaaagcagcgagccggtgtcttatgggatgtgccttccccaccccctatggggaaagccgaactggaggacggagcttatcgcattaagcaaaaaggcatcctcggctactcacagatcggggcaggagtttacaaggaaggtacattccacaccatgtggcatgtaactcggggcgccgtgctgatgcacaaggggaaaagaattgagccgagttgggcggatgtcaagaaagaccttatcagctatggaggcggttggaagctggagggggaatggaaagagggagaagaggtgcaggttttggctctagaaccaggcaagaatcccagggccgtgcagacaaagcctggcctgtttaaaaccaacacggggactataggagcagtctctctcgatttctccccaggtacctcaggcagtcccattatcgacaagaaagggaaggtggtaggactgtacggcaacggtgtcgtgacacgtagcggggcctatgtttccgctattgcccaaaccgagaaatctatcgaggataatcctgaaatagaggacgatatttttcgcaagcggagacttacaatcatggacttacacccgggagcaggcaagactaaaaggtacctgcccgctatcgtgcgagaagccattaagcggggcctccgcaccttgatcctggcgccaacgagagtcgtggccgcagagatggaagaggctctcagggggctgcctattcggtatcagacacccgccatacgagctgagcatactggaagagaaatcgttgaccttatgtgtcacgcaaccttcacaatgcgcctgttgtcgccagtgagggtccctaactacaatctaattatcatggatgaggcccatttcaccgaccccgccagcatcgctgcgcgtggttatatttcaactcgggtggaaatgggcgaggcagccgggatatttatgaccgctacaccaccgggatccagagatcctttcccccagagtaacgccccaatcattgacgaggaaagggagatccccgaacgctcttggaatagcggccacgagtgggtaacggattttaaaggtaagactgtgtggttcgttccttccattaaagcagggaacgacatcgccgcttgcctgcgaaagaatggaaagaaagtcatacaactctcaagaaagacctttgattctgaatacgtgaaaacacggaccaacgactgggatttcgtggtcactacagacatcagcgagatgggcgcgaattttaaggccgagagggtaattgatccacgccgttgtatgaaacccgtgatcttaaccgacggcgaagagagagttattctggcagggcctatgccggtgacgcatagttccgctgcccagcggaggggacgcatcggtcgaaacccaaagaatgaaaacgaccagtacatatatatgggcgagccccttgaaaatgatgaggactgcgcacactggaaagaggccaagatgctgctcgataacattaatactcctgaagggatcattcccagcatgttcgagccagaaagagagaaggtcgacgctatcgatggagaataccggttgaggggcgaggcccgcaaaacatttgtggacctgatgagaaggggtgatctccctgtttggctggcgtataaggtggcagccgaggggataaactacgctgaccggcgttggtgtttcgatggcatcaaaaacaatcagattcttgaagagaacgtcgaagtggagatctggaccaaggagggagaacgcaaaaagctaaagccccgatggctggacgccagaatttattctgatccattggctttaaaagagtttaaggagttcgcagccggcaggaaatcactgaccctcaatctgatcactgagatggggcggcttcctacattcatgacccaaaagacacgcgacgctctggataacctcgccgtattgcacactgcagaagcgggaggtagagcctacaatcatgctctgtccgagctaccggagacgctggaaaccctccttctgttaacattgctggccactgtgaccggcgggatatttctcttcctgatgagtggaaggggcattggtaaaatgacacttgggatgtgctgcatcatcaccgcaagcattctgctctggtatgctcagatccagccccactggatagccgcatcgattatcttggagtttttcctgattgttttactaatcccagaacctgagaagcagcggactccccaagacaaccagctgacgtacgtcgtgatagccatcctcaccgtggtcgctgcgacaatggccaatgaaatgggctttcttgagaagactaaaaaggacctgggattgggctctattgcaacccagcagccagagtccaacatcctggatattgacctccgacctgctagcgcctggacactgtacgccgttgcaaccactttcgtgacacccatgcttagacattcaatcgaaaatagttctgtaaacgtgtccctcacggctattgccaatcaagcgaccgtcctgatggggttgggaaaaggttggccgctgagcaagatggatatcggcgtgccattactagctatagggtgttattcacaggttaaccctattactctgacagccgcactccttctgttggtggcccactacgctatcatcggacccggcctgcaggcaaaagccacccgcgaggcgcagaagagggctgccgcaggtattatgaagaatccaaccgtcgacgggataacagtaatcgatctcgaccccattccttatgatccgaaatttgaaaagcaactgggccaggtgatgcttttaatcctgtgcgttactcaggtgctcatgatgcggacgacctgggccttgtgtgaggctctgacactagccactggacccattagtaccctgtgggaaggcaacccagggcgtttctggaatacaaccatcgcagtcagcatggctaacatatttagaggatcctacctcgccggcgcgggtcttctgttctctatcatgaaaaatactacgaacacaaggcgcgggaccggaaacattggcgagactttgggtgagaagtggaaaagccggctgaatgccctcggcaagtccgaatttcaaatctataaaaagtcagggattcaggaggtggaccgaaccctggcaaaggaaggaatcaaaagaggcgagacagatcaccatgctgtctctagggggagtgccaagttacgctggttcgtggagcggaacatggttactcctgaaggaaaagtggtagaccttggctgcggtagagggggatggtcgtactattgtggcggtctgaagaatgtgcgtgaggtcaaaggcctcaccaaagggggacccggccacgaggaacctataccaatgagcacatacgggtggaacctagttaggctgcagtccggagtggatgtctttttcattccccctgaaaagtgcgacacgttgctgtgtgatatcggcgagtcttcaccaaatcccaccgtggaggcaggtcggactctccgcgtacttaacctggtggaaaattggttgaacaataacacacagttctgcatcaaagttctgaatccgtacatgcctagcgtgattgagaagatggaagctctccaacgaaaatatgggggagccttagtcagaaacccactgtccaggaatagtacccatgagatgtactgggtgtctaacgccagcggcaatatagtctcatccgtgaacatgatcagtcggatgcttattaaccgctttactatgagacacaagaaagcgacatatgaacccgacgttgacctgggcagcgggaccaggaatatcggaattgagtctgagatccctaacctagatataatcggtaagcgaattgaaaagatcaaacaggagcatgaaacgtcctggcactacgaccaggatcacccatataagacctgggcttaccatggctcatatgagacaaaacagactgggagcgcatcgtctatggtaaatggagtggtccggctcctgaccaagccctgggacgtgttgccgacagttactcaaatggccatgaccgatacaacccctttcggccagcagcgtgtgtttaaagaaaaggtcgacactagaacgcaggagcccaaggagggtaccaaaaagctgatgaaaattaccgctgaatggctctggaaggagcttgggaaaaagaaaactccacgcatgtgtaccagggaagagttcacacggaaggtgagaagtaacgccgcactgggagccatctttacggatgagaataagtggaaatccgctcgcgaagcggtagaggacagcaggttctgggaattagtggataaggagcgaaacctgcacttggaaggcaaatgcgagacctgtgtttacaatatgatgggcaagcgggagaaaaagctcggggaatttggaaaggccaaaggttcaagagcaatttggtacatgtggctgggcgctaggttcctagagtttgaagcccttgggttcctgaacgaggaccattggttttcccgcgaaaattctctcagcggagtcgagggcgagggtctgcacaagttggggtatatactgcgtgatgtgagtaaaaaggaaggaggcgcaatgtacgccgacgacactgctggctgggatacacggatcaccctcgaggaccttaaaaacgaagagatggtgactaatcacatggaaggggagcataagaagctggccgaggcgattttcaaattaacatatcaaaacaaggtcgttagagtgcagaggcctacaccccgcggaacagtaatggatatcatctcccgacgggaccagagaggtagcggccaagtggggacttacggactgaatacctttacgaacatggaagcacagttgattaggcagatggagggcgaaggtgtcttcaaaaatatacagcacctcaccgtgacagaggaggttgccgtgcataactggctggctcgcgtcgggagagaacggctatctaggatggccatctcaggagatgactgcgtggtaaagccacttgatgaccgtttcgcaaacgctctgactgccctcaatgatatgggcaaaattcgaaaggacatccaacagtgggagcccagtaagggctggaacgattggacccaggttcctttttgctcccaccatttccacgaactgattatgaaagacgggcgcatcttggtggtcccatgtagaaatcaggatgagttaataggacgggctaggatcagccaaggtgccggctggtctctgcgcgaaacagcatgcctcgggaagtcgtatgcgcagatgtggtcacttatgtactttcacagacgggacctgaggctagccgctaacgccatttgtagcgcagtgccgtcccattgggtgcccacaagtcgaaccacgtggtctatccacgctaaacatgagtggatgacaaccgaggacatgctgactgtctggaatcgtgtttggattagagaaaacccttggatggaggataagacaccagtggaaagctgggaggaaatcccctatctcggaaaacgcgaggaccagtggtgcggctccttgataggtctgacctcacgggccacttgggcaaagaatattcaggccgcgatcaaccaagtaaggagtcttattgggaatgaggaatacaccgattacatgccttctatgaagagattccgccgggaggaagaggaagctggagtgctgtggtga

SEQ ID NO: 14823 - RNA, 9876 nt, synthetic construct
  misc_feature 1..9876: note = derived and/or modified CDS sequence (opt3) from DENV-2__EU482642__SS-prME
  source 1..9876: mol_type = other RNA
agcgcaggcatgatcattatgctgatacccaccgtgatggctttccacctcactactcggaacggggaacctcatatgatcgtcggtattcaagaaaagggaaaatcccttctgtttaagacggaggacggcgttaatatgtgcaccttgatggcaatggatttaggggaactgtgtgaggacacgatcacttacaaatgcccacttctcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactgccgagtgccccaatacaaacagagcatggaatagtctggaagtggaggattacggatttggcgtgttcaccacaaacatctggctcaagctgaaagaaaagcaggacgcgttttgtgactctaagttaatgagcgctgccattaaagataatagggcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaaactcattaccgagtggtgctgtagatcctgcacactgccgcctcttaggtatcgcggagaggacggctgttggtacggtatggaaatacggccattgaaggagaaagaagagaatctggtgaactcattagttacggcggggcacggacaggtggataatttcagtctcggcgtactgggtatggccctttttctggaagagatgttgagaaccagggtcggcactaagcatgctatcctcctggtggcagtgagcttcgtcacactaattaccgggaacatgtcgtttaaagacctgggacgcgttgtggtaatggtgggcgccactatggctgatgacatcgggatgggagtcacatatctcgccctgcttgcagcgttcaaggtgcgacccacctttgccgctggcttgctgttacggaagctcacgtccaaagagctgatgatgactaccattggtatcgttcttctgtctcaaagcacaatacctgaaaccgtgttcgagctaactgatgccctcgcactggggatgatggtcttgaagatcgtgcgtaatatggaaaaataccagctggctgttacaattatggccatcttatgcgtgcccaacgcagtcattctccagaatgcctggaaggtatcatgtaccatcctggctgtggttagtgtgtccccacttctgttgacatctagccagcagaagactgactggatacctctcgcgctgaccattaagggactaaaccccacggccatctttctgacaaccctttccagaactaataaaaagaggtcatggccactcaacgaggcaatcatggctgtcggcatggtgagcattctggccagttctttgctgaagaatgacataccgatgaccggccctttagtagccgggggactcctgacagtgtgctatgtccttactggtcgctccgctgatctggaattggagcgggcaaccgacgttaaatgggaggatcaggccgaaatcagcggctcgtcacccattctctctatcacgattagtgaggacgggtccatgagcatcaagaacgaagaggaggaacagacactgaccatactaatcagaactggactgcttgtgatttctggcctcttcccaatcagcattcccatcacagcggctgcctggtacctgtgggaggtgaaaaagcagagggccggtgtcttgtgggatgtgccttccccaccccctatggggaaagccgaattagaggacggagcttatcgaataaagcaaaagggcattctgggctactcacagatcggggcaggagtttacaaagaaggtacctttcacactatgtggcatgtaacacgcggcgccgtgctcatgcacaaggggaaacggatcgagccgagttgggcggatgtcaagaaagacctgattagctatggaggcggttggaaacttgagggggaatggaaggagggagaagaggtgcaggttctggctttggaaccaggcaaaaatcccagagccgtgcagaccaagcctggcctattcaaaacgaacactgggaccatcggagcagtctctctggatttttccccaggtacatcaggcagtcccataattgacaagaaagggaaggtggtaggactctacggcaacggtgtcgtgaccaggagcggggcctatgtttccgctatcgcccaaacagagaagtctattgaggataatcctgaaatcgaggacgatatattccgtaaacgccggctgactattatggaccttcacccgggagcaggcaagaccaaaagatacttacccgctatcgtgagggaagccatcaagcgaggcctgcggacgctcattttggcgccaacacgcgtcgtggccgcagagatggaagaggctctgagagggctccctatcaggtatcagactcccgccattcgggctgagcataccggacgagaaatagttgacctgatgtgtcacgcaacattcaccatgagacttctgtcgccagtgcgcgtccctaactacaatttgatcattatggatgaggcccattttactgaccccgccagcatcgctgcgaggggttatatctcaacccgtgtggaaatgggcgaggcagccgggattttcatgacagctacgccaccgggatcccgggatccttttccccagagtaacgccccaataatcgacgaggaaagagagattcccgaaaggtcttggaatagcggccacgagtgggtaactgatttcaaaggtaagaccgtgtggtttgttccttccatcaaggcagggaacgacattgccgcttgcctacgcaaaaatggaaagaaagtcatccaactgtcacgaaagacattcgattctgaatacgtgaaaaccagaactaacgactgggattttgtggtcacaaccgacataagcgagatgggcgcgaatttcaaggccgagcgggtaatcgatccaaggcgctgtatgaaacccgtgattctcacggacggcgaagaacgtgttatcttagcagggcctatgccggtgactcatagttccgctgcccagagacggggaaggattggtcgcaacccaaagaatgaaaacgaccagtacatctatatgggcgagcccctggaaaatgatgaggactgcgcacactggaaggaggccaaaatgcttctggataacataaatacacctgaagggattatccccagcatgtttgagccagaacgagagaaggtcgacgctattgatggagaatacagactccggggcgaggccaggaaaaccttcgtggacttgatgcgcagaggtgatctgcctgtttggctcgcgtataaggtggcagccgaggggatcaactacgctgacaggcggtggtgttttgatggcatcaagaacaatcagatcctggaagagaacgtcgaagtggagatttggaccaaggagggagaacgtaagaaacttaagccccgctggctagacgcccgaatctattctgatccactggctttgaaagagttcaaggagttcgcagccggcagaaaatcattaactctgaatctcattacagagatggggaggctgcctacctttatgacacaaaagactcgggacgctcttgataacctggccgtactccacacggcagaagcgggaggtcgcgcctacaatcatgctttgtccgagctgccggagaccctagaaacactgctccttctgactttattggccaccgtgacaggcgggatcttcctgtttctcatgagtggaagaggcataggtaagatgaccctggggatgtgctgcattatcactgcaagcatccttctgtggtatgctcagattcagccccactggatcgccgcatcgataattctcgagttctttttgatcgttctgttaattccagaacctgagaaacagaggacgccccaagacaaccagctaacctacgtcgtgatcgccatactgacagtggtcgctgcgactatggccaatgaaatgggcttcctcgagaagaccaaaaaggaccttggactgggctctatcgcaacacagcagccagagtccaacattttggatatcgacctgcggcctgctagcgcctggaccctctacgccgttgcaactacatttgtgacgcccatgctgcgacattcaattgaaaatagttctgtaaacgtgtcccttaccgctatcgccaatcaagcgactgtcctcatggggctgggaaaaggttggccgttgagcaagatggatattggcgtgccactgttagctatcgggtgttattcacaggttaaccctataacactaaccgccgcactgctccttctggtggcccactacgctattatcggacccggcttgcaggcaaaggccaccagagaggcgcagaaacgcgctgccgcaggtatcatgaagaatccaacagtcgacgggattactgtaatagatctggaccccatcccttatgatccgaaattcgaaaagcaactcggccaggtgatgctgcttattttatgcgttacacaggtgctgatgatgaggaccacatgggccctctgtgaggctttgactctggccaccggacccatcagtacactatgggaaggcaacccagggcggttttggaataccactattgcagtcagcatggctaacatcttccgtggatcctacctggccggcgcgggtctcctattttctataatgaaaaatacgacaaacaccagaagggggactggaaacatgggcgagaccctgggtgagaagtggaaaagccgcttgaatgccctgggcaagtccgagttccaaatctataagaaatcagggattcaggaggtggaccggacactcgcaaaggaaggaatcaaacgaggcgagactgatcaccatgctgtctctagagggagtgccaagctgaggtggtttgtggagcgcaacatggttacccctgaaggaaaagtggtagacttaggctgcggtagagggggatggtcgtactattgtggcggtcttaagaatgtgagagaggtcaagggcctgacaaaagggggacccggccacgaagaacctattccaatgagcacgtacgggtggaacctcgttcgtctacagtccggagtggatgtcttcttcataccccctgaaaagtgcgacaccctgttgtgtgatataggcgagtcttcaccaaatcccactgtggaggcaggtaggacactgcgggtactcaaccttgtggaaaattggctgaacaataacacccagttttgcattaaagttttgaatccgtacatgcctagcgtgatcgagaagatggaagctctgcaacgcaaatatgggggagccctcgtccgaaacccattatccagaaatagtactcatgagatgtactgggtgtctaacgccagcggcaatatcgtctcatccgtgaacatgattagtaggatgctgataaaccggttcacaatgcgccacaagaaggcgacctatgaacccgacgttgaccttggcagcgggacgagaaatatcggaattgagtctgagatccctaacctggatattatcggtaaaaggatagaaaagatcaaacaggagcatgaaacctcctggcactacgaccaggatcacccatataagacatgggcttaccatggctcatatgagactaaacagaccgggagcgcatcgtctatggtaaatggagtggtccgactactcacaaagccctgggacgtgctgccgactgttacccaaatggccatgacagataccactccttttggccagcagcgggtgttcaaggaaaaagtcgacacgcgtacacaggagcccaaggagggtaccaaaaagttgatgaaaattactgctgaatggctgtggaaggagctcgggaaaaagaagaccccaagaatctgtacacgcgaagagtttacgaggaaagtgcggagtaacgccgcacttggagccattttcaccgatgagaataagtggaaatccgctagagaagcggtagaggacagccgcttttgggaactggtggataaggagaggaacttacacctggaaggcaaatgcgagacttgtgtttacaatatgatgggcaagcgagagaagaaattgggggagttcggaaaggccaaaggttcacgggcaatctggtacatgtggctcggcgctagatttctggagttcgaagccctagggtttcttaacgaggaccattggttctccagggaaaattctctgagcggagtcgagggcgagggtctccacaagctggggtatattttgcgcgatgtgagtaaaaaggaaggaggcgcaatgtacgccgacgacacagctggctgggatacccgtataactctggaggacctcaagaacgaagagatggtgacaaatcacatggaaggggagcataagaaacttgccgaggcgatctttaaactgacctatcaaaacaaagtcgttcgggtgcagagacctacacccaggggaactgtaatggatattatctcccgcaaagaccagcgaggtagcggccaagtggggacctacggattaaatacgttcaccaacatggaagcacagctgatccggcagatggagggcgaaggtgtcttcaagaatattcagcacttgacagtgactgaggaggttgccgtgcaaaactggctcgctagagtcgggagggaacgcctgtctagaatggccatatcaggagatgactgcgtggtaaagccactagatgaccggtttgcaaacgctcttaccgccctgaatgatatgggcaaaatcaggaaggacattcagcagtgggagcccagtaaaggctggaacgattggacacaggttcctttctgctcccatcactttcatgaactcatcatgaaggacgggcgtgtgctggtcgtgccatgtcgaaatcaagatgagttgattggacgcgctagaatcagccagggtgccggctggtctttacgggaaactgcatgcctggggaaatcgtatgcgcagatgtggtcactcatgtacttccacaggcgcgaccttagactggccgctaacgccatatgtagcgcagtgccgtcccactgggtccccaccagtcggacgacatggtctatccatgctaagcacgagtggatgaccactgaggacatgctaacagtttggaatagggtgtggattcaggaaaacccttggatggaggataagaccccagtagaaagctgggaggaaatcccctatctgggaaaacgagaggaccaatggtgcggctccctcattggtttgacttcacgtgccacctgggcaaagaatatccaggccgcgataaaccaggtgagaagtctgattgggaatgaggaatacacagattacatgccttctatgaaacgctttcggagggaggaagaggaagctggagtcctttggtga

SEQ ID NO: 14824 - RNA, 9876 nt, synthetic construct
  misc_feature 1..9876: note = derived and/or modified CDS sequence (opt3) from DENV-2__EU482643__SS-prME
  source 1..9876: mol_type = other RNA
agcgccggaatgatcattatgctgatacccaccgtgatggctttccacctcactactcggaacggggaacctcatatgatcgtcggcattcaggaaaagggtaaatcccttctgtttaagacggaggacggagttaatatgtgcaccttgatggcaatggatttaggggaactgtgtgaggacacaatcacttacaaatgcccattactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatgaagaacaaggcctggctcgtgcacaggcagtggtttctggacttacctctgccatggctccccggcgcagataaacaggagtctaattggatccagaaggagacccttgttactttcaaaaaccctcatgctaagaaacaagacgtggtcgtgctgggatcccaggaaggcgccatgcacacagcgttgacgggggccaccgagatacagatgtcaagcggaaatctactgtttactggtcatctcaagtgccggctgcgtatggacaaacttcaactgaaaggcatgagttactctatgtgtacagggaagttcaaagtagttaaggaaattgcagagacccagcacggaacaatcgtgatccgcgtccagtatgagggcgatggttccccatgcaaaattcccttcgaaatcatggacttggagaagagatacgtgctcgggaggctgattactgtcaacccgatagtgaccgaaaaggatagccctgttaacatcgaggctgaacccccatttggcgactcgtacattatcatcggagtggagcctggccagttaaaactgaattggttcaagaaagggtcttccattggacaaatgtttgagacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaagaactgaagtgcgggtcaggaatcttcattacggacaacgtgcacacatggaccgagcagtataaatttcaacccgaaagtccaagcaagttggcctccgctatccagaaagcccaggaggaaggcatatgtggtattagatctgtcactaggctcgagaatctgatgtggaagcagatcacacccgagttaaaccacattctggcagaaaatgaggttaaactaaccatcatgactggcgatataaaggggatcatgcaagccggaaagcggtcgctccgccctcagccaaccgaactgaaatacagctggaagacatggggcaaagctaagatgctttccacggagtcatataaccagaccttcttgattgacgggccggaaactacagagtgccccaataccaacagagcctggaatagtctggaggtggaagattacggatttggcgtgttcacaactaacatctggctcaaactgaaggagaagcaggacgcattttgtgactctaaattaatgagcgcggctattaaggataatagggccgtacatgcagacatgggttattggatcgaatccgccctgaacgatacctggaaaatagagaaggcttcattcattgaggtcaaaaattgccactggcctaagagccatacgctttggtctaacggggtgttggaatccgagatgatcatcccaaagaacctcgccggacccgttagtcaacacaattaccgtcctggctaccacacacagattgcaggtccatggcatctgggcaaactagaaatggacttcgatttttgtgacgggaccactgtgatcgtcaccgaggattgcggaaaccggggccccagcctgcgaacaactaccgcttctgggaagctcattacagaatggtgctgtagatcctgcacgctgccgcctcttaggtatcgcggagaggacggctgttggtacggtatggagatacggccattgaaagaaaaggaggaaaatctggtgaactcattagttaccgccgggcacggacaggtggataatttcagtctcggcgtactgggtatggcgctttttctggaggaaatgttgagaactagggtcggcacaaaacatgccatcctcctggtgaccgtgagcttcgtcactctaattacagggaacatgtcgtttaaggacctgggacgcgttgtggtaatggtgggcgctaccatggcagatgacatcgggatgggagtcacgtatctcgccctgcttgctgccttcaaggtgcgacccacttttgcagcgggcttgctgttacggaaactcacctccaaggagctgatgatgacaaccattggtatcgttcttctgtctcaaagcactatacctgagacagtgctagaactcaccgatgccctggctttggggatgatggtcctgaaaatcgtgcgtaatatggagaagtaccagttagccgttacaattatggcaatcctctgcgtgcccaacgctgtcattctgcagaatgcctggaaagtatcatgtactatccttgcagtggttagtgtgtccccactgttgctcacctctagccagcaaaagacggactggatacctctggccctaacaattaaaggactgaaccccaccgctatcttccttactaccctctccagaacaaataagaagaggtcatggccactgaacgaagcgatcatggccgtcggcatggtgagcattttggcaagttctctgctaaagaatgacataccgatgactggccctctcgtagctgggggactgcttaccgtgtgctatgtcctgacgggtcgctccgccgatttggagctcgaacgggccacagacgttaagtgggaggatcaggctgagatcagcggctcgtcacccattctgtctatcaccattagtgaagacgggtccatgagcatcaaaaacgaggaagaggagcagactctaacaatactgatcagaaccggacttctcgtgatttctggcctgtttccaatcagcattcccatcactgcagccgcgtggtacttgtgggaagtgaagaaacagagggctggtgtcttatgggatgtgccttccccaccccctatggggaaggccgagctggaagacggagcatatcgaataaagcaaaaaggcattctcggctactcacagatcggggccggagtttacaaggagggtacattccacaccatgtggcatgtaacgcgcggcgctgtgctgatgcacaaagggaagcggatcgaaccgagttgggcagatgtcaaaaaggaccttattagctatggaggcggttggaagctggagggggagtggaaagaaggagaggaagtgcaggttttggccctagagccaggcaagaatcccagagcggtgcagactaaacctggcctgtttaagaccaacacagggaccatcggagctgtctctctcgatttctccccaggtacatcaggcagtcccataattgacaaaaaggggaaggtggtaggactgtacggcaacggtgtcgtgactaggagcggggcctatgtttccgcaatcgcccaaaccgaaaaatctattgaggataatcctgagatcgaagacgatatatttcgtaagcgccggcttacgattatggacttacacccgggagctggcaaaacaaagagatacctgcccgccatcgtgagggaggcaatcaaacgaggcctccggactttgattctggctccaacccgcgtcgtggccgcggaaatggaggaagccctcagagggctgcctatcaggtatcagacacccgcaattcgggctgagcataccggacgagagatagttgaccttatgtgtcacgccactttcaccatgagactgttgtcgccagtgcgcgtccctaactacaatctaatcattatggatgaagctcatttcacagaccccgcaagcatcgccgccaggggttatatctcaacgcgtgtggagatgggcgaagctgcggggatttttatgactgcaaccccaccgggatcccgggatcctttcccccagagtaacgccccaataatcgacgaggagagagaaattcccgagaggtcttggaatagcggccacgaatgggtaacagattttaagggtaagaccgtgtggttcgttccttccatcaaagctgggaacgacattgccgcatgcctgcgcaagaatggcaagaaggtcatccaactctcacgaaaaacttttgattctgagtacgtgaagacaagaaccaacgactgggatttcgtggtcacgactgacataagcgaaatgggcgccaattttaaagctgagcgggtaatcgatccaaggcgctgtatgaagcccgtgattttaacagacggcgaggaacgtgttatcctggcggggcctatgccggtgacccatagttccgccgcacagagacggggaaggattggtcgcaacccaaagaatgagaacgaccagtacatctatatgggcgaaccccttgagaatgatgaagactgcgctcactggaaagaggccaagatgctgctcgataacataaatacccctgaggggattatccccagcatgttcgaaccagagcgagaaaaagtcgacgcaattgatggagagtacagattgcggggcgaagccaggaagacttttgtggacctgatgcgcagaggtgatctccctgtttggctggcttataaagtggccgcggaggggatcaactacgcagacaggcggtggtgtttcgatggcataaagaacaatcagatccttgaggaaaacgtcgaggtggaaatttggacaaaggagggagagcgtaaaaagctaaaaccccgctggctggacgcccgaatctattctgatccattggctttaaaggaatttaaagagttcgccgctggcagaaagtcactgaccctcaatctgattacagaaatggggaggcttcctactttcatgacgcaaaagacccgggacgcactggataacctcgccgtattgcacacagctgaggccggaggtcgcgcatacaatcatgcgctgtccgaactaccggagactctggagaccctccttctgttaacattgctggccaccgtgactggcgggatctttctcttcctgatgagtggaagaggcataggtaaaatgacgcttgggatgtgctgcattatcaccgctagcatcctgctctggtatgcccagattcagccccactggatcgcagcttcgataattttggaatttttcctgatcgttttactaattccagagcctgaaaagcagaggacaccccaagacaaccagctgacttacgtcgtgatcgccatactcaccgtggtcgcagccacaatggctaatgagatgggctttcttgagaagaccaagaaagacctgggattgggctctatcgcgactcagcagccagagtccaacattctggatatcgacctccggcctgccagcgcatggacactgtacgctgttgccacgaccttcgtgactcccatgcttcgacattcaattgagaatagttctgtaaacgtgtccctcacagccatcgcaaatcaagctaccgtcctgatggggttgggaaagggttggccgctgagcaagatggatattggcgtgccattactagccatcgggtgttattcacaggttaaccctataaccctgacagcggctctccttctgttggtggcccactacgcaattatcggacccggcctgcaggccaaagctactagagaagcacagaagcgcgccgcggctggtatcatgaaaaatccaacggtcgacgggattaccgtaatagatctcgaccccatcccttatgatccgaagtttgagaaacaactgggccaggtgatgcttttaattctgtgcgttacacaggtgctcatgatgaggactacctgggccttgtgtgaagcactgacactagccaccggacccatcagtactctgtgggagggcaacccagggcggttctggaatacgacaattgctgtcagcatggccaacatctttcgtggatcctacctcgcaggcgctggtcttctgttctctataatgaagaataccactaacaccagaagggggacaggaaacatcggcgaaactttgggtgagaaatggaaaagccgcctgaatgccctcggcaagtccgagtttcaaatttataaaaagtcagggatccaggaagtggaccggaccctggcgaaagagggaattaagcgaggcgaaacagatcaccatgccgtctctagagggagtgcaaaattaaggtggttcgtggagcgcaacatggttacgcctgagggaaaggtggtagaccttggctgcggtagagggggatggtcgtactattgtggcggtctgaagaatgtgagagaagtcaaaggcctcaccaaagggggacccggccacgaggaacctatcccaatgagcacttacgggtggaacctagttcgtctgcagtccggagtggatgtctttttcataccccctgagaaatgcgacacattgctgtgtgatattggcgaatcttcaccaaatcccaccgtggaggctggtaggactctccgggtacttaacctggtggagaattggttgaacaataacacacagttctgcatcaaggttctgaatccgtacatgcctagcgtgatcgagaaaatggaggccctccaacgcaagtatgggggagcattagtccgaaacccactgtccagaaatagtacccatgaaatgtactgggtgtctaacgctagcggcaatattgtctcatccgtgaacatgataagtaggatgcttatcaaccggtttacgatgcgccacaagaaagccacctatgagcccgacgttgacctgggcagcgggacaagaaatattggaatcgaatctgagattcctaacctagatatcataggtaagaggatcgagaaaattaagcaggaacatgagacttcctggcactacgaccaggatcacccatataaaacctgggcctaccatggctcatatgaaacaaagcagactgggagcgcgtcgtctatggtaaatggagtggtccgactcctgaccaagccctgggacgtgttgccgacagttacccaaatggctatgactgatacgacacctttcggccagcagcgggtgtttaaagagaaggtcgacacccgtactcaggaacccaaagagggtaccaagaaactgatgaagatcacagcagagtggctctggaaagaacttgggaagaagaaaacgccaagaatgtgtacccgcgaggagttcactaggaaggtgcggagtaacgccgctctgggagccatttttacagatgagaataaatggaagtccgcaagagaggccgtagaagacagccgcttctgggagttagtggataaagaaaggaacctgcacttggagggcaagtgcgaaacctgtgtttacaatatgatgggcaagcgagagaaaaagctcggggagtttggaaaagctaagggttcacgggcgatctggtacatgtggctgggcgccagattcctagaatttgaggcacttgggttcctgaacgaagaccattggttttccagggaaaattctctcagcggagtcgaaggcgagggtctgcacaaattggggtatattctgcgcgatgtgagtaagaaggagggaggcgctatgtacgccgacgacactgcaggctgggatacacgtataaccctcgaagaccttaaaaacgaggaaatggtgacaaatcacatggagggggaacataagaaactggccgaggctatcttcaagttaacttatcaaaacaaagtcgttcgggtgcagagacctacccccaggggaacggtaatggatattatctcccgccgagaccagcggggtagcggccaagtggggacctacggactgaatacatttactaacatggaggcccagttgatcagacagatggaaggcgagggtgtcttcaagaatattcagcacctcaccgtgacagaagaggttgcggtgcaaaactggctggcaagggtcgggcgcgagagactatctcggatggccatatcaggagatgactgcgtggtaaagccacttgatgacaggttcgctaacgccctgactgcactcaatgatatgggcaaaatccgtaaggacattcagcagtgggaacccagtaaaggctggaacgattggacccaggttcctttttgctcccatcacttccatgagctgatcatgaaggacgggcgagtgttggtcgtgccatgtcgcaatcaagatgaattaattggtagagctcggatcagccagggagccggctggtctctgagggagacggcttgcctcgggaaatcgtatgcccagatgtggtcacttatgtactttcaccgcagagacctgcggctagcagcgaacgccatatgtagcgctgtgccgtcccactgggtccccacaagtaggaccacttggtctatccatgccaagcacgaatggatgacaaccgaggacatgctgactgtttggaatcgagtgtggattcgtgataacccttggatggaggacaagaccccagtagaaagctgggaggaaatcccctatctcggaaaaagagaggatcagtggtgcggctccttgattggtctgacatcacgcgcaacgtgggctaagaatatccaagccgcaataaaccaggtgcggagtcttatggggaatgaagagtacaccgactacatgccttctatgaaaaggttcagacgcgaggaagaggaagccggagtcctgtggtga

SEQ ID NO: 14825 - RNA, 9876 nt, synthetic construct
  misc_feature 1..9876: note = derived and/or modified CDS sequence (opt3) from DENV-2__EU482644__SS-prME
  source 1..9876: mol_type = other RNA
agcgccggaatgatcattatgctgataccaaccgtgatggctttccacctcactactcggaacggggagcctcatatgatcgtcggcattcaggaaaagggtaaatcccttctgtttaagacggaggacggagttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccaattaaagctgaattggttcaagaaagggtcttccattggacagatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacaatataaatttcagcccgagagtccaagcaagttggcctccgctatccagaaagcccaggaagagggcatatgtggtattagatctgtcactaggctcgagaatctgatgtggaagcaaatcacacccgaattaaaccacattctggcagagaatgaagttaaactaaccatcatgactggcgatataaaggggatcatgcaggccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaagacgcgttttgtgactctaagttaatgagcgctgccattaaggataatagggcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatccccaagaacctcgcaggacccgttagtcagcacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaagctcattaccgagtggtgctgtagatcctgcacactgccgcctcttaggtatcgcggagaggacggctgttggtacggtatggaaatacggccattgaaagagaaggaagagaatctggtgaactcattagttacggcggggcacggacaagtggataatttcagtctcggcgtactgggtatggccctttttctggaagagatgttgagaaccagggtcggcactaaacatgctatcctcctggtggcagtgagcttcgtcacactaattaccgggaacatgtcgtttaaggacctgggacgcgttgtggtaatggtgggcgccactatggctgatgacatcgggacaggagtcacctatctcgccctgcttgcagcgttcaaagtgcgacccacgtttgccgctggcttgctgttacggaagctcacttccaaggagctgatgatgaccacaattggtatcgttcttctgtctcagagcaccatacctgaaactgtgctagagctcacagatgccctggcattggggatgatggtcctgaaaatcgtgcgtaatatggaaaagtaccagttagctgttaccattatgacaatcctctgcgtgcccaacgccgtcattctgcagaatgcatggaaagtatcatgtactatccttgccgtggttagtgtgtccccactgttgctcacctctagccaacagaagacggactggatacctctggctctaacaattaaaggactgaaccccaccgcgatcttccttactaccctctccagaacaaataagaaaaggtcatggccactgaacgaggccatcatggcagtcggcatggtgagcattttggctagttctctgttaaagaatgacataccgatgactggccctctcgtagccgggggactgcttaccgtgtgctatgtcctgacgggtcgctccgccgatttggaactcgagcgggctacagacgttaagtgggaggatcaggcagaaatcagcggctcgtcacccattctgtctatcaccattagtgaggacgggtccatgagcatcaaaaacgaagaggaggaacagactctaacaatactgatcagaaccggacttctcgtgatttctggcctgtttccaatcagcattcccatcactgccgcggcttggtacttgtgggaggtgaagaaacaaagggccggtgtcttatgggatgtgccttccccaccccctatggggaaggcagaactggaggacggagcctatcgaataaaacagaagggcattctcggctactcacagatcggggctggagtttacaaggaaggtacattccacaccatgtggcatgtaacgcgcggcgcagtgctgatgcacaaagggaagcggatcgagccgagttgggccgatgtcaaaaaggaccttattagctatggaggcggttggaaactggagggggaatggaaggagggagaagaggtgcaggttttggcgctagaaccaggcaagaatcccagagctgtgcaaactaaacctggcctgtttaagaccaacacagggaccatcggagccgtctctctcgatttctccccaggtacatcaggcagtcccataattgacaaaaaggggaaagtggtaggactgtacggcaacggtgtcgtgactaggagcggggcatatgtttccgccatcgctcagaccgagaagtctattgaggataatcctgaaatcgaggacgatatatttcgtaagcgccggcttacgattatggacttacacccgggagccggcaaaacaaagagatacctgcccgcaatcgtgagggaagctatcaaacgaggcctccggactttgattctggccccaacccgcgtcgtggcggccgagatggaagaggcactcagagggctgcctatcaggtatcagacacccgctattcgggccgagcataccggacgagaaatagttgaccttatgtgtcacgctactttcaccatgagactgttgtcgccagtgcgcgtccctaactacaatctaatcattatggatgaggcacatttcacagaccccgccagcatcgccgctaggggttatatctcaacgcgtgtggaaatgggcgaggcggcagggatttttatgactgccaccccaccgggatcccgggatcctttcccccaaagtaacgctccaataatcgacgaggaaagagagattcccgaaaggtcttggaatagcggccacgagtgggtaacagattttaagggtaaaaccgtgtggttcgttccttccatcaaggccgggaacgacattgcagcctgcctgcgcaagaatggcaagaaggtcatccagctctcacgaaaaacttttgattctgaatacgtgaagacaagaaccaacgactgggatttcgtggtcacgactgacataagcgagatgggcgctaattttaaagcggagcgggtaatcgatccaaggcgctgtatgaagcccgtgattttaacagacggcgaagaacgtgttatcctggccgggcctatgccggtgacccatagttccgcagctcagagacggggaaggattggtcgcaaccccaaaaatgaaaacgaccagtacatctatatgggcgagccccttgaaaatgatgaggactgcgcccactggaaggaggcaaagatgctgctcgataacataaatacccctgaagggattatccccagcatgttcgagccagaacgagagaaagtcgacgccattgatggagaatacagattgcggggcgaggctaggaagacttttgtggacctgatgcgcagaggtgatctccctgtttggctggcctataaagtggcggcagaggggatcaactacgccgacaggcggtggtgtttcgatggcataaagaacaatcaaatccttgaagagaacgtcgaagtggagatttggacaaaagagggagaacgtaagaagctaaaaccccgctggctggacgctcgaatctattctgatccattggccttaaaggagtttaaagagttcgctgcaggcagaaagtcactgaccctcaatctgattacagagatggggaggcttcctactttcatgacgcagaaaacccgggacgccctggataacctcgctgtattgcacacagccgaagcaggaggtcgcgcgtacaatcatgccctgtccgagctaccggagactctggaaaccctccttctgttaacattgctggctaccgtgactggcgggatctttctcttcctgatgagtggaagaggcataggtaagatgacgcttgggatgtgctgcattatcaccgccagcatcctgctctggtatgcacagattcagccccactggatcgctgcctcgataattttggagtttttcctgatcgttttactaattccagaacctgagaagcaaaggacaccccaggacaaccagctgacttacgtcgtgatcgcaatactcaccgtggtcgccgctacaatggcgaatgaaatgggctttcttgagaaaaccaagaaagacctgggattgggctctatcgccactcagcaaccagagtccaacattctggatatcgacctccggcctgcaagcgcttggacactgtacgccgttgccacgaccttcgtgactcccatgcttcgacattcaattgaaaatagttctgtaaacgtgtccctcacagcaatcgctaatcaggccaccgtcctgatggggttgggaaagggttggccgctgagcaaaatggatattggcgtgccattactagcgatcgggtgttattcacaggttaaccctataaccctgacagctgccctccttctgttggtggcacactacgccattatcggacccggcctgcaggctaaggcaactagagaggcccaaaagcgcgcggctgccggtatcatgaaaaatccaacggtcgacgggattaccgtaatagatctcgaccccatcccttatgatccgaagtttgaaaaacagctgggccaggtgatgcttttaattctgtgcgttacacaagtgctcatgatgaggactacctgggcattgtgtgaggccctgacactagctaccggacccatcagtactctgtgggaaggcaacccagggcggttctggaatacgacaattgccgtcagcatggcaaacatctttcgtggatcctacctcgctggcgccggtcttctgttctctataatgaagaataccactaacaccagaagggggacaggaaacatgggcgagactttgggtgagaaatggaaaagccgcctgaatgcgctcggcaaatccgaatttcagatctataagaagtcagggattcaggaggtggaccggaccctggccaaagaaggaatcaagcgaggcgagacagatcaccatgcagtctctagagggagtgctaaattaaggtggttcgtggagcgcaacatggttacgcctgaaggaaaggtggtagaccttggctgcggtagagggggatggtcgtactattgtggcggtctgaaaaatgtgagagaggtcaagggcctcaccaaagggggacccggccacgaggaacctattccaatgagcacttacgggtggaacctagttcgtctgcagtccggagtggatgtctttttcatcccacctgaaaaatgcgacacattgctgtgtgatataggcgagtcttcaccaaatcccaccgtggaggccggtaggactctccgggtacttaacctggtggaaaattggttgaacaataacacacaattctgcattaaggttctgaatccgtacatgcctagcgtgatcgagaaaatggaagcactccagcgcaagtatgggggagctttagtccgaaacccactgtccagaaatagtacccatgagatgtactgggtgtctaacgccagcggcaatatcgtctcatccgtgaacatgattagtaggatgcttataaaccggtttacgatgcgccacaaaaaggccacctatgaacccgacgttgacctgggcagcgggacaagaaatatcggaattgagtctgagatccctaacctagatattatcggtaagaggatagagaaaatcaagcaggagcatgaaacttcctggcactacgaccaggatcacccatataaaacctgggcgtaccatggctcatatgagacaaagcaaactgggagcgcttcgtctatggtaaatggagtggtccgactcctgaccaaaccctgggacgtgttgccgacagttacccagatggcaatgactgatacgacacctttcggccagcagcgggtgtttaaggaaaaggtcgacacccgtactcaagagcccaaagagggtaccaagaaactgatgaagattacagccgaatggctctggaaagagcttgggaagaaaaagacgccaagaatgtgtacccgcgaagagttcactaggaaggtgcggagtaacgctgccctgggagcaatctttacagatgagaataaatggaagtccgccagagaagctgtagaggacagccgcttctgggaattagtggataaagagaggaacctgcacttggaaggcaagtgcgagacctgtgtttacaatatgatgggcaaacgagagaagaagctcggggaatttggaaaagcgaagggttcacgggccatttggtacatgtggctgggcgcaagattcctagagtttgaagctcttgggttcctgaacgaggaccattggttttccagggaaaattctctcagcggagtcgagggcgagggtctgcacaaattggggtatatcctgcgcgatgtgagtaagaaagaaggaggcgccatgtacgcagacgacactgccggctgggatacacgtattaccctcgaggaccttaagaacgaagagatggtgacaaatcacatggaaggggagcataagaaactggctgaggccatattcaagttaacttatcagaacaaagtcgttcgggtgcagagacctacccccaggggaacggtaatggatatcatttcccgccgagaccaacggggtagcggccaggtggggacctacggactgaatacatttactaacatggaagcgcagttgatcagacagatggagggcgaaggtgtcttcaagaatatccaacacctcaccgtgacagaggaggttgcagtgcagaactggctggccagggtcgggcgcgaaagactatctcggatggctatttcaggagatgactgcgtggtaaaaccacttgatgacaggttcgccaacgcactgactgctctcaatgatatgggcaagatacgtaaggacatccagcagtgggagcccagtaaaggctggaacgattggacccaagttcctttttgctcccatcacttccatgaactgattatgaaggacgggcgagtgttggtcgtgccatgtcgcaatcaggatgagttaatcggtagagcccggattagccagggagctggctggtctctgagggaaacggcctgcctcgggaaatcgtatgcacagatgtggtcacttatgtactttcaccgcagagacctgcggctagcggccaacgctatctgtagcgccgtgccgtcccactgggtccccacaagtaggaccacttggtctatacatgcaaagcacgagtggatgacaaccgaggacatgctgactgtttggaatcgagtgtggatccgtgaaaacccttggatggaggataaaaccccagtagaaagctgggaggaaattccctatctcggaaagagagaggaccaatggtgcggctccttgatcggtctgacatcacgcgctacgtgggccaagaatattcaggcagccatcaaccaggtgcggagtcttatagggaatgaggaatacaccgattacatgccttctatgaaaaggttcagacgcgaggaagaggaagcgggagtcctgtggtga

SEQ ID NO: 14826 - RNA, 9876 nt, synthetic construct
  misc_feature 1..9876: note = derived and/or modified CDS sequence (opt3) from DENV-2__EU482645__SS-prME
  source 1..9876: mol_type = other RNA
agcgccggcatgatcattatgctgatacccaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagaaggtgctcattttcatcctgctgactgctgttgcaccatctatgacaatgcggtgcatagggatttcgaaccgcgattttgtggaaggagtctcaggtggcagctgggtggacatcgtactcgagcacgggagttgtgttaccactatggccaagaataaacccacattagatttcgaactgattaagaccgaggctaaacagcctgccacgcttagaaagtattgcatcgaagcgaaattgaccaacacaactaccgagtccaggtgtccaacacaaggagagccctctctgaaggaagaacaggacaagcggtttgtgtgcaaacatagcatggtcgatcgcggctggggtaatgggtgtggactattcggcaagggcgggatcgtgacttgcgcaatgtttacctgcaaaaagaacatggaaggaaaaattgtgcagcctgagaatctcgaatacacaatagtcgttaccccacactccggtgaggagcatgccgtgggcaacgacactgggaagcacggacaggaaatcaaagtaacgccgcaatcaagtattacagaggctgaactgaccggctatggtactgtgaccatggagtgtagcccccgaacagggcttgatttcaatgaaatggtcctgttgcagatggagaacaaggcctggctcgtgcacagacagtggtttctggacttacctctgccatggctccccggcgcagataagcaggagtctaattggatccaaaaagaaacccttgttactttcaagaaccctcatgctaaaaagcaggacgtggtcgtgctgggatcccaggagggcgccatgcacacagcgttgacgggggccaccgaaatacaaatgtcaagcggaaatctactgtttactggtcatctcaaatgcaggctgcggatggacaaacttcagctgaagggcatgagttactctatgtgtacagggaaattcaaggtagttaaagagattgcagagacccagcacggaacaatcgtgatccgtgtccagtatgaaggcgatggttccccatgcaagattcccttcgagatcatggacttggaaaaacgctacgtgctcgggagactgattactgtcaacccgatagtgaccgagaaggatagccctgttaacatcgaagctgagcccccatttggcgactcgtacattatcatcggagtggagcctggccaattaaagctgaattggttcaaaaaggggtcttccattggacagatgtttgaaacgaccatgaggggtgccaaacggatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgaagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacaatataagtttcagcccgagagtccaagcaaattggcctccgctatccagaaggcccaggaagagggcatatgtggtattcgctctgtcactagactcgagaatctgatgtggaaacaaatcacacccgaattaaaccacattctggcagagaatgaagttaagctaaccatcatgactggcgatataaaagggatcatgcaggccggaaagaggtcgctccggcctcagccaaccgagctgaagtacagctggaaaacatggggcaaggctaaaatgctttccacggaatcatataaccagaccttcttgattgacgggccggagactgccgagtgccccaatacaaaccgcgcatggaatagtctggaagtggaggattacggatttggcgtgttcaccacaaacatctggctcaagctgaaagaaaagcaagacgcgttttgtgactctaagttaatgagcgctgccattaaagataatagagcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcagcacaattacaggcctggctaccacacgcagattgctggtccatggcatctgggcaagctagagatggacttcgatttttgtgacgggacaaccgtgatcgtcactgaagattgcggaaaccgtggccccagcctgcggaccacaactgcctctgggaaactcattaccgagtggtgctgtcgatcctgcacactgccgcctcttagatataggggagaggacggctgttggtacggtatggaaatacgcccattgaaggagaaagaagagaatctggtgaactcattagttacggcggggcacggacaagtggataatttcagtctcggcgtactgggtatggccctttttctggaagagatgttgcggaccagagtcggcactaagcatgctatcctcctggtggcagtgagcttcgtcacactaattaccgggaacatgtcgtttaaagacctgggaagggttgtggtaatggtgggcgccactatggctgatgacatcgggacaggagtcacctatctcgccctgcttgcagcgttcaaggtgcgccccacgtttgccgctggcttgctgttacgaaagctcacttccaaagagctgatgatgaccacaattggtatcgttcttctgtctcagagcaccatacctgaaactgtgctagagctcacagatgccctggcattggggatgatggtcctgaagatcgtgcggaatatggaaaaataccagttagctgttaccattatgacaatcctctgcgtgcccaacgccgtcattctgcagaatgcatggaaggtatcatgtactatccttgccgtggttagtgtgtccccactgttgctcacctctagccaacagaaaacggactggatacctctggctctaacaattaagggactgaaccccaccgcgatcttccttactaccctctcccgtacaaataaaaagagatcatggccactgaacgaggccatcatggcagtcggcatggtgagcattttggctagttctctgttaaagaatgacataccgatgactggccctctcgtagccgggggactgcttaccgtgtgctatgtcctgacgggtaggtccgccgatttggaactcgagcgcgctacagacgttaaatgggaggatcaggcagaaatcagcggctcgtcacccattctgtctatcaccattagtgaggacgggtccatgagcatcaagaacgaagaggaggaacagactctaacaatactgatccggaccggacttctcgtgatttctggcctgtttccaatcagcattcccatcactgccgcggcttggtacttgtgggaggtgaaaaagcaaagagccggtgtcttatgggatgtgccttccccaccccctatggggaaagcagaactggaggacggagcctataggataaagcagaagggcattctcggctactcacagatcggggctggagtttacaaagaaggtacattccacaccatgtggcatgtaacgcgaggcgcagtgctgatgcacaaggggaaacgcatcgagccgagttgggccgatgtcaagaaagaccttattagctatggaggcggttggaagctggagggggaatggaaggagggagaagaggtgcaggttttggcgctagaaccaggcaaaaatccccgggctgtgcaaactaagcctggcctgtttaaaaccaacacagggaccatcggagccgtctctctcgatttctccccaggtacatcaggcagtcccataattgacaagaaagggaaggtggtaggactgtacggcaacggtgtcgtgactagaagcggggcatatgtttccgccatcgctcagaccgagaagtctattgaggataatcctgaaatcgaggacgatatatttaggaaacgtcgccttacgattatggacttacacccgggagccggcaagacaaaacggtacctgcccgcaatcgtgagagaagctatcaagaggggcctccgaactttgattctggccccaacccgggtcgtggcggccgagatggaagaggcactccgcgggctgcctatcagatatcagacacccgctattagggccgagcataccggacgggaaatagttgaccttatgtgtcacgctactttcaccatgcgactgttgtcgccagtgagagtccctaactacaatctaatcattatggatgaggcacatttcacagaccccgccagcatcgccgctcgcggttatatctcaacgagggtggaaatgggcgaggcggcagggatttttatgactgccaccccaccgggatcccgtgatcctttcccccaaagtaacgctccaataatcgacgaggaacgggagattcccgaaagatcttggaatagcggccacgagtgggtaacagattttaaaggtaagaccgtgtggttcgttccttccatcaaggccgggaacgacattgcagcctgcctgaggaaaaatggaaagaaagtcatccagctctcacgcaagacttttgattctgaatacgtgaaaacacgaaccaacgactgggatttcgtggtcacgactgacataagcgagatgggcgctaattttaaggcggagagagtaatcgatccacggaggtgtatgaaacccgtgattttaacagacggcgaggaacgcgttatcctggccgggcctatgccggtgacccatagttccgcagctcagcgtagaggacggattggtaggaacccaaagaatgaaaacgaccagtacatctatatgggcgagccccttgaaaatgatgaggactgcgcccactggaaggaggcaaaaatgctgctcgataacataaatacccctgaagggattatccccagcatgttcgagccagaacgcgagaaggtcgacgccattgatggagaataccgattgagaggcgaggctcggaaaacttttgtggacctgatgaggcgcggtgatctccctgtttggctggcctataaggtggcggcagaggggatcaactacgccgacagaaggtggtgtttcgatggcatcaagaacaatcaaatccttgaagagaacgtcgaagtggagatttggacaaaggagggagaacggaagaaactaaagccccgttggctggacgctcgcatctattctgatccattggccttaaaagagtttaaggagttcgctgcaggccgaaaatcactgaccctcaatctgattacagagatggggagacttcctactttcatgacgcagaagaccagggacgccctggataacctcgctgtattgcacacagccgaagcaggaggtcgggcgtacaatcatgccctgtccgagctaccggagactctggaaaccctccttctgttaacattgctggctaccgtgactggcgggatctttctcttcctgatgagtggacgcggcataggtaagatgacgcttgggatgtgctgcattatcaccgccagcatcctgctctggtatgcacagattcagccccactggatcgctgcctcgataattttggagtttttcctgatcgttttactaattccagaacctgagaaacaaagaacaccccaggacaaccagctgacttacgtcgtgatcgcaatactcaccgtggtcgccgctacaatggcgaatgaaatgggctttcttgagaagaccaaaaaggacctgggattgggctctatcgccactcagcaaccagagtccaacattctggatatcgacctcaggcctgcaagcgcttggacactgtacgccgttgccacgaccttcgtgactcccatgcttcggcattcaattgaaaatagttctgtaaacgtgtccctcacagcaatcgctaatcaggccaccgtcctgatggggttgggaaaaggttggccgctgagcaagatggatattggcgtgccattactagcgatcgggtgttattcacaggttaaccctataaccctgacagctgccctccttctgttggtggcacactacgccattatcggacccggcctgcaggctaaggcaactcgagaggcccagaaaagagcggctgccggtatcatgaagaatccaacggtcgacgggattaccgtaatagatctcgaccccatcccttatgatccgaaatttgaaaagcagctgggccaggtgatgcttttaattctgtgcgttacacaagtgctcatgatgcgcactacctgggcattgtgtgaggccctgacactagctaccggacccatcagtactctgtgggaaggcaacccagggaggttctggaatacgacaattgccgtcagcatggcaaacatctttcggggatcctacctcgctggcgccggtcttctgttctctataatgaaaaataccactaacacccgtagagggacaggaaacatgggcgagactttgggtgagaagtggaaaagcaggctgaatgcgctcggcaagtccgaatttcagatctataagaaatcagggattcaggaggtggaccgcaccctggccaaggaaggaatcaaacggggcgagacagatcaccatgcagtctctcgagggagtgctaagttaagatggttcgtggagaggaacatggttacgcctgaaggaaaagtggtagaccttggctgcggtcgcgggggatggtcgtactattgtggcggtctgaagaatgtgcgggaggtcaagggcctcaccaaagggggacccggccacgaggaacctattccaatgagcacttacgggtggaacctagttagactgcagtccggagtggatgtctttttcataccccctgaaaagtgcgacacattgctgtgtgatataggcgagtcttcaccaaatcccaccgtggaggccggtcgtactctcagggtacttaacctggtggaaaattggttgaacaataacacacaattctgcattaaagttctgaatccgtacatgcctagcgtgatcgagaagatggaagcactccagcggaaatatgggggagctttagtccgcaacccactgtcccgaaatagtacccatgagatgtactgggtgtctaacgccagcggcaatatcgtctcatccgtgaacatgattagtagaatgcttataaacaggtttacgatgcggcacaagaaggccacctatgaacccgacgttgacctgggcagcgggacacgcaatatcggaattgagtctgagatccctaacctagatattatcggtaaaagaatagaaaagatcaaacaggagcatgaaacttcctggcactacgaccaggatcacccatataagacctgggcgtaccatggctcatatgagacaaaacaaactgggagcgcttcgtctatggtaaatggagtggtcaggctcctgaccaagccctgggacgtgttgccgacagttacccagatggcaatgactgatacgacacctttcggccagcagcgagtgtttaaggaaaaagtcgacacccggactcaagagcccaaggagggtaccaaaaagctgatgaaaattacagccgaatggctctggaaggagcttgggaaaaagaagacgccacgtatgtgtaccagagaagagttcactcgcaaagtgaggagtaacgctgccctgggagcaatctttacagatgagaataagtggaaatccgcccgggaagctgtagaggacagcagattctgggaattagtggataaggagcgcaacctgcacttggaaggcaaatgcgagacctgtgtttacaatatgatgggcaagagggagaagaaactcggggaatttggaaaggcgaaaggttcacgagccatttggtacatgtggctgggcgcacggttcctagagtttgaagctcttgggttcctgaacgaggaccattggttttccagagaaaattctctcagcggagtcgagggcgagggtctgcacaagttggggtatatcctgagggatgtgagtaaaaaggaaggaggcgccatgtacgcagacgacactgccggctgggatacacgcattaccctcgaggaccttaagaacgaagagatggtgacaaatcacatggaaggggagcataaaaagctggctgaggccatattcaaattaacttatcagaacaaggtcgttcgtgtgcagcggcctacccccagaggaacggtaatggatatcatttccaggcgcgaccaacgaggtagcggccaggtggggacctacggactgaatacatttactaacatggaagcgcagttgatccggcagatggagggcgaaggtgtcttcaaaaatatccaacacctcaccgtgacagaggaggttgcagtgcagaactggctggccagagtcgggagggaacgcctatctagaatggctatttcaggagatgactgcgtggtaaagccacttgatgaccggttcgccaacgcactgactgctctcaatgatatgggcaagataaggaaagacatccagcagtgggagcccagtaagggctggaacgattggacccaagttcctttttgctcccatcacttccatgaactgattatgaaagacgggcgtgtgttggtcgtgccatgtcgaaatcaggatgagttaatcggacgcgccagaattagccagggtgctggctggtctctgcgggaaacggcctgcctcgggaagtcgtatgcacagatgtggtcacttatgtactttcacaggcgcgacctgagactagcggccaacgctatctgtagcgccgtgccgtcccactgggtccccacaagtcggaccacttggtctatacatgcaaaacacgagtggatgacaaccgaggacatgctgactgtttggaatagggtgtggatccgagaaaacccttggatggaggataagaccccagtagaaagctgggaggaaattccctatctcggaaagcgtgaggaccaatggtgcggctccttgatcggtctgacatcaagagctacgtgggccaaaaatattcaggcagccatcaaccaggtgcgcagtcttatagggaatgaggaatacaccgattacatgccttctatgaagcggttcaggagagaggaagaggaagcgggagtcctgtggtga

SEQ ID NO: 14827 - RNA, 9876 nt, synthetic construct
  misc_feature 1..9876: note = derived and/or modified CDS sequence (opt3) from DENV-2__EU482646__SS-prME
  source 1..9876: mol_type = other RNA
agcgcaggcatgatcattatgctgatccccaccgtgatggctttccacctcaccactagaaacggggagcctcatatgatcgtcggtattcaagaaaagggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttatctgcaagcatagcatggtggatcgaggctggggtaatgggtgtggactattcggcaaaggcgggattgtcacttgcgcaatgtttacctgcaagaaaaacatggaaggaaagatagtgcagcctgagaatctcgaatacacaatcgtggtcaccccacactccggtgaggagcatgccgttggcaacgacactgggaaacacggaaaggaaattaaagtgacgccgcagtcaagtatcacagaggctgaactgaccggctatggtactgtaaccatggagtgtagccccagaacagggcttgatttcaatgaaatggtgctgttgcaaatggagaacaaggcctggctcgtccacaggcagtggtttctggacttacctctgccatggctccccggcgcagataagcaggagtctaattggatacagaaagaaacccttgtgactttcaagaaccctcatgctaaaaagcaagacgttgtggtcctgggatcccaggagggcgccatgcacacagcgttgacgggggccaccgaaattcagatgtcaagcggaaatctactgtttactggtcatctcaaatgccggctgcgtatggacaaacttcaactgaagggcatgagttactctatgtgtacagggaaattcaaggtggtaaaagagatcgcagagacccagcacggaacaatcgttattcgcgtgcagtatgaaggcgatggttccccatgcaagatccccttcgagattatggacttggagaagagatacgtcctcgggaggctgataactgtgaacccgatcgtcaccgagaaggatagccctgtgaacattgaagctgagcccccatttggcgactcgtacatcatcattggagttgagcctggccagttaaagctgaattggttcaaaaaggggtcttccataggacaaatgtttgaaacgaccatgcggggtgccaaacgaatggctatcctaggcgatacagcctgggacttcgggtcactcggaggcgtgtttacaagtattggtaaggcactgcatcaggtattcggggccatctatggcgctgcgtttagcggagtctcctggaccatgaaaattcttatcggcgtgataatcacatggattgggatgaactctcgcagcacttcattgagtgtttccctggtgctcgtcggaatcgtgaccctgtaccttggcgtaatggtgcaggcagatagcggttgtgttgtctcttggaagaataaggagctgaaatgcgggtcaggaattttcatcacggacaacgtgcacacatggaccgaacagtataagtttcaacccgagagtccaagcaaattggcctccgctatacagaaggcccaggaagagggcatttgtggtatcagatctgtgactaggctcgagaatctgatgtggaaacagattacacccgaattaaaccacatcctggcagagaatgaagtcaagctaaccataatgactggcgatatcaaagggattatgcaagccggaaagcggtcgctccgccctcagccaaccgagctgaagtacagctggaaaacatggggcaaggctaaaatgctttccacggaatcatataaccagaccttcttgatcgacgggccggagactgccgagtgccccaatacaaacagagcatggaatagtctggaagttgaggattacggatttggcgtgttcaccacaaacatttggctcaagctgaaagaaaagcaggacgcgttttgtgactctaagttaatgagcgctgccatcaaagataatagggcagtgcatgccgacatgggttattggatagagtccgctctgaacgatacttggaagattgagaaagcctcattcatcgaagtaaagaattgccactggcctaaaagccataccctttggtctaacggggtcttggagtccgaaatgatcattccaaagaacctcgcaggacccgtgagtcaacacaattaccgtcctggctaccacacgcagatcgctggtccatggcatctgggcaagctagagatggacttcgatttttgtgacgggacaaccgttattgtgactgaagattgcggaaaccggggccccagcctgcgaaccacaactgcctctgggaaactcataaccgagtggtgctgtagatcctgcacactgccgcctcttaggtatcgcggagaggacggctgttggtacggtatggaaatccggccattgaaggagaaagaagagaatctggtcaactcattagtgacggcggggcacggacaggttgataatttcagtctcggcgtgctgggtatggccctttttctggaagagatgttgagaaccagggtaggcactaagcatgctattctcctggtcgcagtgagcttcgtgacactaatcaccgggaacatgtcgtttaaagacctgggacgcgtcgttgtgatggtaggcgccactatggctgatgacattgggatgggagtgacatatctcgccctgcttgcagcgttcaaggtccgacccacctttgccgctggcttgctgttacggaagctcacgtccaaagagctgatgatgactaccatcggtatagtgcttctgtctcaaagcacaatccctgaaaccgttctagagctcactgatgccctggcattggggatgatggtgctgaagattgtccgtaatatggaaaaataccagttagctgtgacaatcatggccattctctgcgttcccaacgcagtgatcctgcagaatgcctggaaggtctcatgtaccatacttgctgtagtgagtgtttccccactgttgctcacatctagccagcagaagactgactggattcctctggcgctaaccatcaagggactgaaccccacggccatcttccttacaaccctctccagaactaataaaaagaggtcatggccactgaacgaggcaattatggctgtgggcatggtcagcatattggccagttctctgttaaagaatgacatcccgatgaccggccctctcgtggccgggggactgcttacagtatgctatgtgctgactggtcgctccgctgatttggaactcgagcgggcaaccgacgtcaaatgggaggatcaggccgaaattagcggctcgtcacccatcctgtctattacgatcagtgaggacgggtccatgagcataaagaacgaagaggaggaacagacactaaccatcctgattagaactggacttctcgttatctctggcctgtttccaattagcatccccataacagcggctgcctggtacttgtgggaggtgaaaaagcagagggccggtgtgttatgggatgtcccttccccaccccctatggggaaagccgaactggaggacggagcttatcgaattaagcaaaagggcatcctcggctactcacagatcggggcaggagtgtacaaagaaggtaccttccacactatgtggcatgttacacgcggcgccgtactgatgcacaaggggaaacggattgagccgagttgggcggatgtgaagaaagaccttatcagctatggaggcggttggaagctggagggggaatggaaggagggagaagaggtccaggtgttggctctagaaccaggcaaaaatcccagagccgttcagaccaagcctggcctgtttaaaacgaacactgggaccataggagcagtgtctctcgatttctccccaggtacatcaggcagtcccattatcgacaagaaagggaaggtcgtgggactgtacggcaacggtgtagtcaccaggagcggggcctatgtgtccgctattgcccaaacagagaagtctatcgaggataatcctgaaatagaggacgatatttttcgtaaacgccggcttactatcatggacttacacccgggagcaggcaagaccaaaagatacctgcccgctatcgttagggaagccattaagcgaggcctccggacgttgatcctggcgccaacacgcgtggtcgccgcagagatggaagaggctctcagagggctgcctattaggtatcagactcccgccatacgggctgagcataccggacgagaaatcgtggaccttatgtgtcacgcaacattcaccatgagactgttgtcgccagttcgcgtgcctaactacaatctaattatcatggatgaggcccatttcactgaccccgccagcatcgctgcgaggggttatatttcaacccgtgtcgaaatgggcgaggcagccgggatatttatgacagctacgccaccgggatcccgggatcctttcccccagagtaacgccccaatcattgacgaggaaagagagatccccgaaaggtcttggaatagcggccacgagtgggtgactgattttaaaggtaagaccgtatggttcgtgccttccattaaggcagggaacgacatcgccgcttgcctgcgcaaaaatggaaagaaagttatacaactctcacgaaagacatttgattctgaatacgtcaaaaccagaactaacgactgggatttcgtggtgacaaccgacatcagcgagatgggcgcgaattttaaggccgagcgggtcattgatccaaggcgctgtatgaaacccgtaatcttaacggacggcgaagaacgtgtgattctggcagggcctatgccggttactcatagttccgctgcccagagacggggaaggatcggtcgcaacccaaagaatgaaaacgaccagtacatatatatgggcgagccccttgaaaatgatgaggactgcgcacactggaaggaggccaaaatgctgctcgataacattaatacacctgaagggatcattcccagcatgttcgagccagaacgagagaaggtggacgctatcgatggagaatacagattgcggggcgaggccaggaaaacctttgtcgacctgatgcgcagaggtgatctccctgtgtggctggcgtataaggttgcagccgaggggataaactacgctgacaggcggtggtgtttcgatggcatcaaaaacaatcagattcttgaagagaacgtggaagtcgagatctggaccaaggagggagaacgtaagaaactaaagccccgctggctggacgcccgaatttattctgatccattggctttaaaagagtttaaggagttcgcagccggcagaaaatcactgactctcaatctgatcacagagatggggaggcttcctaccttcatgacacaaaagactcgggacgctctggataacctcgccgtgttgcacacggcagaagcgggaggtcgcgcctacaatcatgctctgtccgagctaccggagaccctggaaacactccttctgttaactttgctggccaccgtaacaggcgggatatttctcttcctgatgagtggaagaggcattggtaagatgacccttgggatgtgctgcatcactacggcaagcatcctgctctggtatgctcagattcagccccactggatcgccgcatcgataattttggagtttttcctgatcgtgttactaattccagaacctgagaaacagaggacaccccaagacaaccagctgacatacgttgtcatcgccatactcactgtggtggctgcgaccatggccaatgaaatgggctttcttgagaagactaaaaaggacctgggattgggctctatcgcaacccagcagccagagtccaacattctggatatcgacctccggcctgctagcgcctggactctgtacgccgtcgcaacaacgttcgttacccccatgcttcgacattcaattgaaaatagttctgtgaacgtatccctcactgctatcgccaatcaagcgacagtgctgatggggttgggaaaaggttggccgctgagcaagatggatattggcgtcccattactagctatcgggtgttattcacaggtgaaccctataaccctgaccgccgcactccttctgttggttgcccactacgctattatcggacccggcctgcaggcaaaggccacaagagaggcgcagaaacgcgctgccgcaggtatcatgaagaatccaactgtggacgggattacggtcatagatctcgaccccatcccttatgatccgaaatttgaaaagcaactgggccaggtaatgcttttaattctgtgcgtgacccaggttctcatgatgaggacaacttgggccttgtgtgaggctctgaccctagccacaggacccatcagtaccctgtgggaaggcaacccagggcggttctggaatactacgattgcagtgagcatggctaacatctttcgtggatcctacctcgccggcgcgggtcttctgttctctataatgaaaaatacaaccaacactagaagggggaccggaaacatgggcgagacattgggtgagaagtggaaaagccgcctgaatgccctcggcaagtccgaatttcaaatctataagcggtcagggattcaggaggtcgaccgaactctggcaaaagaaggaatcaagagaggcgagaccgatcaccatgctgtgtctagggggagtgccaaattacgctggttcgtcgagcggaacatggtgacacctgaaggaaaggttgtggaccttggctgcggtagagggggatggtcgtactattgtggcggtctgaaaaatgtacgtgaggtgaagggcctcacgaaagggggacccggccacgaagaacctattccaatgagcacctacgggtggaacctagtcaggctgcagtccggagttgatgtgtttttcataccccctgaaaaatgcgacactttgctgtgtgatataggcgagtcttcaccaaatcccacagtcgaggcaggtcggaccctccgcgtgcttaacctggtagaaaattggttgaacaataacactcagttctgcattaaggtgctgaatccgtacatgcctagcgttatcgagaaaatggaagctctccaacgaaagtatgggggagccttagtgagaaacccactgtccaggaatagtacacatgagatgtactgggtctctaacgccagcggcaatatcgtgtcatccgtcaacatgattagtcggatgcttataaaccgctttaccatgagacacaaaaaggcgacgtatgaacccgacgtggacctgggcagcgggaccaggaatatcggaattgagtctgagatccctaacctagatattatcggtaagcgaatagagaaaatcaagcaggagcatgaaacatcctggcactacgaccaggatcacccatataaaacttgggcttaccatggctcatatgagaccaagcagacagggagcgcatcgtctatggttaatggagtagtgcggctcctgactaaaccctgggacgtcttgccgaccgtgacacaaatggccatgaccgatactacgcctttcggccagcagcgtgtttttaaggaaaaggtggacacaagaacccaggagcccaaagagggtactaagaaactgatgaagattaccgctgaatggctctggaaagagcttgggaagaaaaagacaccacgcatgtgtacgagggaagagttcacccggaaggtcagaagtaacgccgcactgggagccatctttactgatgagaataaatggaagtccgctcgcgaagcggtggaggacagcaggttctgggaattagtagataaagagcgaaacctgcacttggaaggcaagtgcgagacatgtgtgtacaatatgatgggcaaacgggagaagaagctcggggaatttggaaaagccaagggttcaagagcaatttggtacatgtggctgggcgctaggttcctagagtttgaagcccttgggttcctgaacgaggaccattggttttcccgcgaaaattctctcagcggagttgagggcgagggtctgcacaaattggggtatatcctgcgtgatgtcagtaagaaagaaggaggcgcaatgtacgccgacgacaccgctggctgggatactcggattacactcgaggaccttaagaacgaagagatggtgaccaatcacatggaaggggagcataagaaactggccgaggcgatattcaagttaacatatcaaaacaaagtggtcagagttcagaggcctactccccgcggaaccgtgatggatatcatttcccgacgggaccagagaggtagcggccaagtagggacgtacggactgaatacctttacaaacatggaagcacagttgatcaggcagatggagggcgaaggtgtgttcaagaatatccagcacctcactgtcaccgaggaggtggccgttcaaaactggctggctcgcgtggggagagaacggctatctaggatggccatttcaggagatgactgcgtcgtgaaaccacttgatgaccgtttcgcaaacgctctgacagccctcaatgatatgggcaagatacgaaaggacatccagcagtgggagcccagtaaaggctggaacgattggactcaggtacctttttgctcccatcacttccatgaactgattatgaaggacgggcgcgttttggtggtcccatgtagaaatcaagatgagttaatcggacgggctaggattagccagggtgccggctggtctctgcgcgaaaccgcatgcctcgggaaatcgtatgcgcagatgtggtcacttatgtactttcacagacgggacctgaggctagccgctaacgccatctgtagcgcagtgccgtcccactgggtgcccacgagtcgaacaacctggtctatacatgctaagcacgagtggatgactacagaggacatgctgaccgtctggaatcgtgtttggatcagagaaaacccttggatggaggataaaactccagtggaaagctgggaggaaattccctatctcggaaagcgcgaggaccagtggtgcggctccttgatcggtctgacctcacgggccacatgggcaaagaatattcaagccgcgatcaaccaggtaaggagtcttatagggaatgaggaatacacggattacatgccttctatgaaaagattccgccgggaggaagaggaagctggagtgctgtggtga

SEQ ID NO: 14828 - RNA, 9876 nt, synthetic construct
  misc_feature 1..9876: note = derived and/or modified CDS sequence (opt3) from DENV-2__EU482647__SS-prME
  source 1..9876: mol_type = other RNA
agcgcaggaatgatcattatgctgatccccaccgtgatggctttccacctcactactcggaacggggaacctcatatgatcgtcggcattcaggaaaagggtaaatcccttctgtttaagacggaggacggagttaatatgtgcaccttgatggcaatggatttaggggaactgtgtgaggacacgatcacttacaaatgcccattactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatgaagaacaaggcctggctcgtgcacaggcagtggtttctggacttacctctgccatggctccccggcgcagataaacaggagtctaattggatccagaaggagacccttgttactttcaaaaaccctcatgctaagaaacaagacgtggtcgtgctgggatcccaggaaggcgccatgcacacagcgttgacgggggccaccgagatacagatgtcaagcggaaatctactgtttactggtcatctcaagtgccggctgcgtatggacaaacttcaactgaaaggcatgagttactctatgtgtacagggaagttcaaagtagttaaggaaattgcagagacccagcacggaacaatcgtgatccgcgtccagtatgagggcgatggttccccatgcaaaattcccttcgaaatcatggacttggagaagagatacgtgctcgggaggctgattactgtcaacccgatagtgaccgaaaaggatagccctgttaacatcgaggctgaacccccatttggcgactcgtacattatcatcggagtggagcctggccagttaaaactgaattggttcaagaaagggtcttccattggacaaatgtttgagacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaagaactgaagtgcgggtcaggaatcttcattacggacaacgtgcacacatggaccgagcagtataaatttcaacccgaaagtccaagcaagttggcctccgctatccagaaagcccaggaggaaggcatatgtggtattagatctgtcactaggctcgagaatctgatgtggaagcagatcacacccgagttaaaccacattctggcagaaaatgaggttaaactaaccatcatgactggcgatataaaggggatcatgcaagccggaaagcggtcgctccgccctcagccaaccgaactgaaatacagctggaagacatggggcaaagctaagatgctttccacggagtcatataaccagaccttcttgattgacgggccggaaactgccgagtgccccaatacaaacagagcatggaatagtctggaggtggaagattacggatttggcgtgttcaccacaaacatctggctcaaactgaaggagaagcaggacgcgttttgtgactctaaattaatgagcgctgccattaaggataatagggcagtacatgccgacatgggttattggatcgaatccgctctgaacgatacttggaaaatagagaaggcctcattcattgaggtcaaaaattgccactggcctaagagccataccctttggtctaacggggtgttggaatccgagatgatcatcccaaagaacctcgcaggacccgttagtcaacacaattaccgtcctggctaccacacgcagattgctggtccatggcatctgggcaaactagaaatggacttcgatttttgtgacgggacaaccgtgatcgtcactgaggattgcggaaaccggggccccagcctgcgaaccacaactgcctctgggaagctcattaccgaatggtgctgtagatcctgcacactgccgcctcttaggtatcgcggagaggacggctgttggtacggtatggagatacggccattgaaagaaaaggaggaaaatctggtgaactcattagttacggcggggcacggacaggtggataatttcagtctcggcgtactgggtatggccctttttctggaggaaatgttgagaaccagggtcggcactaaacatgctatcctcctggtggcagtgagcttcgtcacactaattaccgggaacatgtcgtttaaggacctgggacgcgttgtggtaatggtgggcgccactatggctgatgacatcgggatgggagtcacatatctcgccctgcttgcagcgttcaaggtgcgacccacctttgccgctggcttgctgttacggaaactcacgtccaaggagctgatgatgactaccattggtatcgttcttctgtctcaaagcacaatacctgagaccgtgctagaactcactgatgccctggcattggggatgatggtcctgaaaatcgtgcgtaatatggagaagtaccagttagctgttacaattatggccatcctctgcgtgcccaacgcagtcattctgcagaatgcctggaaagtatcatgtaccatccttgctgtggttagtgtgtccccactgttgctcacatctagccagcaaaagactgactggatacctctggcgctaaccattaaaggactgaaccccacggccatcttccttacaaccctctccagaactaataagaagaggtcatggccactgaacgaagcaatcatggctgtcggcatggtgagcattttggccagttctctgctaaagaatgacataccgatgaccggccctctcgtagccgggggactgcttacagtgtgctatgtcctgactggtcgctccgctgatttggagctcgaacgggcaaccgacgttaagtgggaggatcaggccgagatcagcggctcgtcacccattctgtctatcacgattagtgaagacgggtccatgagcatcaaaaacgaggaagaggagcagacactaaccatactgatcagaactggacttctcgtgatttctggcctgtttccaatcagcattcccatcacagcggctgcctggtacttgtgggaagtgaagaaacagagggccggtgtcttatgggatgtgccttccccaccccctatggggaaggccgagctggaagacggagcttatcgaataaagcaaaaaggcattctcggctactcacagatcggggcaggagtttacaaggagggtaccttccacactatgtggcatgtaacacgcggcgccgtgctgatgcacaaagggaagcggatcgaaccgagttgggcggatgtcaaaaaggaccttattagctatggaggcggttggaagctggagggggagtggaaagaaggagaggaagtgcaggttttggctctagagccaggcaagaatcccagagccgtgcagaccaaacctggcctgtttaagacgaacactgggaccatcggagcagtctctctcgatttctccccaggtacatcaggcagtcccataattgacaaaaaggggaaggtggtaggactgtacggcaacggtgtcgtgaccaggagcggggcctatgtttccgctatcgcccaaacagaaaaatctattgaggataatcctgagatcgaagacgatatatttcgtaagcgccggcttactattatggacttacacccgggagcaggcaaaaccaagagatacctgcccgctatcgtgagggaggccatcaaacgaggcctccggacgttgattctggcgccaacacgcgtcgtggccgcagaaatggaggaagctctcagagggctgcctatcaggtatcagactcccgccattcgggctgagcataccggacgagagatagttgaccttatgtgtcacgcaacattcaccatgagactgttgtcgccagtgcgcgtccctaactacaatctaatcattatggatgaagcccatttcactgaccccgccagcatcgctgcgaggggttatatctcaacccgtgtggagatgggcgaagcagccgggatttttatgacagctacgccaccgggatcccgggatcctttcccccagagtaacgccccaataatcgacgaggagagagaaattcccgagaggtcttggaatagcggccacgaatgggtaactgattttaagggtaagaccgtgtggttcgttccttccatcaaagcagggaacgacattgccgcttgcctgcgcaagaatggcaagaaggtcatccaactctcacgaaaaacatttgattctgagtacgtgaagaccagaactaacgactgggatttcgtggtcacaaccgacataagcgaaatgggcgcgaattttaaagccgagcgggtaatcgatccaaggcgctgtatgaagcccgtgattttaacggacggcgaggaacgtgttatcctggcagggcctatgccggtgactcatagttccgctgcccagagacggggaaggattggtcgcaacccaaagaatgagaacgaccagtacatctatatgggcgaaccccttgagaatgatgaagactgcgcacactggaaagaggccaagatgctgctcgataacataaatacacctgaggggattatccccagcatgttcgaaccagagcgagaaaaagtcgacgctattgatggagagtacagattgcggggcgaagccaggaagacctttgtggacctgatgcgcagaggtgatctccctgtttggctggcgtataaagtggcagccgaggggatcaactacgctgacaggcggtggtgtttcgatggcataaagaacaatcagatccttgaggaaaacgtcgaggtggaaatttggaccaaggagggagagcgtaaaaagctaaaaccccgctggctggacgcccgaatctattctgatccattggctttaaaggaatttaaagagttcgcagccggcagaaagtcactgactctcaatctgattacagaaatggggaggcttcctaccttcatgacacaaaagactcgggacgctctggataacctcgccgtattgcacacggcagaggcgggaggtcgcgcctacaatcatgctctgtccgaactaccggagaccctggagacactccttctgttaactttgctggccaccgtgacaggcgggatctttctcttcctgatgagtggaagaggcataggtaaaatgacccttgggatgtgctgcattatcactgcaagcatcctgctctggtatgctcagattcagccccactggatcgccgcatcgataattttggaatttttcctgatcgttttactaattccagagcctgaaaagcagaggacgccccaagacaaccagctgacctacgtcgtgatcgccatactcacagtggtcgctgcgactatggccaatgagatgggctttcttgagaagaccaagaaagacctgggattgggctctatcgcaacacagcagccagagtccaacattctggatatcgacctccggcctgctagcgcctggaccctgtacgccgttgcaactacattcgtgacgcccatgcttcgacattcaattgagaatagttctgtaaacgtgtccctcaccgctatcgccaatcaagcgactgtcctgatggggttgggaaagggttggccgctgagcaagatggatattggcgtgccattactagctatcgggtgttattcacaggttaaccctataacactgaccgccgcactccttctgttggtggcccactacgctattatcggacccggcctgcaggcaaaagccaccagagaagcgcagaagcgcgctgccgcaggtatcatgaaaaatccaacagtcgacgggattactgtaatagatctcgaccccatcccttatgatccgaagtttgagaaacaactgggccaggtgatgcttttaattctgtgcgttacacaggtgctcatgatgaggaccacatgggccttgtgtgaagctctgactctagccaccggacccatcagtacactgtgggagggcaacccagggcggttctggaataccactattgcagtcagcatggctaacatctttcgtggatcctacctcgccggcgcgggtcttctgttctctataatgaagaatacgacaaacaccagaagggggactggaaacatcggcgaaaccttgggtgagaaatggaaaagccgcctgaatgccctcggcaagtccgagtttcaaacatataaaaagtcagggattcaggaagtggaccggactctggcaaaagagggaatcaagcgaggcgaaaccgatcaccatgctgtctctagagggagtgccaaattaaggtggttcgtggagcgcaacatggttacacctgagggaaaggtggtagaccttggctgcggtagagggggatggtcgtactattgtggcggtctgaagaatgtgagagaagtcaaaggcctcacgaaagggggacccggccacgaggaacctattccaatgagcacctacgggtggaacctagttcgtctgcagtccggagtggatgtctttttcataccccctgagaaatgcgacactttgctgtgtgatataggcgaatcttcaccaaatcccacagtggaggcaggtaggaccctccgggtacttaacctggtggagaattggttgaacaataacactcagttctgcattaaggttctgaatccgtacatgcctagcgtgatcgagaaaatggaggctctccaacgcaagtatgggggagccttagtccgaaacccactgtccagaaatagtacacatgaaatgtactgggtgtctaacgccagcggcaatatcgtctcatccgtgaacatgattagtaggatgcttataaaccggtttaccatgcgccacaagaaagcgacgtatgagcccgacgttgacctgggcagcgggaccagaaatatcggaattgaatctgagatccctaacctagatattatcggtaagaggatagagaaaatcaagcaggaacatgagacatcctggcactacgaccaggatcacccatataaaacttgggcttaccatggctcatatgaaaccaagcagacagggagcgcatcgtctatggtaaatggagtggtccgactcctgactaagccctgggacgtgttgccgaccgttacacaaatggccatgaccgatactacgcctttcggccagcagcgggtgtttaaagagaaggtcgacacacgtacccaggaacccaaagagggtactaagaaactgatgaagattaccgctgagtggctctggaaagaacttgggaagaagaaaacaccaagaatgtgtacgcgcgaggagttcaccaggaaggtgcggagtaacgccgcactgggagccatctttactgatgagaataaatggaagtccgctagagaggcggtagaagacagccgcttctgggagttagtggataaagaaaggaacctgcacttggagggcaagtgcgaaacatgtgtttacaatatgatgggcaagcgagagaaaaagctcggggagtttggaaaagccaagggttcacgggcaatttggtacatgtggctgggcgctagattcctagaatttgaggcccttgggttcctgaacgaagaccattggttttccagggaaaattctctcagcggagtcgaaggcgagggtctgcacaaattggggtatatcctgcgcgatgtgagtaagaaggagggaggcgcaatgtacgccgacgacaccgctggctgggatactcgtattacactcgaagaccttaaaaacgaggaaatggtgaccaatcacatggagggggaacataagaaactggccgaggcgatattcaagttaacatatcaaaacaaagtcgttcgggtgcagagacctactcccaggggaaccgtaatggatatcatttcccgccgagaccagcggggtagcggccaagtggggacgtacggactgaatacctttacaaacatggaggcacagttgatcagacagatggaaggcgagggtgtcttcaagaatatccagcacctcactgtgaccgaagaggttgccgtgcaaaactggctggctagggtcgggcgcgagagactatctcggatggccatttcaggagatgactgcgtggtaaagccacttgatgacaggttcgcaaacgctctgacagccctcaatgatatgggcaaaatacgtaaggacatccagcagtgggaacccagtaaaggctggaacgattggactcaggttcctttttgctcccatcacttccatgagctgattatgaaggacgggcgagtgttggtcgtgccatgtcgcaatcaagatgaattaatcggtagagctcggattagccagggagccggctggtctctgagggagaccgcatgcctcgggaaatcgtatgcgcagatgtggtcacttatgtactttcaccgcagagacctgcggctagccgctaacgccatctgtagcgcagtgccgtcccactgggtccccacgagtaggacaacctggtctatacatgctaagcacgaatggatgactacagaggacatgctgaccgtttggaatcgagtgtggatccgtgagaacccttggatggaagataagactccagtagagagctgggaagagattccctatctcggaaaaagagaagaccagtggtgcggctccttgatcggtctgacctcacgcgccacatgggcaaagaatattcaagccgcgatcaaccaggtgcggagtcttatagggaatgaggagtacacggattacatgccttctatgaaaaggttcagacgcgaagaggaagaggctggagtcctgtggtga

SEQ ID NO: 14829 - RNA, 9876 nt, synthetic construct
  misc_feature 1..9876: note = derived and/or modified CDS sequence (opt3) from DENV-2__EU482648__SS-prME
  source 1..9876: mol_type = other RNA
accgccggagtgatcattatgctgatacccacagctatggcattccacctcactacgaggaacggggagcctcatatgatcgtcgggaggcaggaaaagggtaaaagccttctgtttaagaccgaggacggagttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtggcgctggtgccccatgtcggtatggggcttgagacccggacagaaacttggatgagtagcgagggagcttggaaacacgcccagaggatcgagacctggatactgcggcatcctggcttcacaatcatggcagccattttggcttacaccatcggcacgactcactttcagcgcgcactcattttcatcctgctgacagccgtggctccatccatgaccatgcgttgcatagggatttctaacagggattttgttgaaggagtgtcgggtggctcatgggtcgacatcgtgctcgagcacgggagctgtgtaactacaatggccaagaataagcccaccttagatttcgaactgattaaaacggaggcgaagcagcctgcaacccttcggaaatattgcatcgaagccaagttgacaaacactaccacagagagtcgctgtccaactcaaggagagccctccctgaatgaagaacaggacaaacgatttgtttgcaagcattctatggtggatagaggctggggtaacgggtgtggactattcggcaagggcgggatcgtcacatgcgctatgtttacatgcaaaaagaatatggaaggaaaaattgtgcagcctgagaacctcgaatacaccatagtgatcactccacacagcggtgaggagcatgccgtcggcaatgacacggggaagcacggaaaagaaattaagatcacaccgcagtcctcaataaccgaggcagaactgactggctatggtaccgttacaatggagtgtagtcccaggaccgggcttgatttcaacgaaatggtgctgttgcaaatggaggacaaggcttggctcgtacaccggcagtggtttctggatttacctctgccatggctccccggcgccgacactcagggaagcaattggattcagaaggagacacttgtgacgttcaagaaccctcatgcgaaaaagcaagacgtcgtggttctgggctctcaggaaggggccatgcacaccgcattgactggagctacagagatccagatgtcctcaggtaatctactgtttaccggccatctcaaatgccgtctgcgcatggataaacttcaactgaaagggatgagctacagtatgtgtacaggaaagttcaagatcgtgaaagaaattgccgagactcagcacggcaccatcgtcattagagtgcagtatgagggtgacgggtctccatgcaagatacccttcgaaatcatggatttggagaaaaggcatgtactcggccggctgattacggttaacccgatcgtgaccgaaaaggactcccctgtcaacatcgaggctgaacccccatttggagatagctacattataatcggcgtggagcctgggcagttaaaactgaattggttcaagaagggatcgtctattggtcaaatgtttgagacaactatgcgaggcgccaaacgcatggcaatcctaggggacaccgcctgggatttcggatccctcggcggtgtctttacatcaattgggaaggctctgcaccaggtgttcggcgcgatctacggagcagcctttagtggcgttagctggactatgaaaatacttatcggggctattatcacctggattggaatgaactccagatctacgagcttgtcagtgagtctggtactcgtcggcgtgatcacactgtatcttggtgccatggttcaggcagactccgggtgtgtggtcagctggaagaataaagaactgaagtgcggatctggcatattcattaccgataacgtgcacacttggacagagcagtacaagtttcaacccgaatcaccaagtaaattggccagcgctatccagaaggcccatgaggaaggtatttgtggcatcaggtccgtaacccggctcgagaatctgatgtggaaacagataactcccgagttaaaccacatcctgtctgaaaatgaggtgaagctaaccattatgacaggggacatcaaaggaattatgcaggcaggcaagcgctcgctcagacctcaaccaacggaactgaaatatagctggaagacctgggggaaggcgaaaatgctttccactgagtcacataaccagacattcttgatcgatggaccggaaaccgctgagtgccccaatacaaacagggcctggaatagtctggaggttgaagactacggctttggtgtcttcactaccaacatatggctcaagctgcgtgagaaacaggacgtgttttgtgattctaagttaatgagcgcagccattaaagacaatcgggctgtgcacgccgatatggggtattggatcgaatccgcactgaacgacacgtggaagatggagaaggcttcattcatcgaggtcaaaagctgccactggcctaagtctcatacactttggtccaatggagttttggaaagtgagatgattatcccaaaatcattcgccggccccgtgtctcagcacaactaccgacctggttattacacccaaactgcgggcccatggcatctcgggaagctggaaatggattttgacttctgtgagggaaccacagtggtagtcactgaagattgcggcaacagagggccctccctaaggaccacaacggcctcaggaaaactgattaccgagtggtgctgtcgcagttgcactctcccgcctctgcggtacagaggcgaggacggttgttggtatgggatggaaataaggccacttaaggagaaggaagagaatttggtgaacagcctggttacagctggacacggccagatcgataatttttcgttaggtgtgctcggcatggcactgttccttgaagagatgctgcgcacccgagtcgggactaaacatgccattttgctcgtggctgtttcctttatgacactgatcaccggaaacatgtctttccgggacctaggccgtgtgatggtaatggtcggggccacgatgactgatgacattggaatgggcgtgacctacctggcactcctggcggcctttaaggtgagacccacattcgctgccggtcttttgctgaggaaattaaccagcaaggagctcatgatggcaactatcgggatagctctgctttcacagagtacaatccctgaaaccattctggagctaacagatgccctcgcactgggaatgatggtcttgaaaatcgttcgcaatatggaaaagtatcaactggccgtgactattatggctatctcctgcgtacccaacgcggtgatattacagaatgcctggaaggtctcttgtaccattctcgcagctgtgagcgtttccccactgcttctgacgtcaagccagcagaaagccgactggatccctttggccctcacaatcaagggcctgaaccccaccgctatttttctaactaccctgagtcggacatctaaaaagagatcctggccacttaatgaggcaataatggccgtgggcatggtcagcatcctcgcgtcgtcactgttgaaaaacgacattccgatgactgggcctctggtggctggaggtttactcaccgtttgctacgtgctgacgggcaggtctgccgatcttgaactggagcgagcaacagacgtcaagtgggaggatcaagccgaaatcagtgggtccagccccattttgtctatcaccataagcgaggacggatccatgtcaatcaaaaatgaagaggaggaacagactctcacaattctgatccgcaccggcctactggtaattagtggtcttttcccagtgagcatccccataactgctgcagcctggtatctctgggaggttaagaagcagcgggcgggggtgctgtgggatgtcccttctccaccccctgtgggaaaagctgaattggaggacggcgcctacagaattaagcagaaaggcatcttagggtattcccaaatcggagctggtgtatacaaggaaggcacatttcacaccatgtggcacgtgacgagaggggcagtcctgatgcatcgtggaaaacgcattgagccgtcatgggcagatgttaagaaggacctcatcagttacggcggtgggtggaaactggagggagaatggaaggagggcgaagaggtacaggtgcttgccctggaaccaggcaaaaacccccgggcagtccagactaagcctgggttgttcaaaaccaatacaggaaccataggtgctgtgagcctagatttttccccaggcacatctgggtcgcccattgttgacagaaagggaaaggtagtgggcctgtatggtaacggggtcgtgactaggagcggagcctacgtttcagcgatcgcccagaccgagaaatccattgaggataatcctgaaatcgaggacgatatattccgaaagaaacggctcacgattatggacctgcacccgggcgcaggcaagacaaaacgctatcttcccgctatcgtgagagaagccatcaagagggggttacggactctgattctcgctccaacccgagtcgtggcagccgagatggaagaggccttgagaggactgcctatccgctaccaaacacccgctattagggcggagcataccggtcgtgaaatagtagacctcatgtgtcacgcaactttcaccatgcggctgcttagtccagtcagagtgcctaactataacctgatcattatggatgaggcccattttacagaccccgcttctatcgccgcaaggggctacatcagcacgcgcgttgaaatgggggaggccgctggaattttcatgactgcgaccccaccgggctcccgagatccttttccccagtcaaatgccccaataatcgacgaggaaagagagattcccgaacggtcttggaacagcggtcacgagtgggtgacagatttcaaggggaaaaccgtctggtttgtgcctagtatcaaggcaggaaatgacattgctgcctgcttgaggaaaaacggcaagaaagttatccagctatcccgcaagactttcgatagcgaatatgtgaagacacgtaccaatgactgggattttgtcgtgacgactgacatatctgagatgggcgcaaacttcaaagccgagagagtaatcgatccacggaggtgtatgaagcccgtgattctgacagacggggaagaacgcgttatcctcgctggacctatgccggtcacccactcatccgccgcgcaacgaagaggtcggattggcaggaatcccaaaaacgaaaatgaccagtacatctacatgggggagcccttagaaaacgatgaggactgcgcacattggaaggaggccaaaatgctgcttgataatataaacacccctgaaggaattatccccagtatgtttgagccagaacgcgagaaggtggacgctattgatggcgaatatagactgaggggtgaggcccggaaaactttcgtggacctcatgcgtcgcggggatttgcctgtctggctggcttaccgagtagcagccgagggcatcaattatgctgacagaaggtggtgttttgatggagtgaagaacaatcagatactcgaagagaacgttgaagtggagatctggacaaaggagggcgaacggaaaaagctgaaaccccgctggcttgacgccagaatttacagcgatccactagcactgaaggagttcaaagagttcgcggccgggaggaagtcgttgaccttaaacctgatcacagagatgggacggctccctacttttatgacgcagaaggctcgagacgccctggataatcttgcagtcctgcacaccgctgaagccggtggcagagcatataaccatgccctctctgagttgccggagacactggaaactctactgctccttaccctgttagctacagtgaccgggggaattttcttgtttctgatgtccggcaaaggtgttgggaagatgactctcggcatgtgctgcatcataacggcgagcattctgctttggtacgcccaaatccagccccactggatcgcagcttcaattatcctggagttctttctcatagtgttgctgattccagaacctgagaaacagcgcaccccacaggacaatcaattaacatatgtcgtgatcgccattctaactgtagtggccgcaaccatggctaacgaaatgggattcctggagaagaccaaaaaggacctcggccttgggagtatcgccacccaggagccagaatctaatatactggatatcgacttgaggcctgcgtccgcttggactctgtacgccgttgcaacaacgtttgtcacccccatgctccggcacagcattgagaactcaagtgtgaatgtgagcctgactgccatcgctaaccaggcaacagtccttatgggactcggtaagggctggccgctgtccaaaatggatattggggttccattgctggccatcggatgttactctcaggtgaatcctattaccttaaccgcggctctactgctccttatcgcccattatgcaataattggccccggtctgcaagccaaggctacacgtgaagcccagaaaagagcagctgccgggatcatgaagaacccaactgtagacggcatcacggtgattgatttggaccccataccttacgatccgaaattcgagaagcagctgggacaggtcatgctcctgatcctttgcgtgacccaagttttaatgatgaggacaacttgggcgctgtgtgaagccctcaccttggcaacaggccccattagcaccctgtgggaggggaatccaggacgcttttggaacactacgatcgctgtgtccatggccaatattttccggggctcatatctagccggtgctgggctgctcttttctatcatgaagaacacaaccaatactcgaagaggaaccggcaacataggtgagacacttggcgaaaaatggaagagtaggctgaatgccttggggaaatcggagttccagatctacaagaaaagcggcattcaggaagtcgaccgcactctggccaaggagggcatcaaaagaggggaaaccgatcaccatgcggtatccagaggatctgctaagctccgttggtttgtggaaaggaacatggttacacctgagggcaaggtggtcgacctgggttgcgggcggggaggctggtcatattactgtggtggccttaaaaacgtgcgcgaagtcaaggggctaacgaaaggaggccccgggcacgaggaacctattccaatgagcacctatggatggaatctggtgcgactccaatccggcgttgatgtgttcttcactccccctgagaagtgcgacacactactgtgtgatatcggtgagagttctccaaaccccaccatagaagcagggagaactttgagggtactgagcctcgtggagaattggcttaacaatgacacacagttttgcattaaagtcctgaacccgtacatgccttcagttatcgaaaagatggagaccttgcagcggaagtacggaggcgccctggtgcgcaatccactctccagaaacagtacgcatgaaatgtattgggtcagcaatgctaccggcaacatcgtgtcttccgtaaatatgatttcaaggatgttaataaaccgattcacaatgaaacacaagaaagccacttacgagcccgacgtggatctggggagcggaacccggaatatcggtattgagtcggaaatccctaaccttgacattatcggcaagcgtatagagaaaatcaagcaggaacacgagacatcttggcattatgatcaagaccacccatacaagacttgggcatatcatgggagttacgaaaccaaacagacaggatccgccagctcaatggttaatggcgtggtcagactgctaaccaagccctgggatgtggtcccgatggtgactcagatggctatgacggacacaaccccttttggtcagcaacgcgttttcaaagagaaggtagatactaggacccaggagcccaaagaagggacaaagaagctcatgaaaattacggcggagtggctgtggaaggaattgggcaaaaagaaaaccccacggatgtgtactagagaggagtttacacgcaaggtgaggtccaacgccgcactgggcgctatcttcaccgacgaaaacaaatggaagtctgcccgagaggcagtcgaagatagccggttttgggagctcgtggacaaggaaagaaatcttcacctggagggcaaatgcgagacttgtgtttataacatgatggggaagagggagaaaaagttaggagagttcggtaaagccaagggcagtcgcgctatttggtacatgtggctgggggccagatttttggagttcgaggcgctcggatttctgaatgaagatcactggttctcccgggagaacagcctatctggcgtggagggtgaagggcttcataagctgggatacatcctcagagacgtcagcaaaaaggagggcggcgcaatgtatgccgacgatacagctgggtgggacaccaggattacactggaagatttgaaaaatgaggaaatggtgactaaccacatggagggagagcataagcgcctggccgaagcaatatttaaactcacctaccagaataaggtagtgcgagttcagcggcctacgcccagaggtaccgtcatggacatcattagtaggcgcgatcaaagaggctccggacaggtgggaacatatggccttaacactttcaccaatatggaggctcagctgatccggcaaatggaaggtgaggggatcttcaagagcattcagcacttaacagtgactgaggaaatagccgtccagaactggctggctagggttggacgtgagcgattgtctcgcatggccatctcgggcgacgattgcgtggtaaaaccactcgacgatagatttgcatcagcgctgaccgccctaaatgacatgggcaaggtgcggaaagatattcagcaatgggaacccagcaaggggtggaacgactggacgcaggtccctttctgctcccatcactttcacgagcttatcatgaaagatggaagggtgctggttgtgccatgtcgcaatcaggacgaactcattggtagagctcggatcagtcagggcgccgggtggtctctgaaggagacagcatgcttgggaaagagctacgctcaaatgtggtccttaatgtatttccataggcgagacctgcgtctcgccgcaaacgccatatgttcagcggtcccgagtcactgggtgcccacctctagaactacatggagcatccatgctaaacacgagtggatgaccactgaagatatgcttaccgtatggaatcgcgtttggattcaggagaacccttggatggaagacaagacaccagtggagtcctgggaagaggtcccctacctgggcaaacgggaggatcagtggtgcggttcactaatcgggctgacgagcagggccacctgggcaaagaacattcagactgccatcaatcaagtgagatctctcataggaaacgaagagtatacagactacatgccttccatgaaacgctttcggagggaagaggaagaggctggcgtgttgtggtga

SEQ ID NO: 14830 - RNA, 9876 nt, synthetic construct
  misc_feature 1..9876: note = derived and/or modified CDS sequence (opt3) from DENV-2__EU482649__SS-prME
  source 1..9876: mol_type = other RNA
agcgccggcatgatcattatgctgatacccaccgtgatggctttccacctcacaactagaaacggggagcctcatatgatcgtcggaattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctatagcaccatctatgacaatgcgctgcattgggatctcgaacagagattttgttgaaggagtgtcaggtggcagctgggtcgacattgtgctcgagcacgggagttgtgtaaccactatggccaagaataagcccacattagatttcgaactgatcaaaaccgaggctaagcagcctgccacgcttaggaaatattgcatcgaagcgaagttgaccaacacaactaccgagtcccggtgtccaacacaaggagagccctctctgaaagaagagcaggacaagcgctttgtttgcaagcatagcatggtggatcgaggctggggtaatgggtgtggactattcggcaaaggcgggattgtcacttgcgcaatgtttacctgcaagaaaaacatggaaggaaagatagtgcagcctgagaatctcgaatacacaatcgtggtcaccccacactccggtgaggagcatgccgttggcaacgacactgggaaacacggaaaggaaattaaagtgacgccgcagtcaagtatcacagaggctgaactgaccggctatggtactgtaaccatggagtgtagccccagaacagggcttgatttcaatgaaatggtgctgttgcaaatggagaacaaggcctggctcgtccacaggcagtggtttctggacttacctctgccatggctccccggcgcagataagcaggagtctaattggatacagaaagaaacccttgtgactttcaagaaccctcatgctaaaaagcaagacgttgtggtcctgggatcccaggagggcgccatgcacacagcgttgacgggggccaccgaaattcagatgtcaagcggaaatctactgtttactggtcatctcaaatgccggctgcgtatggacaagcttcaactgaagggcatgagttactctatgtgtacagggaaattcaaggtggtaaaagagatcgcagagacccagcacggaacaatcgttattcgcgtgcagtatgaaggcgatggttccccatgcaagatccccttcgagattatggacttggaaaaaagatacgtcctcgggaggctgataactgtgaacccgatcgtcaccgagaaggatagccctgtgaacattgaagctgagcccccatttggcgactcgtacatcatcattggagttgagcctggccagttaaagctgaattggttcaaaaaggggtcttccataggacaaatgtttgaaacgaccatgcggggtgccaaacgaatggctatcctaggcgatacagcctgggacttcgggtcactcggaggcgtgtttactagtattggtaaggcactgcatcaggtattcggggccatctatggcgctgcgtttagcggagtctcctggaccatgaaaattcttatcggcgtgataatcacatggattgggatgaactctcgcagcacttcattgagtgtttccctggtgctcgtcggaatcgtgaccctgtaccttggcgtaatggtgcaggcagatagcggttgtgttgtctcttggaagaataaggagctgaaatgcgggtcaggaattttcatcacggacaacgtgcacacatggaccgaacagtataagtttcaacccgagagtccaagcaaattggcctccgctatacagaaggcccaggaagagggcatttgtggtatcagatctgtgactaggctcgagaatctgatgtggaaacagattacacccgaattaaaccacatcctggcagagaatgaagtcaagctaaccataatgactggcgatatcaaagggattatgcaagccggaaagcggtcgctccgccctcagccaaccgagctgaagtacagctggaaaacatggggcaaggctaaaatgctttccacggaatcatataaccagaccttcttgatcgacgggccggagactgccgagtgccccaatacaaacagagcatggaatagtctggaagttgaggattacggatttggcgtgttcaccacaaacatttggctcaagctgaaagaaaagcaggacgcgttttgtgactctaagttaatgagcgctgccatcaaagataatagggcagtgcatgccgacatgggttattggatagagtccgctctgaacgatacttggaagattgagaaagcctcattcatcgaagtaaagaattgccactggcctaaaagccataccctttggtctaacggggtcttggagtccgaaatgatcattccaaagaacctcgcaggacccgtgagtcaacacaattaccgtcctggctaccacacgcagatcgctggtccatggcatctgggcaagctagagatggacttcgatttttgtgacgggacaaccgttattgtgactgaagattgcggaaaccggggccccagcctgcgaaccacaactgcctctgggaaactcataaccgagtggtgctgtagatcctgcacactgccgcctcttaggtatcgcggagaggacggctgttggtacggtatggaaatccggccattgaaggagaaagaagagaatctggtcaactcattagtgacggcggggcacggacaggttgataatttcagtctcggcgtgctgggtatggccctttttctggaagagatgttgagaaccagggtaggcactaagcatgctattctcctggtcgcagtgagcttcgtgacactaatcaccgggaacatgtcgtttaaagacctgggacgcgtcgttgtgatggtaggcgccactatggctgatgacattgggatgggagtgtcctatctcgccctgcttgcagcgttcaaggtccgacccacatttgccgctggcttgctgttacggaagctcacctctaaagagctgatgatgacgactatcggtatagtgcttctgagccaatcaaccatccctgaaacagttctagagctcaccgatgccctggcattggggatgatggtgctgaagattgtccgtaatatggaaaaataccagttagctgtgactatcatggccattctctgcgttcccaacgcagtggtcctgcagaatgcctggaaggtaagttgtacaatccttgctgtggtttccgtgtctccactgttgctcaccagctcccagcaaaaaacagactggatacctctggcgctaactattaagggactgaaccccaccgccatcttccttacgacactctcaagaaccaataaaaagaggagctggccactgaacgaggcaatcatggctgtcggcatggtgagtattttggcctcttccctgttaaagaatgacataccgatgactggccctctcgtagccgggggactgcttaccgtgtgctatgtcctgacaggtcgcagcgctgatttggaactcgagcgggcaactgacgttaaatgggaggatcaggccgaaatctcgggctcatctcccattctgagtatcaccatttccgaggacgggagcatgtctatcaagaacgaagaggaggaacagacgctaacaatactgatcagaaccggacttctcgtgattagcggcctgtttccaatctccattcccatcactgcggctgcctggtacttgtgggaggtgaaaaagcagagggcaggtgtcttatgggatgtgccttcaccaccccctatggggaaagccgaactggaggacggagcttatcgaataaagcaaaagggcattctcggctacagtcagatcggggcaggagtttacaaagaaggtacattccacaccatgtggcatgtaactcgcggcgccgtgctgatgcacaaggggaaacggatcgagccgagctgggcggatgtcaagaaagaccttatttcttatggaggcggttggaagctggagggggaatggaaggagggagaagaggtgcaggttttggctctagaaccaggcaaaaatcccagagccgtgcagacaaagcctggcctgtttaaaaccaacacggggactatcggagcagtctccctcgatttctcaccaggtaccagtggcagccccataattgacaagaaagggaaggtggtaggactgtacggcaacggtgtcgtgacaaggtccggggcctatgtttctgctatcgcccaaaccgagaagtcgattgaggataatcctgaaatcgaggacgatatatttcgtaaacgccggcttacaattatggacttacacccgggagcaggcaagactaaaagatacctgcccgctatcgtgagggaagccatcaagcgaggcctccggaccttgattctggcgccaacgcgcgtcgtggccgcagagatggaagaggctctcagagggctgcctatcaggtatcagacacccgccattaaagctgagcatactggacgggaaatagttgaccttatgtgtcacgcaaccttcacaatgcgactgttgagcccagtgagagtccctaactacaatctaatcattatggatgaggcccatttcaccgaccccgcctcaatcgctgcgcgcggttatatctccactagggtggaaatgggcgaggcagccgggatttttatgaccgctacaccaccgggaagtcgtgatcctttcccccagtctaacgccccaataatcgacgaggaacgggagattcccgaaagaagctggaattccggccacgagtgggtaacggattttaagggtaagactgtgtggttcgttccttcaatcaaagcagggaacgacattgccgcttgcctgaggaagaatggaaaaaaggtcatccaactctctcgcaaaacctttgatagcgaatacgtgaagacacgaaccaacgactgggatttcgtggtcactacagacataagtgagatgggcgcgaattttaaagccgagagagtaatcgatccacggaggtgtatgaagcccgtgattttaaccgacggcgaagagcgcgttatcctggcagggcctatgccggtgacgcattccagcgctgcccagcgtagaggacggattggtaggaacccaaagaatgaaaacgaccagtacatctatatgggcgagccccttgaaaatgatgaggactgcgcacactggaaagaggccaagatgctgctcgataacataaatactcctgaagggattatcccctctatgttcgagccagaacgcgagaaagtcgacgctattgatggagaataccgattgagaggcgaggcccggaagacatttgtggacctgatgaggcgcggtgatctccctgtttggctggcgtataaagtggcagccgaggggatcaactacgctgacagaaggtggtgtttcgatggcataaagaacaatcagatccttgaagagaacgtcgaagtggagatttggaccaaggagggagaacggaaaaagctaaaaccccgttggctggacgcccgcatctattcagatccattggctttaaaggagtttaaagaattcgcagccggccgaaagtccctgaccctcaatctgattactgagatggggagacttcctacattcatgacccaaaagacaagggacgctctggataacctcgccgtattgcacactgcagaagcgggaggtcgggcctacaatcatgctctgagtgagctaccggagacgctggaaaccctccttctgttaacattgctggccactgtgaccggcgggatctttctcttcctgatgagcggacgcggcataggtaaaatgacacttgggatgtgctgcattatcaccgcatcgatcctgctctggtatgctcagattcagccccactggatcgccgcatctataattttggagtttttcctgatcgttttactaattccagaacctgagaagcagagaactccccaagacaaccagctgacgtacgtcgtgatcgccatactcaccgtggtcgctgcgacaatggccaatgaaatgggctttcttgagaaaactaagaaagacctgggattgggctccatcgcaacccagcagccagagagcaacattctggatatcgacctcaggcctgcttcagcctggacactgtacgccgttgcaaccactttcgtgacacccatgcttcggcatagtattgaaaattcttccgtaaacgtgagcctcacggctatcgccaatcaagcgaccgtcctgatggggttgggaaagggttggccgctgtcaaagatggatattggcgtgccattactagctatcgggtgttatagtcaggttaaccctataactctgacagccgcactccttctgttggtggcccactacgctattatcggacccggcctgcaggcaaaagccacccgagaggcgcagaagagagctgccgcaggtatcatgaaaaatccaaccgtcgacgggattacagtaatagatctcgaccccatcccttatgatccgaagtttgaaaaacaactgggccaggtgatgcttttaattctgtgcgttactcaggtgctcatgatgcgcacgacctgggccttgtgtgaggctctgacactagccactggacccatcagcaccctgtgggaaggcaacccagggaggttctggaatacaaccattgcagtctccatggctaacatctttcggggatcttacctcgccggcgcgggtcttctgttcagcataatgaagaatactacgaacacacgtagagggaccggaaacatcggcgagactttgggtgagaaatggaagtccaggctgaatgccctcggcaagtcagaatttcaaatttataaaaagtctgggatccaggaggtggaccgcaccctggcaaaagaaggaattaagcggggcgagacagatcaccatgctgtcagtcgagggtcggccaaattaagatggttcgtggagaggaacatggttactcctgaaggaaaggtggtagaccttggctgcggtcgcgggggatggagctactattgtggcggtctgaagaatgtgcgggaggtcaaaggcctcaccaaggggggacccggccacgaagagcctatcccaatgtccacatacgggtggaacctagttagactgcagtctggagtggatgtctttttcataccccctgaaaaatgcgacacgttgctgtgtgatattggcgagtcaagcccaaatcccaccgtggaggcaggtcgtactctcagggtacttaacctggtggaaaattggttgaacaataacacacagttctgcatcaaggttctgaatccgtacatgccttccgtgatcgagaaaatggaagctctccaacggaagtatgggggagccttagtccgcaacccactgagtcgaaattctacccatgagatgtactgggtgagcaacgcctcaggcaatattgtctccagtgtgaacatgataagcagaatgcttatcaacaggtttactatgcggcacaagaaagcgacatatgaacccgacgttgacctgggctctgggacccgcaatattggaatcgagtccgagattcctaacctagatatcataggtaagagaatcgaaaaaattaagcaggagcatgaaacgtcatggcactacgaccaggatcacccatataaaacctgggcttaccatggcagctatgagacaaagcagactgggtcggcatctagtatggtaaatggagtggtcaggctcctgaccaagccctgggacgtgttgccgacagttactcaaatggccatgaccgatacaacccctttcggccagcagcgagtgtttaaagaaaaggtcgacactcggacgcaggagcccaaagagggtacaaagaaactgatgaagatcaccgctgaatggctctggaaagagcttgggaagaagaaaactccacgtatgtgtaccagagaagagttcacacgcaaggtgaggtccaacgccgcactgggagccatttttacggatgagaataaatggaagagcgctcgggaagcggtagaggactcaagattctgggaattagtggataaagagcgcaacctgcacttggaaggcaagtgcgagacctgtgtttacaatatgatgggcaagagggagaaaaagctcggggaatttggaaaagccaagggttcccgagcaatctggtacatgtggctgggcgctcggttcctagagtttgaagcccttgggttcctgaacgaggaccattggttttctagagaaaatagcctcagtggagtcgagggcgagggtctgcacaaattggggtatattctgagggatgtgtccaagaaggaaggaggcgcaatgtacgccgacgacactgctggctgggatacacgcataaccctcgaggaccttaaaaacgaagagatggtgactaatcacatggaaggggagcataagaaactggccgaggcgatcttcaagttaacatatcaaaacaaagtcgttcgtgtgcagcggcctacccccagaggaacagtaatggatattatcagcaggcgcgaccagcgaggttctggccaagtggggacttacggactgaatacctttacgaacatggaagcacagttgatccggcagatggagggcgaaggtgtcttcaagaatattcagaacctcaccgtgacagaggaggttgccgtgcaaaactggctggctagagtcgggagggaacgcctatcaagaatggccataagtggagatgactgcgtggtaaagccacttgatgaccggttcgcaaatgctctgactgccctcaacgatatgggcaaaatcaggaaggacattcagcagtgggagccctccaaaggctggaatgattggacccaggttcctttttgcagccaccatttccacgaactgatcatgaaggacgggcgtgtgttggtcgtgccatgtcgaaaccaagatgagttaattggacgcgctagaatctctcagggtgccggctggtcgctgcgggaaacagcatgcctcgggaaatcatatgcgcagatgtggagccttatgtactttcataggcgcgacctgagactagccgctaatgccatatgttccgcagtgccgagtcactgggtccccacttctcggaccacgtggagcatccacgctaagcatgagtggatgacaaccgaggacatgctgactgtttggaacagggtgtggattcgagaaaatccttggatggaggataagacaccagtagaatcctgggaggaaatcccctatctcggaaaacgtgaggaccagtggtgcggctcattgattggtctgaccagtagagccacttgggcaaagaacatccaagccgcgataaatcaggtgcgctctcttattgggaacgaggaatacaccgattacatgcctagcatgaaacggttcaggagagaggaagaggaagctggagtcctgtggtga

SEQ ID NO: 14831 - RNA, 9876 nt, synthetic construct
  misc_feature 1..9876: note = derived and/or modified CDS sequence (opt3) from DENV-2__EU482650__SS-prME
  source 1..9876: mol_type = other RNA
agcgccggcatgatcattatgctgatacccaccgtgatggctttccacctcacaactagaaacggggagcctcatatgatcgtcggaattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagagcaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccaattaaagctgaattggttcaagaaagggtcttccattggacagatgtttgaaacgaccatgcggggtgccaagcgaatggctatactaggcgatacagcctgggacttcgggtcactcggaggcgtatttactagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacaatataaatttcagcccgagagtccaagcaagttggcctccgctatccagaaagcccaggaagagggcatatgtggtattagatctgtcactaggctcgagaatctgatgtggaagcaaatcacacccgaattaaaccacattctggcagagaatgaagttaaactaaccatcatgactggcgatataaaggggatcatgcaggccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaagacgcgttttgtgactctaagttaatgagcgctgccattaaggataatagggcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatcccaaaaaacctcgcaggacccgttagtcagcacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaagctcattaccgagtggtgctgtagatcctgcacactgccgcctcttaggtatcgcggagaggacggctgttggtacggtatggaaatacggccattgaaagagaaggaagagaatctggtgaactcattagttacggcggggcacggacaagtggataatttcagtctcggcgtactgggtatggccctttttctggaagagatgttgagaaccagggtcggcactaaacatgctatcctcctggtggcagtgagcttcgtcacactaattaccgggaacatgtcgtttaaggacctgggacgcgttgtggtaatggtgggcgccactatggctgatgacatcgggatgggagtcacatatctcgccctgcttgcagcgttcaaagtgcgacccacctttgccgctggcttgctgttacggaagctcacgtccaaggagctgatgatgactaccattggtatcgttcttctgtctcagagcacaatacctgaaaccgtgctagagctcactgatgccctggcattggggatgatggtcctgaaaatcgtgcgtaatatggaaaagtaccagttagctgttacaattatggccatcctctgcgtgcccaacgcagtcattctgcagaatgcctggaaagtatcatgtaccatccttgctgtggttagtgtgtccccactgttgctcacatctagccaacagaagactgactggatacctctggcgctaaccattaaaggactgaaccccacggccatcttccttacaaccctctccagaactaataagaaaaggtcatggccactgaacgaggcaatcatggctgtcggcatggtgagcattttggccagttctctgttaaagaatgacataccgatgaccggccctctcgtagccgggggactgcttacagtgtgctatgtcctgactggtcgctccgctgatttggaactcgagcgggcaaccgacgttaagtgggaggatcaggccgaaatcagcggctcgtcacccattctgtctatcacgattagtgaggacgggtccatgagcatcaaaaacgaagaggaggaacagacactaaccatactgatcagaactggacttctcgtgatttctggcctgtttccaatcagcattcccatcacagcggctgcctggtacttgtgggaggtgaagaaacaaagggcaggtgtcttatgggatgtgccttccccaccccctatggggaaggccgaactggaggacggagcttatcgaataaaacagaagggcattctcggctactcacagatcggggcaggagtttacaaggaaggtaccttccacactatgtggcatgtaacacgcggcgccgtgctgatgcacaaagggaagcggatcgagccgagttgggcggatgtcaaaaaggaccttattagctatggaggcggttggaaactggagggggaatggaaggagggagaagaggtgcaggttttggctctagaaccaggcaagaatcccagagccgtgcaaaccaaacctggcctgtttaagacgaacactgggaccatcggagcagtctctctcgatttctccccaggtacatcaggcagtcccataattgacaaaaaggggaaagtggtaggactgtacggcaacggtgtcgtgaccaggagcggggcctatgtttccgctatcgcccagacagagaagtctattgaggataatcctgaaatcgaggacgatatatttcgtaagcgccggcttactattatggacttacacccgggagcaggcaaaaccaagagatacctgcccgctatcgtgagggaagccatcaaacgaggcctccggacgttgattctggcgccaacacgcgtcgtggccgcagagatggaagaggctctcagagggctgcctatcaggtatcagactcccgccattcgggctgagcataccggacgagaaatagttgaccttatgtgtcacgcaacattcaccatgagactgttgtcgccagtgcgcgtccctaactacaatctaatcattatggatgaggcccatttcactgaccccgccagcatcgctgcgaggggttatatctcaacccgtgtggaaatgggcgaggcagccgggatttttatgacagctacgccaccgggatcccgggatcctttcccccaaagtaacgccccaataatcgacgaggaaagagagattcccgaaaggtcttggaatagcggccacgagtgggtaactgattttaagggtaaaaccgtgtggttcgttccttccatcaaggcagggaacgacattgccgcttgcctgcgcaagaatggaaaaaaggtcatccagctctcacgaaaaacatttgattctgaatacgtgaagaccagaactaacgactgggatttcgtggtcacaaccgacataagcgagatgggcgcgaattttaaagccgagcgggtaatcgatccaaggcgctgtatgaagcccgtgattttaacggacggcgaagagcgtgttatcctggcagggcctatgccggtgactcatagttccgctgcccagagacggggaaggattggtcgcaacccaaaaaatgaaaacgaccagtacatctatatgggcgagccccttgaaaatgatgaggactgcgcacactggaaggaggccaagatgctgctcgataacataaatacacctgaagggattatccccagcatgttcgagccagaacgagagaaagtcgacgctattgatggagaatacagattgcggggcgaggccaggaagacctttgtggacctgatgcgcagaggtgatctccctgtttggctggcgtataaagtggcagccgaggggatcaactacgctgacaggcggtggtgtttcgatggcataaagaacaatcaaatccttgaagagaacgtcgaagtggagatttggaccaaagagggagaacgtaagaagctaaaaccccgctggctggacgcccgaatctattctgatccattggctttaaaggagtttaaagaattcgcagccggcagaaagtcactgactctcaatctgattacagagatggggaggcttcctaccttcatgacacagaaaactcgggacgctctggataacctcgccgtattgcacacggcagaagcgggaggtcgcgcctacaatcatgctctgtccgagctaccggagaccctggaaacactccttctgttaactttgctggccaccgtgacaggcgggatctttctcttcctgatgagtggaagaggcataggtaagatgacccttgggatgtgctgcattatcactgcaagcatcctgctctggtatgctcagattcagccccactggatcgccgcatcgataattttggagtttttcctgatcgttttactaattccagaacctgagaagcaaaggacgccccaggacaaccagctgacctacgtcgtgatcgccatactcacagtggtcgctgcgactatggccaatgaaatgggctttcttgagaaaaccaagaaagacctgggattgggctctatcgcaacacagcaaccagagtccaacattctggatatcgacctccggcctgctagcgcctggaccctgtacgccgttgcaactacattcgtgacgcccatgcttcgacattcaattgaaaatagttctgtaaacgtgtccctcaccgctatcgccaatcaggcgactgtcctgatggggttgggaaagggttggccgctgagcaaaatggatattggcgtgccattactagctatcgggtgttattcacaggttaaccctataacactgaccgccgcactccttctgttggtggcccactacgctattatcggacccggcctgcaggcaaaggccaccagagaggcgcaaaagcgcgctgccgcaggtatcatgaaaaatccaacagtcgacgggattactgtaatagatctcgaccccatcccttatgatccgaagtttgaaaaacagctgggccaggtgatgcttttaattctgtgcgttacgcaagtgctcatgatgaggaccacatgggccttgtgtgaggctctgactctagccaccggacccatcagtacactgtgggaaggcaacccagggaagttctggaataccactattgcagtcagcatggctaacatctttcggggatcctacctcgccggcgcgggtcttctgttctctataatgaaaaatacgacaaacacccgtagagggactggaaacatgggcgagaccttgggtgagaagtggaaaagcaggctgaatacactcggcaagtccgaatttcagatctataagaaatcagggattcaggaggtggaccgcactctggccaaggaaggaatcaaacggggcgagaccgatcaccatgcagtctctcgagggagtgctaagttaagatggttcgtggagaggaacatggttacacctgaaggaaaagtggtagaccttggctgcggtcgcgggggatggtcgtactattgtggcggtctgaagaatgtgcgggaggtcaagggcctcacgaaagggggacccggccacgaagagcctattccaatgagcacctacgggtggaacctagttagactgcagtccggagtggatgtctttttcatcccccctgaaaagtgcgacactttgctgtgtgatataggcgagtcttcaccaaatcccacagtggaggccggtcgtaccctcagggtacttaacctggtggaaaattggttgaacaataacactcaattctgcattaaagttctgaatccgtacatgcctagcgtgatcgagaagatggaagcactccagcggaaatatgggggagctttagtccgcaacccactgtcccgaaatagtacacatgagatgtactgggtgtctaacgccagcggcaatatcgtctcatccgtgaacatgattagtagaatgcttataaacaggtttaccatgcggcacaagaaggccacgtatgaacccgacgttgacctgggcagcgggacccgcaatatcggaattgagtctgagatccctaacctagatattatcggtaaaagaatagaaaagatcaaacaggagcatgaaacatcctggcactacgaccaggatcacccatataagacttgggcgtaccatggctcatatgagaccaaacaaacagggagcgcttcgtctatggtaaatggagtggtcaggctcctgactaagccctgggacgtgttgccgaccgttacacagatggcaatgaccgatactacgcctttcggccagcagcgagtgtttaaggaaaaagtcgacacacggacccaagagcccaaggagggtactaaaaagctgatgaaaattaccgccgaatggctctggaaggagcttgggaaaaagaagacaccacgtatgtgtacgagagaagagttcacccgcaaagtgaggagtaacgctgccctgggagcaatctttactgatgagaataagtggaaatccgcccgggaagctgtagaggacagcagattctgggaattagtggataaggagcgcaacctgcacttggaaggcaaatgcgagacatgtgtttacaatatgatgggcaagagggagaagaaactcggggaatttggaaaggcgaaaggttcacgagccatttggtacatgtggctgggcgcacggttcctagagtttgaagctcttgggttcctgaacgaggaccattggttttccagagaaaattctctcagcggagtcgagggcgagggtctgcacaagttggggtatatcctgagggatgtgagtaaaaaggaaggaggcgccatgtacgcagacgacaccgccggctgggatactcgcattacactcgaggaccttaagaacgaagagatggtgaccaatcacatggaaggggagcataaaaagctggctgaggccatattcaaattaacatatcagaacaaggtcgttcgtgtgcagcggcctactcccagaggaaccgtaatggatatcatttccaggcgcgaccaacgaggtagcggccaggtggggacgtacggactgaatacctttacaaacatggaagcgcagttgatccggcagatggagggcgaaggtgtcttcaaaaatatccaacacctcactgtgaccgaggaggttgcagtgcagaactggctggccagagtcgggagggaacgcctatctagaatggctatttcaggagatgactgcgtggtaaagccacttgatgaccggttcgccaacgcactgacagctctcaatgatatgggcaagataaggaaagacatccagcagtgggagcccagtaagggctggaacgattggactcaagttcctttttgctcccatcacttccatgaactgattatgaaagacgggcgtgtgttggtcgtgccatgtcgaaatcaggatgagttaatcggacgcgccagaattagccagggtgctggctggtctctgcgggaaaccgcctgcctcgggaagtcgtatgcacagatgtggtcacttatgtactttcacaggcgcgacctgagactagcggccaacgctatctgtagcgccgtgccgtcccactgggtccccacgagtcggacaacctggtctatacatgcaaaacacgagtggatgactacagaggacatgctgaccgtttggaatagggtgtggatccgagaaaacccttggatggaggataagactccagtagaaagctgggaggaaattccctatctcggaaagcgtgaggaccaatggtgcggctccttgatcggtctgacctcaagagctacatgggccaaaaatattcaggcagccatcaaccaggtgcgcagtcttatagggaatgaggaatacacggattacatgccttctatgaagcggttcaggagagaggaagaggaagcgggagtcctgtggtga

SEQ ID NO: 14832 - RNA, 9876 nt, synthetic construct
  misc_feature 1..9876: note = derived and/or modified CDS sequence (opt3) from DENV-2__EU482651__SS-prME
  source 1..9876: mol_type = other RNA
agcgccggcatgatcattatgctgatacccaccgtgatggctttccacctcacaactagaaacggggagcctcatatgatcgtcggaattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagagcaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaagcttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggaaaaaagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttactagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactgccgagtgccccaatacaaacagagcatggaatagtctggaagtggaggattacggatttggcgtgttcaccacaaacatctggctcaggctgaaggaaaaacaggacgcgttttgtgactctaagttaatgagcgctgccattaaggataatcgtgcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatcccaaaaaacctcgcaggacccgttagtcaacacaattaccggcctggctaccacacgcagattacaggtccatggcatctgggcaagctagagatggacttcgatttttgtgacgggaccactgtgatcgtcaccgaagattgcggaaaccgaggccccagcctgagaacaactaccgcttctgggaagctcattacagagtggtgctgtaggtcctgcacgctgccgcctcttcgctatcggggagaggacggctgttggtacggtatggaaataagaccattgaaagagaaggaagagaatctggtgaactcattagttaccgccgggcacggacaggtggataatttcagtctcggcgtactgggtatggcgctttttctggaagagatgttgaggactcgcgtcggcacaaaacatgccatcctcctggtgaccgtgagcttcgtcactctaattacagggaacatgtcgtttaaggacctgggacgagttgtggtaatggtgggcgctaccatggcagatgacatcgggatgggagtcacgtatctcgccctgcttgctgccttcaaagtgcggcccacttttgcagcgggcttgctgttacgtaagctcacctccaaggagctgatgatgacaaccattggtatcgttcttctgtctcaaagcactatacctgaaacagtgctagagctcaccgatgccctggctttggggatgatggtcctgaaaatcgtgagaaatatggaaaagtaccagttagccgttacaattatggcaatcctctgcgtgcccaacgctgtcgtactgcagaatgcctggaaagtgtcatgtactattcttgcagttgtgagtgtctccccactgttgctcacctctagccagcaaaagacggactggatccctctggccctaacaataaaaggactgaaccccaccgctattttccttactaccctctccaggacaaataagaaacgctcatggccactgaacgaggcgatcatggccgtgggcatggtaagcatcttggcaagttctctgttaaagaatgacattccgatgactggccctctcgtggctgggggactgcttaccgtctgctatgttctgacgggtcggtccgccgatttggaactcgagagagccacagacgtgaagtgggaggatcaggctgaaataagcggctcgtcacccatcctgtctattaccatcagtgaggacgggtccatgagcattaaaaacgaagaggaggaacagactctaacaatcctgataaggaccggacttctcgtgatctctggcctgtttccaattagcatccccattactgcagccgcgtggtacttgtgggaggtcaagaaacagcgagctggtgtgttatgggatgttccttccccaccccctatggggaaggccgaactggaggacggagcatatcgcatcaaacaaaagggcatactcggctactcacagattggggccggagtatacaaggaaggtacattccacaccatgtggcatgtgacgcggggcgctgtcctgatgcacaaagggaagagaatcgagccgagttgggcagatgtgaaaaaggaccttatcagctatggaggcggttggaaactggagggggaatggaaggagggagaagaggttcaggtgttggccctagaaccaggcaagaatcccagggcggtccagactaaacctggcctgtttaagaccaacacagggaccattggagctgtgtctctcgatttctccccaggtacatcaggcagtcccatcatagacaaaaaggggaaagtagtcggactgtacggcaacggtgtggttactcgtagcggggcctatgtgtccgcaattgcccaaaccgagaagtctatcgaggataatcctgaaattgaggacgatatctttcgcaagcggagacttacgataatggacttacacccgggagctggcaaaacaaagaggtacctgcccgccattgtccgagaagcaatcaaacggggcctccgcactttgatcctggctccaaccagagtggttgccgcggagatggaagaggccctcagggggctgcctattcggtatcagacacccgcaatcaaggctgagcataccggacgagaaattgtggaccttatgtgtcacgccactttcaccatgagactgttgtcgccagtccgcgtgcctaactacaatctaataatcatggatgaggctcatttcacagaccccgcaagcattgccgccaggggttatatctcaacgcgtgtagaaatgggcgaggctgcggggatctttatgactgcaaccccaccgggatcccgggatcctttcccccagagtaacgccccaattatagacgaggaaagagagatccccgaaaggtcttggaatagcggccacgagtgggtgacagattttaaaggtaagaccgtttggttcgtcccttccattaaggctgggaacgacatcgccgcatgcctgcgcaaaaatggaaagaaagtgattcaactctcacgaaagacttttgattctgaatacgtgaaaacaagaaccaacgactgggatttcgtcgtaacgactgacatcagcgagatgggcgccaattttaaggctgagcgggtgatagatccaaggcgctgtatgaaacccgttatcttaacagacggcgaagagcgtgtgattctggcggggcctatgccggtcacccatagttccgccgcacagagacggggaaggatcggtcgcaacccaaagaatgaaaacgaccagtacatttatatgggcgagccccttgaaaatgatgaggactgcgctcactggaaggaggccaaaatgctgctcgataacatcaatacccctgaagggataattcccagcatgttcgagccagaacgagagaaggtggacgcaatcgatggagaatacagattgcggggcgaggccaggaaaacttttgttgacctgatgcgcagaggtgatctccctgtgtggctggcttataaggtcgccgcggaggggattaactacgcagacaggcggtggtgtttcgatggcatcaaaaacaatcagatacttgaagagaacgtggaagtagagatctggacaaaggagggagaacgtaagaaactaaagccccgctggctggacgcccgaatttattctgatccattggctttaaaagagtttaaggaattcgccgctggcagaaaatcactgaccctcaatctgatcacagagatggggaggcttcctactttcatgacgcaaaagacccgggacgcactggataacctcgccgtgttgcacacagctgaagccggaggtcgcgcatacaatcatgcgctgtccgagctaccggagactctggaaaccctccttctgttaacattgctggccaccgttactggcgggatttttctcttcctgatgagtggaagaggcatcggtaagatgacgcttgggatgtgctgcataattaccgctagcatcctgctctggtatgcccagatccagccccactggattgcagcttcgatcatattggagtttttcctgattgtcttactaatcccagaacctgagaaacagaggacaccccaagacaaccagctgacttacgtggtgattgccatcctcaccgtcgttgcagccacaatggctaatgaaatgggctttcttgagaagaccaaaaaggacctgggattgggctctatagcgactcagcagccagagtccaacatcctggatattgacctccggcctgccagcgcatggacactgtacgctgtggccacgaccttcgtaactcccatgcttcgacattcaatcgaaaatagttctgtgaacgtctccctcacagccattgcaaatcaagctaccgtgctgatggggttgggaaaaggttggccgctgagcaagatggatatcggcgttccattactagccattgggtgttattcacaggtgaaccctatcaccctgacagcggctctccttctgttggtcgcccactacgcaataattggacccggcctgcaggccaaggctactagagaggcacagaaacgcgccgcggctggtatcatgaagaatccaacggtagacgggatcaccgtgattgatctcgaccccataccttatgatccgaaatttgaaaagcaactgggccaggttatgcttttaatcctgtgcgtgacacaggtcctcatgatgaggactacctgggccttgtgtgaggcactgacactagccaccggacccattagtactctgtgggaaggcaacccagggcggttctggaatacgacaatcgctgtgagcatggccaacatttttcgtggatcctacctcgcaggcgctggtcttctgttctctatcatgaaaaataccactaacaccagaagggggacaggaaacataggcgagactttgggtgagaagtggaaaagccgcctgaatgccctcggcaagtccgaatttcaaatctataagaaatcagggattcaggaggtcgaccggaccctggcgaaggaaggaatcaaacgaggcgagacagatcaccatgccgtgtctagagggagtgcaaagttaaggtggttcgttgagcgcaacatggtgacgcctgaaggaaaagtagtggaccttggctgcggtcgggggggatggtcgtactattgtggcggtctgaagaatgtcagagaggttaagggcctcaccaaagggggacccggccacgaagagcctattccaatgagcacttacgggtggaacctagtgcgtctgcagtccggagtcgatgtgtttttcatcccccctgaaaagtgcgacacattgctgtgtgatataggcgagtcttcaccaaatcccaccgtagaggctggtaggactctccgggtgcttaacctggttgaaaattggttgaacaataacacacagttctgcattaaagtgctgaatccgtacatgcctagcgtcatcgagaagatggaagccctccaacgcaaatatgggggagcattagtgcgaaacccactgtccagaaatagtacccatgagatgtactgggtctctaacgctagcggcaatatcgtgtcatccgttaacatgattagtaggatgcttataaaccggtttacgatgcgccacaagaaggccacctatgaacccgacgtagacctgggcagcgggacaagaaatatcggaattgagtctgagatccctaacctagatattatcggtaaaaggatagaaaagatcaaacaggagcatgaaacttcctggcactacgaccaggatcacccatataagacctgggcctaccatggctcatatgagacaaaacagactgggagcgcgtcgtctatggtgaatggagtcgtgcgactcctgaccaagccctgggacgttttgccgacagtgacccaaatggctatgactgatacgacacctttcggccagcagcgggtctttaaggaaaaagtggacacccgtactcaggagcccaaggagggtaccaaaaagctgatgaaaattacagcagaatggctctggaaggagcttgggaaaaagaagacgccaagaatgtgtacccgcgaagagttcactaggaaagtacggagtaacgccgctctgggagccatctttacagatgagaataagtggaaatccgcaagagaagccgtggaggacagccgcttctgggaattagttgataaggagaggaacctgcacttggaaggcaaatgcgagacctgtgtctacaatatgatgggcaagcgagagaagaaactcggggaatttggaaaggctaaaggttcacgggcgatttggtacatgtggctgggcgccagattcctagagtttgaagcacttgggttcctgaacgaggaccattggttttccagggaaaattctctcagcggagtggagggcgagggtctgcacaagttggggtatatcctgcgcgatgtgagtaaaaaggaaggaggcgctatgtacgccgacgacactgcaggctgggatacacgtattaccctcgaggaccttaagaacgaagagatggtcacaaatcacatggaaggggagcataaaaagctggccgaggctatattcaaattaacttatcaaaacaaggttgtgcgggtacagagacctacccccaggggaacggtgatggatatcatttcccgccgagaccagcggggtagcggccaagtcgggacctacggactgaatacatttactaacatggaagcccagttgatcagacagatggagggcgaaggtgtgttcaaaaatatccagcacctcaccgttacagaggaggtggcggtccaaaactggctggcaagggtggggcgcgaaagactatctcggatggccatttcaggagatgactgcgtagttaagccacttgatgacaggttcgctaacgccctgactgcactcaatgatatgggcaagatacgtaaagacatccagcagtgggagcccagtaagggctggaacgattggacccaggtgcctttttgctcccatcacttccatgaactgattatgaaagacgggcgagtcttggtggtgccatgtcgcaatcaagatgagttaatcggaagagctcggattagccagggtgccggctggtctctgagggaaacggcttgcctcgggaagtcgtatgcccagatgtggtcacttatgtactttcaccgcagagacctgcggctagcagcgaacgccatctgtagcgctgtcccgtcccactgggttcccacaagtaggaccacttggtctatacatgccaaacacgagtggatgacaaccgaggacatgctgactgtgtggaatcgagtatggatccgtgaaaacccttggatggaggataagaccccagtggaaagctgggaggaaattccctatctcggaaagagagaggaccagtggtgcggctccttgatcggtctgacatcacgcgcaacgtgggctaaaaatattcaagccgcaatcaaccaggtccggagtcttatagggaatgaggaatacaccgattacatgccttctatgaagaggttcagacgcgaggaagaggaagccggagtgctgtggtga

SEQ ID NO: 14833 - RNA, 9876 nt, synthetic construct
  misc_feature 1..9876: note = derived and/or modified CDS sequence (opt3) from DENV-2__EU482652__SS-prME
  source 1..9876: mol_type = other RNA
agcgcaggaatgatcattatgctgataccaaccgtgatggctttccacctcactactcggaacggggagcctcatatgatcgtcggcattcaggaaaagggtaaatcccttctgtttaagacggaggacggagttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagcactggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctttgtgtacagggaagttcaaagtagttaaggagattgcagagacccagcacggaacaatcgtgatccgcgtccagtatgaaggcgatggttccccatgcaaaattcccttcgagatcatggacctcgaaaagagatacgtgctggggaggttaattactgtcaacccgatagtgaccgagaaagatagccctgttaacatcgaagctgagcccccatttggcgactcgtacattatcatcggagtggagcctggccaactgaagctaaattggttcaagaaagggtcttccattggacagatgtttgaaacgaccatgcggggtgccaagcgaatggctatactcggcgatacagcctgggacttcgggtcactgggaggcgtatttacaagtatcggtaaagcacttcatcaggtcttcggggccatttatggcgctgcgtttagcggagtgtcctggaccatgaagatcttgattggcgttatcataacatggatcgggatgaactctcgcagcacttcactgagtgtgtccctcgtcctggtgggaattgtaaccctttacctgggcgtgatggttcaggcagatagcggttgtgtcgtgtcttggaaaaataaggagttgaagtgcgggtcaggaatcttcattacggacaacgtgcacacatggaccgaacaatataaatttcagcccgagagtccaagcaagctcgcctccgctatccagaaagcccaggaagagggcatatgtggtattagatctgtcactaggctggagaatttaatgtggaagcaaatcacacccgaactgaaccacattctagcagagaatgaagttaaactcaccatcatgactggcgatataaaggggatcatgcaggccggaaaacggtcgctgcgccctcagccaaccgagcttaagtacagctggaagacatggggcaaagctaagatgttgtccacggaatcatataaccagaccttcctgattgacgggccggagactgccgagtgccccaatacaaacagagcatggaatagtctcgaagtggaggattacggatttggcgtgttcaccacaaacatctggctgaaattaaaggaaaaacaagacgcgttttgtgactctaagctgatgagcgctgccattaaggataatagggcagtacatgccgacatgggttattggatcgagtccgctcttaacgatacttggaaaatagagaaggcctcattcattgaagtcaaaaattgccactggcctaagagccataccttgtggtctaacggggtgctcgagtccgaaatgatcatccccaagaacctggcaggacccgttagtcagcacaattaccgtcctggctaccacacgcagattgctggtccatggcatctaggcaagctggagatggacttcgatttttgtgacgggacaaccgtgatcgtcactgaagattgcggaaaccggggccccagcctccgaaccacaactgcctctgggaagctgattaccgagtggtgctgtagatcctgcacacttccgcctttgaggtatcgcggagaggacggctgttggtacggtatggaaatacggccactgaaagagaaggaagagaatttagtgaactcactcgttacggcggggcacggacaagtggataatttcagtctgggcgtacttggtatggccctgtttttggaagagatgctcagaaccagggtcggcactaaacatgctatcctgctagtggcagtgagcttcgtcacactgattaccgggaacatgtcgtttaaggacctcggacgcgttgtggtaatggtgggcgccactatgacagatgacatcgggatgggagtcacctatctggctcttttggccgcattcaaagtgcgacccacgtttgcggccggcctgttactccggaagctgacttccaaggagcttatgatgaccacaattggtatcgttctgctatctcagagcgctatacctgaaaccgtgctcgagctgactgatgccttggcactggggatgatggtcttaaaaatcgtgcgtaatatggaaaagtaccagctcgctgttacaattatggccatcctgtgcgtgcccaacgcagtcattcttcagaatgcctggaaagtatcatgtaccatcctggctgtggttagtgtgtccccattgctcctgacatctagccaacagaagactgactggatacctctagcgctgaccattaaaggacttaaccccacggccatcttcctcacaaccctgtccagaactaataagaaaaggtcatggccattgaacgaggcaatcatggctgtcggcatggtgagcattctggccagttctttactcaagaatgacataccgatgaccggccctctggtagccgggggacttctgacagtgtgctatgtcttgactggtcgctccgctgatctcgaactggagcgggcaaccgacgttaagtgggaggatcaggccgaaatcagcggctcgtcacccattctatctatcacgattagtgaggacgggtccatgagcatcaaaaacgaagaggaggaacagacactgaccatacttatcagaactggactcctggtgatttctggcttgtttccaatcagcattcccatcacagcggctgcctggtacttatgggaggtgaagaaacaaagggccggtgtcctgtgggatgtgccttccccaccccctatggggaaggccgaactcgaggacggagcttatcgaataaaacagaagggcattctgggctactcacagatcggggcaggagtttacaaggaaggtaccttccacactatgtggcatgtaacacgcggcgccgtgcttatgcacaaagggaagcggatcgagccgagttgggcggatgtcaaaaaggacctgattagctatggaggcggttggaaattggagggggaatggaaggagggagaagaggtgcaggttctagctctggaaccaggcaagaatcccagagccgtgcaaaccaaacctggcctctttaagacgaacactgggaccatcggagcagtctctctggatttctccccaggtacatcaggcagtcccataattgacaaaaaggggaaagtggtaggactttacggcaacggtgtcgtgaccaggagcggggcctatgtttccgctatcgcccagacagagaagtctattgaggataatcctgaaatcgaggacgatatatttcgtaagcgccggttaactattatggacctgcacccgggagcaggcaaaaccaagagatacctccccgctatcgtgagggaagccatcaaacgaggcttgcggacgctgattctcgcgccaacacgcgtcgtggccgcagagatggaagaggctctgagagggcttcctatcaggtatcagactcccgccattcgggctgagcataccggacgagaaatagttgacctgatgtgtcacgcaacattcaccatgagattgctatcgccagtgcgcgtccctaactacaatctgatcattatggatgaggcccatttcactgaccccgccagcatcgctgcgaggggttatatctcaacccgtgtggaaatgggcgaggcagccgggatttttatgacagctacgccaccgggatcccgggatcctttcccccaaagtaacgccccaataatcgacgaggaaagagagattcccgaaaggtcttggaatagcggccacgagtgggtaactgattttaagggtaaaaccgtgtggttcgttccttccatcaaggcagggaacgacattgccgcttgcctccgcaagaatggcaagaaggtcatccagttatcacgaaaaacatttgattctgaatacgtgaagaccagaactaacgactgggatttcgtggtcacaaccgacataagcgagatgggcgcgaattttaaagccgagcgggtaatcgatccaaggcgctgtatgaagcccgtgattctgacggacggcgaagaacgtgttatccttgcagggcctatgccggtgactcatagttccgctgcccagagacggggaaggattggtcgcaaccccaaaaatgaaaacgaccagtacatctatatgggcgagcccctggaaaatgatgaggactgcgcacactggaaggaggccaagatgctcttggataacataaatacacctgaagggattatccccagcatgttcgagccagaacgagagaaagtcgacgctattgatggagaatacagactgcggggcgaggccaggaagacctttgtggacctcatgcgcagaggtgatctgcctgtttggcttgcgtataaagtggcagccgaggggatcaactacgctgacaggcggtggtgtttcgatggcataaagaacaatcaaatcctagaagagaacgtcgaagtggagatttggaccaaagagggagaacgtaagaagctgaaaccccgctggttggacgcccgaatctattctgatccattagctctgaaggagtttaaagagttcgcagccggcagaaagtcactcactctgaatcttattacagagatggggaggctgcctaccttcatgacacagaaaactcgggacgctctcgataacttggccgtactgcacacggcagaagcgggaggtcgcgcctacaatcatgctctatccgagctgccggagaccctcgaaacacttctgttattgactctgctcgccaccgtgacaggcgggatctttctgttccttatgagtggaagaggcataggtaagatgaccctggggatgtgctgcattatcactgcaagcacgctcttgtggtatgctcagatccagccccactggattgccgcatcgatcatactggagtttttcttaattgttctactgatcccagaacctgagaagcaaaggaccccacaggacaaccagctcacatacgtcgtgattgccatccttactgtggtcgctgcgaccatggccaatgaaatgggctttctggagaaaacaaagaaagacttgggactgggctctatagcaacccagcaaccagagtccaacatcctcgatattgacctgcggcctgctagcgcctggactctttacgccgttgcaacaacgttcgtgacccccatgctccgacattcaatcgaaaatagttctgtaaacgtgtccctgactgctattgccaatcaggcgacagtcttgatggggctgggaaagggttggccgttaagcaaaatggatatcggcgtgccactactggctattgggtgttattcacaggttaaccctatcaccctcaccgccgcacttctgttgctggtggcccactacgctataattggacccggcctccaggcaaaggccacaagagaggcgcaaaagcgcgctgccgcaggtatcatgaaaaatccaactgtcgacgggatcacggtaattgatctggaccccataccttatgatccgaagtttgaaaaacagcttggccaggtgatgttactgatcctctgcgttacccaagtgttgatgatgaggacaacttgggccctgtgtgaggctctaaccctggccacaggacccattagtaccctctgggaaggcaacccagggcggttctggaatactacgatcgcagtcagcatggctaacatttttcgtggatcctaccttgccggcgcgggtctgttgttctctatcatgaagaatacaaccaacactagaagggggaccggaaacatgggcgagacactgggtgagaaatggaaaagccgcctcaatgccctgggcaaatccgaatttcagatatataagaagtcagggatccaggaggtggaccggactttagcaaaagaaggaattaagcgaggcgagaccgatcaccatgctgtctctagagggagtgccaaacttaggtggttcgtggagcgcaacatggttacacctgaaggaaaggtggtagacctgggctgcggtagagggggatggtcgtactattgtggcggtctcaaaaatgtgagagaggtcaagggcctaacgaaagggggacccggccacgaagaacctatcccaatgagcacctacgggtggaacctggttcgtttgcagtccggagtggatgtctttttcattccccctgaaaaatgcgacactctgctctgtgatatcggcgagtcttcaccaaatcccacagtggaggcaggtaggacccttcgggtactgaacttggtggaaaattggctgaacaataacactcaattctgcataaaggttctcaatccgtacatgcctagcgtgattgagaaaatggaggctttacagcgcaagtatgggggagccctggtccgaaacccactttccagaaatagtacacatgagatgtactgggtgtctaacgccagcggcaatatcgtctcatccgtgaacatgatcagtaggatgctgattaaccggtttaccatgcgccacaaaaaggcgacgtatgaacccgacgttgacctaggcagcgggaccagaaatataggaatcgagtctgagattcctaacctcgatatcattggtaagaggatcgagaaaataaagcaggagcatgaaacatcctggcactacgaccaggatcacccatataaaacttgggcttaccatggctcatatgagaccaagcaaacagggagcgcatcgtctatggtaaatggagtggtccgactgttgactaaaccctgggacgtgctgccgaccgttacacagatggccatgaccgatactacgcctttcggccagcagcgggtgtttaaggaaaaggtcgacacacgtacccaagagcccaaagagggtactaagaaactcatgaagatcaccgctgaatggctttggaaagagctggggaagaaaaagacaccaagaatgtgtacgcgcgaagagttcaccaggaaggtgcggagtaacgccgcattaggagccatttttactgatgagaataaatggaagtccgctagagaagcggtagaggacagccgcttctgggaactggtggataaagagaggaacttgcacctcgaaggcaagtgcgagacatgtgtttacaatatgatgggcaaacgagagaagaagctgggggaatttggaaaagccaagggttcacgggcaatctggtacatgtggctaggcgctagattccttgagtttgaagccctggggttcctcaacgaggaccattggttttccagggaaaattctctgagcggagtcgagggcgagggtttgcacaaactggggtatattctccgcgatgtgagtaagaaagaaggaggcgcaatgtacgccgacgacaccgctggctgggatactcgtatcacacttgaggacctgaagaacgaagagatggtgaccaatcacatggaaggggagcataagaaattagccgaggcgattttcaagctgacatatcagaacaaagtcgttcgggtgcagagacctactcccaggggaaccgtaatggatataatctcccgccgagaccaacggggtagcggccaggtggggacgtacggattgaatacctttacaaacatggaagcacagctcattagacagatggagggcgaaggtgtcttcaagaatatccaacacctgactgtgaccgaggaggttgccgtgaaaaactggctagctagggtcgggcgcgaaagactttctcggatggccatctcaggagatgactgcgtggtaaagccactggatgacaggttcgcaaacgctctcacagccctgaatgatatgggcaagattcgtaaagacatacagcagtgggagcccagtaagggctggaacgattggactcaggttcctttttgctcccatcacttccatgaattgatcatgaaagacgggcgagtgttagtcgtgccatgtcgcaatcaagatgagctgattggtagagctcggatcagccagggagccggctggtctctcagggaaaccgcatgccttgggaagtcgtatgcgcagatgtggtcactgatgtactttcaccgcagagacctacggctggccgctaacgccatttgtagcgcagtgccgtcccactgggtccccacgagtaggacaacctggtctatccatgctaaacacgagtggatgactacagaggacatgctcaccgtttggaatcgagtgtggatacgtgaaaacccttggatggaggataagactccagtagaaagctgggaggaaatcccctatttgggaaagagagaggaccagtggtgcggctccctgattggtcttacctcacgcgccacatgggccaaaaatatccaagccgcgattaaccaggtgcggagtctgatcgggaatgaggaatacgctgattacatgccttctatgaagaggttcagacgcgaggaagaggaagccggagtcctctggtga

SEQ ID NO: 14834 - RNA, 9876 nt, synthetic construct
  misc_feature 1..9876: note = derived and/or modified CDS sequence (opt3) from DENV-2__EU482653__SS-prME
  source 1..9876: mol_type = other RNA
agcgcaggaatgatcattatgctgataccaaccgtgatggctttccacctcactactagaaacggggaacctcatatgatcgtcggtattcaagaaaagggaaaatcccttctgtttaagacggaagacggcgttaatatgtgcaccttgatggcaatggatttaggggaactgtgtgaagacactatcacttacaaatgcccacttctcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcgtgacggacaacgtccacacatggaccgaacagtataagtttcaacccgagagtccaagcaaattggcctccgctattcagaaggcccaggaagagggcatctgtggtataagatctgttactaggctcgagaatctgatgtggaaacagattacacccgaattaaaccacatcctggcagagaatgaagtgaagctaaccattatgactggcgatatcaaagggataatgcaagccggaaagcggtcgctccgccctcagccaaccgagctgaagtacagctggaaaacatggggcaaggctaaaatgctttccacggaatcacataaccagaccttcttgatcgacgggccggagactgccgagtgccccaatacaaacagagcatggaatagtctggaagtggaggattatggatttggcgtattcaccacaaacatttggctcaggctgaaggaaaaacaggacgcgttttgtgactctaagttaatgagcgctgccatcaaggataatcgtgcagtccacgccgacatgggttactggattgagtccgctctgaacgatacttggaaaatcgagaaggcctcattcatagaagtgaaaaattgccattggcctaagagccacaccctttggtctaacggggttttggagtccgaaatgattatccccaagaacctcgcaggacccgtgagtcaacacaattatcggcctggctaccatacgcagatcgctggtccatggcacctgggcaagctagagatggacttcgatttttgtgacgggacaaccgtcattgtgactgaagattgcggaaaccgaggccccagcctgagaaccacaactgcctctgggaagctcatcaccgagtggtgctgtaggtcctgcacactgccgcctcttcgctaccggggagaggacggctgttggtatggtatggaaattagaccattgaaagagaaggaagagaatctggttaactcattagtgacggcggggcatggacaggtagataatttcagtctcggcgtcctgggtatggccctttttctggaagagatgttgaggacccgcgtgggcactaaacacgctatactcctggtggcagtcagcttcgttacactaatcaccgggaacatgtcgtttaaggacctgggacgagtggtagtgatggtcggcgccactatggctgatgacattgggatgggagtgacatacctcgccctgcttgcagcgttcaaagttcggcccacctttgccgctggcttgctgttacgtaagctcacgtccaaggagctgatgatgactaccatcggtattgtgcttctgtctcaaagcacaatccctgaaaccgtcctagagctcactgatgccctggcattggggatgatggtgctgaaaatagttagaaatatggaaaagtatcagttagctgtgacaatcatggccattctctgcgtccccaacgcagtaatcctgcagaatgcctggaaagtgtcatgtaccattcttgctgttgtgagtgtctccccactgttgctcacatctagccagcaaaagactgactggatccctctggcgctaaccataaaaggactgaaccccacggccattttccttacaaccctctccaggactaataagaaacgctcatggccactgaacgaggcaatcatggctgtgggcatggtaagcatcttggccagttctctgttaaagaatgacattccgatgaccggccctctcgtggccgggggactgcttacagtctgctacgttctgactggtcggtccgctgatttggaactcgagagagcaaccgacgtgaagtgggaggatcaggccgaaataagcggctcgtcacccatcctgtctattacgatcagtgaggacgggtccatgagcattaaaaacgaagaggaggaacagacactaaccatcctgataaggactggacttctcgtgatctctggcctgtttccaattagcatccccattacagcggctgcctggtatttgtgggaggtcaagaaacagcgagccggtgtgttatgggatgttccttccccaccccctatggggaaggccgaactggaggacggagcttaccgcatcaaacaaaagggcatattcggctattcacagattggggcaggagtatacaaggaaggtacctttcatactatgtggcacgtgacacggggcgccgtcctcatgcacaaagggaagagaatcgagccgagttgggcggatgtgaaaaaggacctgatcagctacggaggcggttggaaacttgagggggaatggaaggagggagaagaggttcaggtgctggctttggaaccaggcaagaatcccagggccgtccagaccaaacctggcctattcaagacgaacactgggaccattggagcagtgtctctggatttttccccaggtacatcaggcagtcccatcatagacaaaaaggggaaagtagtcggactctatggcaacggtgtggttacccgtagcggggcctacgtgtccgctattgcccaaacagagaagtctatcgaggataatcctgaaattgaggacgatatcttccgcaagcggagactgactataatggaccttcatccgggagcaggcaaaaccaagaggtatttacccgctattgtccgagaagccatcaaacggggcctgcgcacgctcatcttggcgccaacaagagtggttgccgcagagatggaagaggctctgagggggctccctattcggtaccagactcccgccatccgagctgagcacaccggaagagaaattgtggacctgatgtgtcatgcaacattcaccatgcgccttctgtcgccagtcagggtgcctaactataatttgataatcatggatgaggcccactttactgaccccgccagcattgctgcgcgtggttacatctcaacccgggtagaaatgggcgaggcagccgggatcttcatgacagctacgccaccgggatccagagatccttttccccagagtaacgccccaattatagacgaggaaagggagatccccgaacgctcttggaatagcggccatgagtgggtgactgatttcaagggtaaaaccgtttggtttgtcccttccattaaggcagggaacgacatcgccgcttgcctacgaaagaatggcaagaaggtgattcaactgtcaagaaaaacattcgattctgaatatgtgaagacccggactaacgactgggattttgtcgtaacaaccgacatcagcgagatgggcgcgaatttcaaagccgagagggtgatagatccacgccgttgtatgaagcccgttatcctcacggacggcgaagagagagtgattttagcagggcctatgccggtcactcacagttccgctgcccagcggaggggacgcatcggtcgaaaccccaagaatgaaaacgaccagtacatttacatgggcgagcccctggaaaatgatgaggactgcgcacactggaaggaggccaagatgcttctggataacatcaatacacctgaagggataattcccagcatgtttgagccagaaagagagaaagtggacgctatcgatggagaatatcggctcaggggcgaggcccgcaagaccttcgttgacttgatgagaaggggtgatctgcctgtgtggctcgcgtacaaagtcgcagccgaggggattaactatgctgaccggcgttggtgttttgatggcatcaagaacaatcagatactggaagagaacgtggaagtagagatctggaccaaagagggagaacgcaagaaacttaaaccccgatggctagacgccagaatttactctgatccactggctttgaaggagttcaaagagttcgcagccggcaggaagtcattaactctgaatctcatcacagagatggggcggctgcctacctttatgacacagaaaactcgcgacgctcttgataacctggccgtgctccatacggcagaagcgggaggtagagcctataatcacgctttgtccgagctgccggagaccctagaaacactgctccttctgactttattggccaccgttacaggcgggattttcctgtttctcatgagtggaaggggcatcggtaagatgaccctggggatgtgctgcataattactgcaagcatccttctgtggtacgctcagatccagccccattggattgccgcatcgatcatactcgagttctttttgattgtcctgttaatcccagaacctgagaagcagcggacgccccaagacaaccagctaacctatgtggtgattgccatcctgacagtcgttgctgcgactatggccaatgaaatgggcttcctcgagaaaaccaagaaagaccttggactgggctctatagcaacacagcagccagagtccaacatcttggatattgacctgcgacctgctagcgcctggaccctctacgccgtggcaactacatttgtaacgcccatgctgagacactcaatcgaaaatagttctgtgaacgtctcccttaccgctattgccaatcaagcgactgtgctcatggggctgggaaagggttggccgttgagcaaaatggatatcggcgttccactgttagctattgggtgttactcacaggtgaaccctatcacactaaccgccgcactgctccttctggtcgcccactatgctataattggacccggcttgcaggcaaaggccacccgcgaggcgcagaagagggctgccgcaggtatcatgaaaaatccaacagtagacgggatcactgtgattgatctggaccccataccttacgatccgaagttcgaaaaacaactcggccaggttatgctgcttatcttatgcgtgacgcaggtcctgatgatgcggaccacatgggccctctgtgaggctttgactctggccaccggacccattagtacactatgggaaggcaacccagggcgtttttggaataccactatcgcagtgagcatggctaacattttcagaggatcctatctggccggcgcgggtctcctattttctatcatgaagaatacgacaaacgccaggcgcgggaccggaaacatgggcgagactctgggtgagaaatggaaaagccggttgaatgcactgggcaaatccgagttccaaatatacaagaagtcagggatccaggaggtcgaccgaaccctcgctaaagaaggaattaagagaggcgagacagatcatcacgccgtgtctagggggagtgcaaaactgcgctggtttgttgagcggaacatggtgactcctgaaggaaaggtagtggacttaggctgcggtagagggggatggtcgtattactgtggcggtcttaaaaatgtccgtgaggttaagggcctgaccaaagggggacccggccatgaagaacctatcccaatgagcacatatgggtggaacctcgtgaggctacagtccggagtcgatgtgttcttcattccccctgaaaaatgcgacacgctgttgtgtgatatcggcgagtcttcaccaaatcccaccgtagaggctggtcggactctgcgcgtgctcaaccttgttgaaaattggctgaacaataacacacagttttgcataaaggtgttgaatccgtacatgcctagcgtcattgagaaaatggaagccctgcaacgaaagtacgggggagccctcgtgagaaacccattatccaggaatagtacccacgagatgtattgggtctctaacgcgagcggcaatatcgtgtcatccgttaacatgatcagtcggatgctgattaaccgcttcactatgagacataaaaaggctacatacgaacccgacgtagaccttggcagcgggaccaggaatataggaatcgagtctgagattcctaacctggatatcattggtaagcgaatcgagaaaataaagcaggagcacgaaacgtcctggcactatgaccaggatcatccatacaaaacctgggcatatcacggctcatacgagacaaagcagactgggagcgcctcgtctatggtgaatggagtcgtgcggctactcaccaaaccctgggacgttctgccgacagtgactcaaatggctatgaccgatacaaccccttttggccagcagcgtgtcttcaaggaaaaggtggacactagaacgcaggagcccaaagagggtacaaagaaattgatgaagatcaccgccgaatggctgtggaaagagctcgggaagaaaaagactccacgcatgtgtaccagggaagagtttacacggaaggtaagaagtaacgcagcccttggagctattttcacggatgagaataaatggaagtccgcgcgcgaagccgtggaggacagcaggttttgggaactggttgataaagagcgaaacttacatctggaaggcaagtgcgagacctgtgtctataatatgatgggcaaacgggagaagaagttgggggagttcggaaaagcaaagggttcaagagctatctggtacatgtggctcggcgccaggtttctggagttcgaagcactagggtttcttaacgaggaccactggttctcccgcgaaaattctctgagcggagtggagggcgagggtctccacaaactggggtacattttgcgtgatgtgagtaagaaagaaggaggcgccatgtatgctgacgacactgccggctgggatacacggatcaccctggaggacctcaagaacgaagagatggtcactaatcatatggaaggggagcacaagaaacttgcggaggcaatttttaagctgacataccaaaacaaagttgtgagagtacagaggcctaccccacgcggaacagtgatggatataatctcccgacgggaccagagaggtagcggccaagtcgggacttatggattaaataccttcacgaacatggaagcccagctgattaggcagatggagggcgaaggtgtgttcaagaatatccagcatttgaccgttacagaggaggtggctgtccaaaactggctcgcccgcgtggggagagaacggctgtctaggatggcaatctcaggagatgactgcgtagttaaaccactagatgaccgttttgctaacgcccttactgctctgaatgatatgggcaagattcgaaaggacatacagcagtgggagcccagtaaaggctggaacgattggacccaggtgcctttctgctcccaccattttcacgaactcatcatgaaggacgggcgcgtcctggtggtgccatgtagaaatcaagatgagttgattggacgggccaggatcagccagggtgcaggctggtctttacgcgaaacagcgtgcctggggaaatcgtacgcccagatgtggtcactcatgtatttccacagacgggaccttaggctggctgccaacgcaatttgtagcgctgtcccgtcccattgggttcccacaagtcgaaccacgtggtctatccacgccaagcatgagtggatgacaaccgaggacatgctaactgtgtggaatcgtgtatggataagagaaaacccttggatggaggataaaacaccagtggaaagctgggaggaaatcccctacctgggaaagcgcgaggaccagtggtgcggctccctcattggtttgacctcacgggcaacttgggccaagaatatccaagcggctattaaccaggtcaggagtctgatcgggaatgaggaatataccgattacatgccttctatgaaaagatttcgccgggaggaagaggaagccggagtgctttggtga

SEQ ID NO: 14835 - RNA, 9876 nt, synthetic construct
  misc_feature 1..9876: note = derived and/or modified CDS sequence (opt3) from DENV-2__EU482654__SS-prME
  source 1..9876: mol_type = other RNA
agcgccggaatgatcattatgctgataccaaccgtgatggctttccacctcactactcggaacggggagcctcatatgatcgtcggcattcaggaaaagggtaaatcccttctgtttaagacggaggacggagttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccaattaaagctgaattggttcaagaaagggtcttccattggacagatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacaatataaatttcagcccgagagtccaagcaagttggcctccgctatccagaaagcccaggaagagggcatatgtggtattagatctgtcactaggctcgagaatctgatgtggaagcaaatcacacccgaattaaaccacattctggcagagaatgaagttaaaatgaccatcatgactggcgatataaaggggatcatgcaggccggaaaacggtcgctacgccctcagccaaccgagctcaagtacagctggaagacatggggcaaagctaagatgctgtccacggaatcatataaccagaccttccttattgacgggccggagactgccgagtgccccaatacaaacagagcatggaatagtttggaagtggaggattacggatttggcgtgttcaccacaaacatctggctgaaactcaaggaaaaacaagacgcgttttgtgactctaagctgatgagcgctgccattaaggataatagggcagtacatgccgacatgggttattggatcgagtccgctttaaacgatacttggaaaatagagaaggcctcattcattgaagtcaaaaattgccactggcctaagagccataccctgtggtctaacggggtgcttgagtccgaaatgatcatccccaagaacttggcaggacccgttagtcagcacaattaccgtcctggctaccacacgcagattgctggtccatggcatctcggcaagctggagatggacttcgatttttgtgacgggacaaccgtgatcgtcactgaagattgcggaaaccggggccccagcctacgaaccacaactgcctctgggaagctgattaccgagtggtgctgtagatcctgcacactcccgcctctgaggtatcgcggagaggacggctgttggtacggtatggaaatacggccacttaaagagaaggaagagaatttggtgaactcactggttacggcggggcacggacaagtggataatttcagtttaggcgtactcggtatggccctgtttcttgaagagatgctgagaaccagggtcggcactaaacatgctatcttgctcgtggcagtgagcttcgtcacactgattaccgggaacatgtcgtttaaggacctaggacgcgttgtggtaatggtgggcgccactatggctgatgacatcgggatgggagtcacatatctggccctcctggcagcgttcaaagtgcgacccacctttgccgctggccttttgctgcggaagttaacgtccaaggagctcatgatgactaccattggtatcgttctgctttctcagagcacaatacctgaaaccgtgctggagctaactgatgccctcgcactggggatgatggtcttgaaaatcgtgcgtaatatggaaaagtaccagctggctgttacaattatggccatcttatgcgtgcccaacgcagtcattctccagaatgcctggaaagtatcatgtaccatcctggctgtggttagtgtgtccccacttctgttgacatctagccaacagaagactgactggatacctctcgcgctgaccattaaaggactaaaccccacggccatcttcctgacaaccctttccagaactaataagaaaaggtcatggccactcaacgaggcaatcatggctgtcggcatggtgagcattctggccagttctttgctgaagaatgacataccgatgaccggccctttagtagccgggggactcctgacagtgtgctatgtccttactggtcgctccgctgatctggaattggagcgggcaaccgacgttaagtgggaggatcaggccgaaatcagcggctcgtcacccattctctctatcacgattagtgaggacgggtccatgagcatcaaaaacgaagaggaggaacagacactgaccatactaatcagaactggactgcttgtgatttctggcctctttccaatcagcattcccatcacagcggctgcctggtacctgtgggaggtgaagaaacaaagggccggtgtcttgtgggatgtgccttccccaccccctatggggaaggccgaattagaggacggagcttatcgaataaaacagaagggcattctgggctactcacagatcggggcaggagtttacaaggaaggtaccttccacactatgtggcatgtaacacgcggcgccgtgctcatgcacaaagggaagcggatcgagccgagttgggcggatgtcaaaaaggacctgattagctatggaggcggttggaaacttgagggggaatggaaggagggagaagaggtgcaggttctggctttggaaccaggcaagaatcccagagccgtgcaaaccaaacctggcctatttaagacgaacactgggaccatcggagcagtctctctggatttctccccaggtacatcaggcagtcccataattgacaaaaaggggaaagtggtaggactctacggcaacggtgtcgtgaccaggagcggggcctatgtttccgctatcgcccagacagagaagtctattgaggataatcctgaaatcgaggacgatatatttcgtaagcgccggctgactattatggaccttcacccgggagcaggcaaaaccaagagatacttacccgctatcgtgagggaagccatcaaacgaggcctgcggacgctcattttggcgccaacacgcgtcgtggccgcagagatggaagaggctctgagagggctccctatcaggtatcagactcccgccattcgggctgagcataccggacgagaaatagttgacctgatgtgtcacgcaacattcaccatgagacttctgtcgccagtgcgcgtccctaactacaatttgatcattatggatgaggcccatttcactgaccccgccagcatcgctgcgaggggttatatctcaacccgtgtggaaatgggcgaggcagccgggatttttatgacagctacgccaccgggatcccgggatcctttcccccaaagtaacgccccaataatcgacgaggaaagagagattcccgaaaggtcttggaatagcggccacgagtgggtaactgattttaagggtaaaaccgtgtggttcgttccttccatcaaggcagggaacgacattgccgcttgcctacgcaagaatggcaagaaggtcatccagctgtcacgaaaaacatttgattctgaatacgtgaagaccagaactaacgactgggatttcgtggtcacaaccgacataagcgagatgggcgcgaattttaaagccgagcgggtaatcgatccaaggcgctgtatgaagcccgtgattctcacggacggcgaagaacgtgttatcttagcagggcctatgccggtgactcatagttccgctgcccagagacggggaaggattggtcgcaaccccaagaatgaaaacgaccagtacatctatatgggcgagcccctggaaaatgatgaggactgcgcacactggaaggaggccaagatgcttctggataacataaatacacctgaagggattatccccagcatgttcgagccagaacgagagaaagtcgacgctattgatggagaatacagactccggggcgaggccaggaagacctttgtggacttgatgcgcagaggtgatctgcctgtttggctcgcgtataaagtggcagccgaggggatcaactacgctgacaggcggtggtgtttcgatggcataaagaacaatcaaatcctggaagagaacgtcgaagtggagatttggaccaaagagggagaacgtaagaaacttaaaccccgctggctagacgcccgaatctattctgatccactggctttgaaggagtttaaagagttcgcagccggcagaaagtcattaactctgaatctcattacagagatggggaggctgcctaccttcatgacacagaaaactcgggacgctcttgataacctggccgtactccacacggcagaagcgggaggtcgcgcctacaatcatgctttgtccgagctgccggagaccctagaaacactgctccttctgactttattggccaccgtgacaggcgggatctttctgttcctcatgagtggaagaggcataggtaagatgaccctggggatgtgctgcattatcactgcaagcatccttctgtggtatgctcagattcagccccactggatcgccgcatcgataattctcgagtttttcttgatcgttctgttaattccagaacctgagaagcaaaggacgccccaggacaaccagctaacctacgtcgtgatcgccatactgacagtggtcgctgcgactatggccaatgaaatgggctttctcgagaaaaccaagaaagaccttggactgggctctatcgcaacacagcaaccagagtccaacattttggatatcgacctgcggcctgctagcgcctggaccctctacgccgttgcaactacattcgtgacgcccatgctgcgacattcaattgaaaatagttctgtaaacgtgtcccttaccgctatcgccaatcaggcgactgtcctcatggggctgggaaagggttggccgttgagcaaaatggatattggcgtgccactgttagctatcgggtgttattcacaggttaaccctataacactaaccgccgcactgctccttctggtggcccactacgctattatcggacccggcttgcaggcaaaggccaccagagaggcgcaaaagcgcgctgccgcaggtatcatgaaaaatccaacagtcgacgggattactgtaatagatctggaccccatcccttatgatccgaagtttgaaaaacagctcggccaggtgatgctgcttattttatgcgttacgcaagtgctgatgatgaggaccacatgggccctctgtgaggctttgactctggccaccggacccatcagtacactatgggaaggcaacccagggcggttctggaataccactattgcagtcagcatggctaacatctttcgtggatcctacctggccggcgcgggtctccttttctctataatgaagaatacgacaaacaccagaagggggactggaaacatgggcgagaccctgggtgagaaatggaaaagccgcttgaatacactgggcaaatccgaatttcagatctataagaagtcagggattcaggaggtggaccggactctcgccaaagaaggaatcaagcgaggcgagaccgatcaccatgcagtctctagagggagtgctaaactgaggtggttcgtggagcgcaacatggttacacctgaaggaaaggtggtagacttaggctgcggtagagggggatggtcgtactattgtggcggtcttaaaaatgtgagagaggtcaagggcctgacgaaagggggacccggccacgaggaacctattccaatgagcacctacgggtggaacctcgttcgtctacagtccggagtggatgtctttttcatcccacctgaaaaatgcgacactctgttgtgtgatataggcgagtcttcaccaaatcccacagtggaggccggtaggaccctgcgggtactcaaccttgtggaaaattggctgaacaataacactcaattctgcattaaggttttgaatccgtacatgcctagcgtgatcgagaaaatggaagcactgcagcgcaagtatgggggagctctcgtccgaaacccattatccagaaatagtacacatgagatgtactgggtgtctaacgccagcggcaatatcgtctcatccgtgaacatgattagtaggatgctgataaaccggtttaccatgcgccacaaaaaggccacgtatgaacccgacgttgaccttggcagcgggaccagaaatatcggaattgagtctgagacacctaacctggatatcattggtaagaggatcgagaaaataaagcaggagcatgaaacttcctggcactacgaccaggatcacccatataaaacctgggcgtaccatggctcatatgagacaaagcaaactgggagcgcttcgtctatggtaaatggagtggtccgactactcaccaaaccctgggacgtgctgccgacagttacccagatggcaatgactgatacgacacctttcggccagcagcgggtgtttaaggaaaaggtcgacacccgtactcaagagcccaaagagggtaccaagaaattgatgaagatcacagccgaatggctgtggaaagagctcgggaagaaaaagacgccaagaatgtgtacccgcgaagagttcactaggaaggtgcggagtaacgctgcccttggagcaatttttacagatgagaataaatggaagtccgccagagaagctgtagaggacagccgcttctgggaactggtggataaagagaggaacttacacctggaaggcaagtgcgagacctgtgtttacaatatgatgggcaaacgagagaagaagttgggggaatttggaaaagcgaagggttcacgggccatctggtacatgtggctcggcgcaagattcctggagtttgaagctctagggttccttaacgaggaccattggttttccagggaaaattctctgagcggagtcgagggcgagggtctccacaaactggggtatattttgcgcgatgtgagtaagaaagaaggaggcgccatgtacgcagacgacactgccggctgggatacacgtatcaccctggaggacctcaagaacgaagagatggtgacaaatcacatggaaggggagcataagaaacttgctgaggccattttcaagctgacttatcagaacaaagtcgttcgggtgcagagacctacccccaggggaacggtaatggatataatctcccgccgagaccaacggggtagcggccaggtggggacctacggattaaatacatttactaacatggaagcgcagctgattagacagatggagggcgaaggtgtcttcaagaatatccaacacttgaccgtgacagaggaggttgcagtgcagaactggctcgccagggtcgggcgcgaaagactgtctcggatggctatctcaggagatgactgcgtggtaaaaccactagatgacaggttcgccaacgcacttactgctctgaatgatatgggcaagattcgtaaggacatacagcagtgggagcccagtaaaggctggaacgattggacccaagttcctttttgctcccatcacttccatgaactcatcatgaaggacgggcgagtgctggtcgtgccatgtcgcaatcaggatgagttgattggtagagcacggatcagccagggagctggctggtctttaagggaaacggcctgcctggggaaatcgtatgcacagatgtggtcactcatgtactttcaccgcagagaccttcggctggcggccaacgctatttgtagcgccgtgccgtcccactgggtccccacaagtaggaccacttggtctatccatgcaaagcacgagtggatgacaaccgaggacatgctaactgtttggaatcgagtgtggatacgtgaaaacccttggatggaggataaaaccccagtagaaagctgggaggaaatcccctatctgggaaagagagaggaccaatggtgcggctccctcattggtttgacatcacgcgctacgtgggccaagaatatccaggcagccattaaccaggtgcggagtctgatcgggaatgaggaatacaccgattacatgccttctatgaaaaggttcagacgcgaggaagaggaagcgggagtcctttggtga

SEQ ID NO: 14836 - RNA, 9876 nt, synthetic construct
  misc_feature 1..9876: note = derived and/or modified CDS sequence (opt3) from DENV-2__EU482656__SS-prME
  source 1..9876: mol_type = other RNA
agcgcaggaatgatcattatgctgataccaaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacacgatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaagacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcgtgacggacaacgtccacacatggaccgaacagtataagtttcaacccgagagtccaagcaaattggcctccgctattcagaaggcccaggaagagggcatctgtggtataagatctgttactaggctcgagaatctgatgtggaaacagattacacccgaattaaaccacatcctggcagagaatgaagtgaagctaaccattatgactggcgatatcaaagggataatgcaagccggaaagcggtcgctccgccctcagccaaccgagctgaagtacagctggaaaacatggggcaaggctaaaatgctttccacggaatcacataaccagaccttcttgatcgacgggccggagactgccgagtgccccaatacaaacagagcatggaatagtctggaagtggaggattatggatttggcgtattcaccacaaacatttggctcaagctgaaagaaaagcaggacgcgttttgtgactctaagttaatgagcgctgccatcaaagataatagggcagtccacgccgacatgggttactggattgagtccgctctgaacgatacttggaagatcgagaaagcctcattcatagaagtgaagaattgccattggcctaaaagccacaccctttggtctaacggggttttggagtccgaaatgattatcccaaagaacctcgcaggacccgtgagtcaacacaattatcgtcctggctaccatacgcagatcgctggtccatggcacctgggcaagctagagatggacttcgatttttgtgacgggacaaccgtcattgtgactgaagattgcggaaaccggggccccagcctgcgaaccacaactgcctctgggaaactcatcaccgagtggtgctgtagatcctgcacactgccgcctcttaggtaccgcggagaggacggctgttggtatggtatggaaattcggccattgaaggagaaagaagagaatctggttaactcattagtgacggcggggcatggacaggtagataatttcagtctcggcgtcctgggtatggccctttttctggaagagatgttgagaaccagggtgggcactaagcacgctatactcctggtggcagtcagcttcgttacactaatcaccgggaacatgtcgtttaaagacctgggacgcgtggtagtgatggtcggcgccactatggctgatgacattgggatgggagtgacatacctcgccctgcttgcagcgttcaaggttcgacccacctttgccgctggcttgctgttacggaagctcacgtccaaagagctgatgatgactaccatcggtattgtgcttctgtctcaaagcacaatccctgaaaccgtcctagagctcactgatgccctggcattggggatgatggtgctgaagatagttcgtaatatggaaaaatatcagttagctgtgacaatcatggccattctctgcgtccccaacgcagtaatcctgcagaatgcctggaaggtgtcatgtaccattcttgctgttgtgagtgtctccccactgttgctcacatctagccagcagaagactgactggatccctctggcgctaaccataaagggactgaaccccacggccattttccttacaaccctctccagaactaataaaaagaggtcatggccactgaacgaggcaatcatggctgtgggcatggtaagcatcttggccagttctctgttaaagaatgacattccgatgaccggccctctcgtggccgggggactgcttacagtctgctacgttctgactggtcgctccgctgatttggaactcgagcgggcaaccgacgtgaaatgggaggatcaggccgaaataagcggctcgtcacccatcctgtctattacgatcagtgaggacgggtccatgagcattaagaacgaagaggaggaacagacactaaccatcctgataagaactggacttctcgtgatctctggcctgtttccaattagcatccccattacagcggctgcctggtatttgtgggaggtcaaaaagcagagggccggtgtgttatgggatgttccttccccaccccctatggggaaagccgaactggaggacggagcttaccgaatcaagcaaaagggcatactcggctattcacagattggggcaggagtatacaaagaaggtaccttccatactatgtggcacgtgacacgcggcgccgtcctgatgcacaaggggaaacggatcgagccgagttgggcggatgtgaagaaagaccttatcagctacggaggcggttggaagctggagggggaatggaaggagggagaagaggttcaggtgttggctctagaaccaggcaaaaatcccagagccgtccagaccaagcctggcctgtttaaaacgaacactgggaccattggagcagtgtctctcgatttctccccaggtacatcaggcagtcccatcatagacaagaaagggaaggtagtcggactgtatggcaacggtgtggttaccaggagcggggcctacgtgtccgctattgcccaaacagagaagtctatcgaggataatcctgaaattgaggacgatatctttcgtaaacgccggcttactataatggacttacatccgggagcaggcaagaccaaaagatatctgcccgctattgtcagggaagccatcaagcgaggcctccggacgttgatcctggcgccaacacgcgtggttgccgcagagatggaagaggctctcagagggctgcctattaggtaccagactcccgccatccgggctgagcacaccggacgagaaattgtggaccttatgtgtcatgcaacattcaccatgagactgttgtcgccagtccgcgtgcctaactataatctaataatcatggatgaggcccacttcactgaccccgccagcattgctgcgaggggttacatctcaacccgtgtagaaatgggcgaggcagccgggatctttatgacagctacgccaccgggatcccgggatcctttcccccagagtaacgccccaattctggacgaggaaagagagatacccgaaaggtcttggaatagcggccatgagtgggtgactgattttgaaggtaaaaccgtttggttcgtcccttccatcaaggcagggaacgacattgccgcttgcctccgcaagaatggcaagaaggtgatccaattatcacgaaaaacatttgattctgagtatgtgaagaccagaactaacgactgggatttcgtcgtaacaaccgacattagcgagatgggcgcgaattttaaagccgaacgggtgatcgatccaaggcgctgtatgaagcccgttatactgacggacggcgaggaacgtgtgatccttgcagggcctatgccggtcactcacagttccgctgcccagagacggggaaggattggtcgcaaccccaaaaatgagaacgaccagtacatctacatgggcgaacccctggagaatgatgaggactgcgcacactggaaggaagccaagatgctcttggataacattaatacacctgaggggatcatacccagcatgttcgaaccagagcgagaaaaagtggacgctattgatggagagtatagactgcggggcgaggccaggaagacctttgttgacctcatgcgcagaggtgatctgcctgtgtggcttgcgtacaaagtcgcagccgaagggatcaactatgctgacaggcggtggtgtttcgatggcattaagaacaatcagatcctagaggaaaacgtggaggtagagatatggaccaaagaaggagagcgtaagaagctgaaaccccgctggttggacgcccgaatctactctgatccattagctctgaaggaatttaaagagttcgcagccggcagaaagtcactcactctgaatcttattacagaaatggggaggctgcctaccttcatgacacagaaaactcgggacgctctcgataacttggccgtgctgcatacggcagaggcgggaggtcgcgcctataatcacgctctatccgagctgccggaaaccctcgagacacttctgttattgactctgctcgccaccgttacaggcgggatctttctgttccttatgagtggaagaggcattggtaagatgaccctggggatgtgctgcatcataactgcaagcattctcttgtggtacgctcagatccagccccattggatcgccgcatcgattatcctggaatttttcttaatagtcctactgattccagagcctgaaaagcagaggacgccccaagacaaccagctcacctatgtggtgatcgccattcttacagtcgttgctgcgactatggccaatgagatgggctttctggagaaaaccaagaaagacttgggactgggctctgtggcaacacagcagccagaatccaacatcctcgatatagacctgcggcctgctagcgcctggaccctttacgccgtagcaactacattcgtgacgcccatgctccgacactcaatcgagaatagttctgtcaacgtgtccctgaccgctattgccaatcaagcgactgttttgatggggctgggaaagggttggccgttaagcaaaatggatatcggcgtgccactactggctattgggtgttactcacaggtcaaccctatcacactcaccgccgcacttctgttgctggtagcccactatgctattatcggacccggcctccaggcaaaggccaccagagaagcgcagaagcgcgctgccgcaggtataatgaaaaatccaacagtggacgggattactgttatcgatctggaccccatcccttacgatccgaagtttgagaaacaacttggccaggtgatgttactgattctctgcgtcacacaggtgttgatgatgaggaccacatgggccctgtgtgaagctctaactctggccaccggacccataagtacactctgggagggcaacccagggcggttctggaataccactatcgcagtcagcatggctaacatttttcgtggatcctatcttgccggcgcgggtctgttgttctctatcatgaagaatacgacaaacaccagaagggggactggaaacatgggcgagaccctgggtgaaaaatggaaaagccgcctcaatgccctgggcaaatccgagtttcaaatttacaagaagtcagggatccaggaagtggaccggacattagcaaaagagggaataaagcgaggcgagactgatcatcacgctgtttctagagggagtgccaaacttaggtggttcgtggaacgcaacatggtaacccctgagggaaaggtggtcgacctgggctgcggtagagggggatggtcgtattactgtggcggtctcaaaaatgttagagaagtgaagggcctaacaaaagggggacccggccatgaggaacctatcccaatgagcacgtatgggtggaacctggtccgtttgcagtccggagtggatgtatttttcattccccctgagaaatgcgacaccctgctctgtgatatcggcgagtcttcaccaaatcccactgtggaagcaggtaggacacttcgggttctgaacttggtggagaattggctgaacaataacacccagttctgcattaaggtcctcaatccgtacatgcctagcgtgatcgagaaaatggaggctttacaacgcaagtacgggggagccctggtccgaaacccactttccagaaatagtactcacgaaatgtattgggtgtctaacgccagcggcaatatagtttcatccgtaaacatgattagtaggatgctgatcaaccggtttacaatgcgccataaaaaggcgacctacgagcccgacgtggacctaggcagcgggacgagaaatatcggaattgagtctgaaatacctaacctcgatatcattggtaagaggatcgagaaaattaagcaggaacacgagacctcctggcactatgaccaggatcatccatacaaaacatgggcttatcacggctcatacgaaactaagcagaccgggagcgcatcgtctatggtcaatggagtggttcgactgttgacaaaaccctgggacgtgctgccgactgtcacccaaatggccatgacagataccactcctttcggccagcagcgggtgtttaaggagaaggtagacacgcgtacacaggagcccaaagaaggtaccaagaaactcatgaagatcactgctgagtggctttggaaagaactggggaagaaaaagaccccaagaatgtgtacacgcgaggagttcacgaggaaggtgcggagtaacgccgcattaggagccatatttaccgatgaaaataaatggaagtccgctagagaggcggttgaagacagccgcttctgggagctggtcgataaagaaaggaacttgcatctcgagggcaagtgcgagacttgtgtgtataatatgatgggcaaacgagaaaagaagctgggggagtttggaaaagccaagggttcacgggcaatctggtacatgtggctaggcgctagattccttgaatttgaggccctggggttcctcaacgaagaccactggttttccagggaaaattctctgagcggagtggagggcgaaggtttgcacaaactggggtacattctccgcgatgtcagtaagaaagagggaggcgcaatgtatgccgacgacacagctggctgggatacccgtatcactcttgaagacctgaagaacgaggaaatggttacaaatcatatggagggggagcacaagaaattagccgaagcgattttcaagctgacctaccaaaacaaagtggtacgggtgcagagacctacacccaggggaactgtcatggatatcatttcccgccgagaccagcggggtagcggccaagtggggacctatggattgaatacgtttaccaacatggaggcacagctcataagacagatggaaggcgagggtgttttcaagaatatccagcatctgacagtgactgaggaagtcgccgtgcaaaactggctagctagggtagggcgcgagagactttctcggatggccatttcaggagatgactgcgttgtgaaaccactggatgacaggttcgcaaacgctctcaccgccctgaatgatatgggcaagatccgtaaggacatccagcagtgggaacccagtaaaggctggaacgattggacacaggtccctttttgctcccaccatttccacgagttgattatgaaggacgggcgagtgttagtggtcccatgtcgcaatcaagatgaactgataggacgggctcggatcagccagggtgccggctggtctctcagggagactgcatgccttgggaaatcgtacgcgcagatgtggtcactgatgtattttcaccgcagagacctacggctggccgctaacgccatttgtagcgcagttccgtcccattgggtgcccaccagtaggacgacatggtctatccacgctaagcatgagtggatgaccactgaagacatgctcacagtatggaatcgagtgtggattcgtgagaacccttggatggaagataaaaccccagtcgagagctgggaagagatcccctacttgggaaagagagaggaccagtggtgcggctccctgataggtcttacttcacgcgccacctgggcaaagaatatccaagccgcgattaaccaggtgcggagtctgatcgggaatgaagagtatacagattacatgccttctatgaaaaggttcagacgcgaagaggaagaggctggagttctctggtga

SEQ ID NO: 14837 - RNA, 9876 nt, synthetic construct
  misc_feature 1..9876: note = derived and/or modified CDS sequence (opt3) from DENV-2__EU482657__SS-prME
  source 1..9876: mol_type = other RNA
agcgcaggaatgatcattatgctgataccaaccgtgatggctttccacctcactactagaaacggggaacctcatatgatcgtcggtattcaagaaaagggaaaatcccttctgtttaagacggaagacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggataatgaggcatcctggcttcaccatcatggccgcaattctggcctacacaatcggcaccacgcactttcagcgggtgttgattttcatcctcctgactgctgttgcaccatctatgacaatgcgctgcatagggatttcgaacagagattttgtggaaggagtctcaggtggcagctgggtggacatcgtactggagcacgggagttgtgttaccactatggccaagaataagcccacactcgatttcgaattaattaaaaccgaggctaagcagcctgccacgctgaggaaatattgcatcgaagcgaaacttaccaacacaactaccgagtcccggtgtccaacacaaggagagccctctttgaaagaagaacaggacaagcgctttgtgtgcaagcatagcatggtcgatcgaggctggggtaatgggtgtggactgttcggcaaaggcgggatcgtgacttgcgcaatgtttacctgcaagaaaaacatggaaggaaagattgtgcagcctgagaatctagaatacacaatagtcgttaccccacactccggtgaggagcatgccgtgggcaacgacactgggaaacacggaaaggaaatcaaagtaacgccgcagtcaagtattacagaggctgaactcaccggctatggtactgtgaccatggagtgtagccccagaacagggctggatttcaatgaaatggtccttctgcaaatggagaacaaggcctggttggtgcacaggcagtggtttctcgacctgcctttaccatggctgcccggcgcagataagcaggagtctaattggatccagaaagaaaccctcgttactttcaagaaccctcatgctaaaaagcaagacgtggtcgtgcttggatcccaggagggcgccatgcacacagcgctgacgggggccaccgaaatacagatgtcaagcggaaatttgctatttactggtcatctgaaatgccggctccgtatggacaagctgcaacttaagggcatgagttactctatgtgtacagggaaattcaaggtagttaaagagattgcagagacccagcacggaacaatcgtgatccgcgtccagtatgaaggcgatggttccccatgcaagattcccttcgagatcatggacctggagaagagatacgtgttggggaggctcattactgtcaacccgatagtgaccgagaaggatagccctgttaacatcgaagctgagcccccatttggcgactcgtacattatcatcggagtggagcctggccagctgaagttaaattggttcaaaaaggggtcttccattggacaaatgtttgaaacgaccatgcggggtgccaaacgaatggctatactgggcgatacagcctgggacttcgggtcactaggaggcgtatttacaagtatcggtaaggcactccatcaggtcttcggggccatttatggcgctgcgtttagcggagtgtcctggaccatgaaaatcctgattggcgttatcataacatggatcgggatgaactctcgcagcacttcacttagtgtgtccttggtcctggtgggaattgtaaccctctacctgggcgtgatggttcaggcagatagcggttgtgtcgtgtcttggaagaataaggagcttaaatgcgggtcaggaatcttcattacggacaacgtgcacacatggaccgaacagtataagtttcaacccgagagtccaagcaaactggcctccgctatccagaaggcccaggaagagggcatatgtggtattagatctgtcactaggttggagaatctcatgtggaaacagatcacacccgaactgaaccacattttagcagagaatgaagttaagctgaccatcatgactggcgatatacgggggatcatgcaagccggaaaacgctcgctaagacctcagccaaccgagctcaagtacagctggaagacatggggcaaagctaagatgctgtccacggaatcatataaccagaccttccttattgacgggccggagactgccgagtgccccaatacaaacagggcatggaatagtttggaagtggaggattacggatttggcgtgttcaccacaaacatctggctgaaactcaaggaaaaacaggacgcgttttgtgactctaagctgatgagcgctgccattaaggataatcgtgcagtacatgccgacatgggttattggatggagtccgctttaaacgatacttggaaaatcgagaaggcctcattcatagaagtcaaaaattgccactggcctaagagccataccctgtggtctaacggggtgcttgagtccgaaatgattatccccaagaacttggcaggacccgttagtcaacacaattaccggcctggctaccacacgcagatcgctggtccatggcatctcggcaagctggagatggacttcgatttttgtgacgggacaaccgtgattgtcactgaagattgcggaaaccgaggccccagcctaagaaccacaactgcctctgggaagctgatcaccgagtggtgctgtaggtcctgcacactcccgcctctgcgctatcggggagaggacggctgttggtacggtatggaaattagaccacttaaagagaaggaagagaatttggtgaactcactggttacggcggggcacggacaggtggataatttcagtttaggcgtactcggtatggccctgtttcttgaagagatgctgaggacccgcgtcggcactaaacatgctatattgctcgtggcagtgagcttcgtcacactgatcaccgggaacatgtcgtttaaggacctaggacgagttgtggtaatggtgggcgccactatggctgatgacattgggatgggagtcacatatctggccctcctggcagcgttcaaagtgcggcccacctttgccgctggccttttgctgcgtaagttaacgtccaaggagctcatgatgactaccatcggtattgttctgctttctcaaagcacaatccctgaaaccgtgctggagctaactgatgccctcgcactggggatgatggtcttgaaaatagtgagaaatatggaaaagtaccagctggctgttacaatcatggccattttatgcgtgcccaacgcagtcatcctccagaatgcctggaaagtatcatgtaccattctggctgtggttagtgtgtccccacttctgttgacatctagccagcaaaagactgactggatccctctcgcgctgaccataaaaggactaaaccccacggccattttcctgacaaccctttccaggactaataagaaacgctcatggccactcaacgaggcaatcatggctgtcggcatggtgagcatcctggccagttctttgctgaagaatgacattccgatgaccggccctttagtagccgggggactcctgacagtgtgctatgtccttactggtcggtccgctgatctggaattggagagagcaaccgacgttaagtgggaggatcaggccgaaataagcggctcgtcacccatcctctctattacgatcagtgaggacgggtccatgagcattaaaaacgaagaggaggaacagacactgaccatcctaataaggactggactgcttgtgatctctggcctctttccaattagcatccccattacagcggctgcctggtacctgtgggaggtgaagaaacagcgagccggtgtcttgtgggatgtgccttccccaccccctatggggaaggccgaattagaggacggagcttatcgcatcaaacaaaagggcatactgggctactcacagattggggcaggagtttacaaggaaggtaccttccacactatgtggcatgtaacacggggcgccgtgctcatgcacaaagggaagagaatcgagccgagttgggcggatgtcaaaaaggacctgatcagctatggaggcggttggaaacttgagggggaatggaaggagggagaagaggtgcaggttctggctttggaaccaggcaagaatcccagggccgtgcagaccaaacctggcctatttaagacgaacactgggaccattggagcagtctctctggatttctccccaggtacatcaggcagtcccatcatagacaaaaaggggaaagtggtaggactctacggcaacggtgtcgtgacccgtagcggggcctatgtttccgctattgcccaaacagagaagtctatcgaggataatcctgaaattgaggacgatatctttcgcaagcggagactgactataatggaccttcacccgggagcaggcaaaaccaagaggtacttacccgctattgtgcgagaagccatcaaacggggcctgcgcacgctcatcttggcgccaacaagagtcgtggccgcagagatggaagaggctctgagggggctccctattcggtatcagactcccgccatccgagctgagcataccggaagagaaattgttgacctgatgtgtcacgcaacattcaccatgcgccttctgtcgccagtgagggtccctaactacaatttgataatcatggatgaggcccatttcactgaccccgccagcattgctgcgcgtggttatatctcaacccgggtggaaatgggcgaggcagccgggatctttatgacagctacgccaccgggatccagagatcctttcccccagagtaacgccccaattatagacgaggaaagggagatccccgaacgctcttggaatagcggccacgagtgggtaactgattttaagggtaaaaccgtgtggttcgttccttccattaaggcagggaacgacatcgccgcttgcctacgaaagaatggcaagaaggtcattcaactgtcaagaaaaacatttgattctgaatacgtgaagacccggactaacgactgggatttcgtggtcacaaccgacatcagcgagatgggcgcgaattttaaagccgagagggtaatagatccacgccgttgtatgaagcccgtgatcctcacggacggcgaagagagagttattttagcagggcctatgccggtgactcatagttccgctgcccagcggaggggacgcatcggtcgaaaccccaagaatgaaaacgaccagtacatttatatgggcgagcccctggaaaatgatgaggactgcgcacactggaaggaggccaagatgcttctggataacatcaatacacctgaagggataattcccagcatgttcgagccagaaagagagaaagtcgacgctatcgatggagaataccggctcaggggcgaggcccgcaagacctttgtggacttgatgagaaggggtgatctgcctgtttggctcgcgtataaagtggcagccgaggggattaactacgctgaccggcgttggtgtttcgatggcatcaagaacaatcagatactggaagagaacgtcgaagtggagatctggaccaaagagggagaacgcaagaaacttaaaccccgatggctagacgccagaatttattctgatccactggctttgaaggagtttaaagagttcgcagccggcaggaagtcattaactctgaatctcatcacagagatggggcggctgcctaccttcatgacacagaaaactcgcgacgctcttgataacctggccgtactccacacggcagaagcgggaggtagagcctacaatcatgctttgtccgagctgccggagaccctagaaacactgctccttctgactttattggccaccgtgacaggcgggatttttctgttcctcatgagtggaaggggcatcggtaagatgaccctggggatgtgctgcataattactgcaagcacgcttctgtggtatgctcagatccagccccactggatcgccgcatcgattatcctcgagtttttcttgatagttctgttaattccagaacctgagaagcagcggaccccacaagacaaccagctaacatacgtcgtgatcgccattctgactgtggtcgctgcgaccatggccaatgaaatgggctttctcgagaaaacaaagaaagaccttggactgggctctatcgcaacccagcagccagagtccaacatattggatatcgacctgcgacctgctagcgcctggactctctacgccgttgcaacaacgttcgtgacccccatgctgagacattcaattgaaaatagttctgtaaacgtgtcccttactgctatcgccaatcaagcgacagtcctcatggggctgggaaagggttggccgttgagcaaaatggatattggcgtgccactgttagctatcgggtgttattcacaggttaaccctattaccctaaccgccgcactgctccttctggtggcccactacgctatcataggacccggcttgcaggcaaaggccacacgcgaggcgcagaagagggctgccgcaggtattatgaaaaatccaactgtcgacgggatcacggtaatcgatctggaccccattccttatgatccgaagtttgaaaaacaactcggccaggtgatgctgcttatattatgcgttacccaggtgctgatgatgcggacaacttgggccctctgtgaggctttgaccctggccacaggacccatcagtaccctatgggaaggcaacccagggcgtttctggaatactacgattgcagtcagcatggctaacatctttagaggatcctacctggccggcgcgggtctccttttctctattatgaagaatacaaccaacactaggcgcgggaccggaaacatcggcgagacactgggtgagaaatggaaaagccggttgaatgccctgggcaaatccgaatttcaaatatataagaagtcagggatccaggaggtggaccgaactctcgcaaaagaaggaattaagagaggcgagaccgatcaccatgctgtctctagggggagtgccaaactgcgctggttcgtggagcggaacatggttacacctgaaggaaaggtggtagacttaggctgcggtagagggggatggtcgtactattgtggcggtcttaaaaatgtgcgtgaggtcaagggcctgacgaaagggggacccggccacgaagaacctatcccaatgagcacctacgggtggaacctcgttaggctacagtccggagtggatgtctttttcattccccctgaaaaatgcgacactctgttgtgtgatatcggcgagtcttcaccaaatcccacagtggaggcaggtcggaccctgcgcgtactcaaccttgtggaaaattggctgaacaataacactcagttctgcataaaggttttgaatccgtacatgcctagcgtgattgagaaaatggaagctctgcaacgaaagtatgggggagccctcgtcagaaacccattatccaggaatagtacacatgagatgtactgggtgtctaacgccagcggcaatatcgtctcatccgtgaacatgatcagtcggatgctgattaaccgctttaccatgagacacaaaaaggcgacgtatgaacccgacgttgaccttggcagcgggaccaggaatataggaatcgagtctgagattcctaacctggatatcattggtaagcgaatcgagaaaataaagcaggagcatgaggcttcctggcactacgaccaggatcacccatataaaacatgggcataccatggctcatatgagactaagcagaccgggagcgcctcgtctatggtaaatggagtggtccggctactcacaaaaccctgggacgtgctgccgactgttacccaaatggctatgacagataccactcctttcggccagcagcgtgtgtttaaggaaaaggtcgacacgagaacacaggagcccaaagagggtaccaagaaattgatgaagatcactgccgaatggctgtggaaagagctcgggaagaaaaagaccccacgcatgtgtacaagggaagagttcacgcggaaggtgagaagtaacgcagcccttggagctatttttaccgatgagaataaatggaagtccgcgcgcgaagccgtagaggacagcaggttctgggaactggtggataaagagcgaaacttacacctggaaggcaagtgcgagacttgtgtttacaatatgatgggcaaacgggagaagaagttgggggaatttggaaaagcaaagggttcaagagctatctggtacatgtggctcggcgccaggttcctggagtttgaagcactagggttccttaacgaggaccattggttttcccgcgaaaattctctgagcggagtcgagggcgagggtctccacaaactggggtatattttgcgtgatgtgagtaagaaagaaggaggcgccatgtacgctgacgacacagccggctgggatacccggatcactctggaggacctcaagaacgaagagatggtgacaaatcacatggaaggggagcataagaaacttgcggaggcaattttcaagctgacctatcaaaacaaagtcgttagagtgcagaggcctacaccccgcggaactgtaatggatataatctcccgacgggaccagagaggtagcggccaagtggggacctacggattaaatacgtttaccaacatggaagcccagctgattaggcagatggagggcgaaggtgtcttcaagaatatccagcacttgacagtgactgaggaggttgctgtgcataactggctcgcccgcgtcgggagagaacggctgtctaggatggcaatctcaggagatgactgcgtggtaaaaccactagatgaccgtttcgctaacgcccttaccgctctgaatgatatgggcaagattcgaaaggacatacaacagtgggagcccagtaaaggctggaacgattggacacaggttcctttttgctcccaccatttccacgaactcatcatgaaggacgggcgcgtgctggtcgtgccatgtagaaatcaggatgagttgattggacgggccaggatcagccaaggtgcaggctggtctttacgcgaaactgcgtgcctggggaaatcgtatgcccagatgtggtcactcatgtactttcacagacgggaccttaggctggctgccaacgcaatttgtagcgctgtgccgtcccattgggtccccaccagtcgaacgacatggtctatccacgccaagcatgagtggatgaccactgaggacatgctaacagtttggaatcgtgtgtggataagagaaaacccttggatggaggataaaaccccagtagaaagctgggaggaaatcccctatctgggaaagcgcgaggaccagtggtgcggctccctcattggtttgacttcacgggcaacctgggccaagaatatccaggcggctattaaccaagtgaggagtctgatcgggaatgaggaatacacagattacatgccttctatgaaaagattccgccgggaggaagaggaagccggagtcctttggtga

SEQ ID NO: 14838 - RNA, 9876 nt, synthetic construct
  misc_feature 1..9876: note = derived and/or modified CDS sequence (opt3) from DENV-2__EU482658__SS-prME
  source 1..9876: mol_type = other RNA
agcgccggcatgatcattatgctgatacccaccgtgatggctttccacctcactactagaaacggggagcctcatatgatcgtcggtattcaagaaaaaggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtgatagtcctgggatcccaggagggcgccatgcacacagcgttgacgggggccaccgaaattcagatgtcaagcggaaatctactgtttactggtcatctcaaatgccggctgcgtatggacaaacttcaactgaagggcatgagttactctatgtgtacagggaaattcaaggtggtaaaagagatcgcagagacccagcacggaacaatcgttattcgcgtgcagtatgaaggcgatggttccccatgcaagatccccttcgagattatggacttggagaagagatacgtcctcgggaggctgataactgtgaacccgatcgtcaccgagaaggatagccctgtgaacattgaagctgagcccccatttggcgactcgtacatcatcattggagttgagcctggccagttaaagctgaattggttcaaaaaggggtcttccataggacaaatgtttgaaacgaccatgcggggtgccaaacgaatggctatcctaggcgatacagcctgggacttcgggtcactcggaggcgtgtttacaagtattggtaaggcactgcatcaggtattcggggccatctatggcgctgcgtttagcggagtctcctggaccatgaaaattcttatcggcgtgataatcacatggattgggatgaactctcgcagcacttcattgagtgtttccctggtgctcgtcggaatcgtgaccctgtaccttggcgtaatggtgcaggcagatagcggttgtgttgtctcttggaagaataaggagctgaaatgcgggtcaggaattttcatcacggacaacgtgcacacatggaccgaacagtataagtttcaacccgagagtccaagcaaattggcctccgctatacagaaggcccaggaagagggcatttgtggtatcagatctgtgactaggctcgagaatctgatgtggaaacagattacacccgaattaaaccacatcctggcagagaatgaagtcaagctaaccataatgactggcgatatcaaagggattatgcaagccggaaagcggtcgctccgccctcagccaaccgagctgaagtacagctggaaaacatggggcaaggctaaaatgctttccacggaatcatataaccagaccttcttgatcgacgggccggagactacagagtgccccaataccaacagagcctggaatagtctggaagttgaggattacggatttggcgtgttcacaactaacatttggctcaagctgaaagaaaagcaggacgcattttgtgactctaagttaatgagcgcggctatcaaagataatagggccgtgcatgcagacatgggttattggatagagtccgccctgaacgatacctggaagattgagaaggcttcattcatcgaagtaaagaattgccactggcctaaaagccatacgctttggtctaacggggtcttggagtccgaaatgatcattccaaagaacctcgccggacccgtgagtcaacacaattaccgtcctggctaccacacacagatcgcaggtccatggcatctgggcaagctagagatggacttcgatttttgtgacgggaccactgttattgtgaccgaagattgcggaaaccggggccccagcctgcgaacaactaccgcttctgggaaactcataacagagtggtgctgtagatcctgcacgctgccgcctcttaggtatcgcggagaggacggctgttggtacggtatggaaatccggccattgaaggagaaagaagagaatctggtcaactcattagtgaccgccgggcacggacaggttgataatttcagtctcggcgtgctgggtatggcgctttttctggaagagatgttgagaactagggtaggcacaaagcatgccattctcctggtcaccgtgagcttcgtgactctaatcacagggaacatgtcgtttaaagacctgggacgcgtcgttgtgatggtaggcgctaccatggcagatgacattgggatgggagtgacgtatctcgccctgcttgctgccttcaaggtccgacccacttttgcagcgggcttgctgttacggaagctcacctccaaagagctgatgatgacaaccatcggtatagtgcttctgtctcaaagcactatccctgaaacagttctagagctcaccgatgccctggctttggggatgatggtgctgaagattgtccgtaatatggaaaaataccagttagccgtgacaatcatggcaattctctgcgttcccaacgctgtgatcctgcagaatgcctggaaggtctcatgtactatacttgcagtagtgagtgtttccccactgttgctcacctctagccagcagaaaacggactggattcctctggccctaacaatcaagggactgaaccccaccgctatcttccttactaccctctccagaacaaataaaaagaggtcatggccactgaacgaggcgattatggccgtgggcatggtcagcatattggcaagttctctgttaaagaatgacatcccgatgactggccctctcgtggctgggggactgcttaccgtatgctatgtgctgacgggtcgctccgccgatttggaactcgagcgggccacagacgtcaaatgggaggatcaggctgaaattagcggctcgtcacccatcctgtctattaccatcagtgaggacgggtccatgagcataaagaacgaagaggaggaacagactctaacaatcctgattagaaccggacttctcgttatctctggcctgtttccaattagcatccccataactgcagccgcgtggtacttgtgggaggtgaaaaagcagagggctggtgtgttatgggatgtcccttccccaccccctatggggaaagccgaactggaggacggagcatatcgaattaagcaaaagggcatcctcggctactcacagatcggggccggagtgtacaaagaaggtacattccacaccatgtggcatgttacgcgcggcgctgtactgatgcacaaggggaaacggattgagccgagttgggcagatgtgaagaaagaccttatcagctatggaggcggttggaagctggagggggaatggaaggagggagaagaggtccaggtgttggccctagaaccaggcaaaaatcccagagcggttcagactaagcctggcctgtttaaaaccaacacagggaccataggagctgtgtctctcgatttctccccaggtacatcaggcagtcccattatcgacaagaaagggaaggtcgtgggactgtacggcaacggtgtagtcactaggagcggggcctatgtgtccgcaattgcccaaaccgagaagtctatcgaggataatcctgaaatagaggacgatatttttcgtaaacgccggcttacgatcatggacttacacccgggagctggcaagacaaaaagatacctgcccgccatcgttagggaagcaattaagcgaggcctccggactttgatcctggctccaacccgcgtggtcgccgcggagatggaagaggccctcagagggctgcctattaggtatcagacacccgcaatacgggctgagcataccggacgagaaatcgtggaccttatgtgtcacgccactttcaccatgagactgttgtcgccagttcgcgtgcctaactacaatctaattatcatggatgaggctcatttcacagaccccgcaagcatcgccgccaggggttatatttcaacgcgtgtcgaaatgggcgaggctgcggggatatttatgactgcaaccccaccgggatcccgggatcctttcccccagagtaacgccccaatcattgacgaggaaagagagatccccgaaaggtcttggaatagcggccacgagtgggtgacagattttaaaggtaagaccgtatggttcgtgccttccattaaggctgggaacgacatcgccgcatgcctgcgcaaaaatggaaagaaagttatacaactctcacgaaagacttttgattctgaatacgtcaaaacaagaaccaacgactgggatttcgtggtgacgactgacatcagcgagatgggcgccaattttaaggctgagcgggtcattgatccaaggcgctgtatgaaacccgtaatcttaacagacggcgaagaacgtgtgattctggcggggcctatgccggttacccatagttccgccgcacagagacggggaaggatcggtcgcaacccaaagaatgaaaacgaccagtacatatatatgggcgagccccttgaaaatgatgaggactgcgctcactggaaggaggccaaaatgctgctcgataacattaatacccctgaagggatcattcccagcatgttcgagccagaacgagagaaggtggacgcaatcgatggagaatacagattgcggggcgaggccaggaaaacttttgtcgacctgatgcgcagaggtgatctccctgtgtggctggcttataaggttgccgcggaggggataaactacgcagacaggcggtggtgtttcgatggcatcaaaaacaatcagattcttgaagagaacgtggaagtcgagatctggacaaaggagggagaacgtaagaaactaaagccccgctggctggacgcccgaatttattctgatccattggctttaaaagagtttaaggagttcgccgctggcagaaaatcactgaccctcaatctgatcacagagatggggaggcttcctactttcatgacgcaaaagacccgggacgcactggataacctcgccgtgttgcacacagctgaagccggaggtcgcgcatacaatcatgcgctgtccgagctaccggagactctggaaaccctccttctgttaacattgctggccaccgtaactggcgggatatttctcttcctgatgagtggaagaggcattggtaagatgacgcttgggatgtgctgcatcatcaccgctagcattctgctctggtatgcccagatccagccccactggatagcagcttcgattatcttggagtttttcctgattgtgttactaatcccagaacctgagaaacagaggacaccccaagacaaccagctgacttacgttgtcatagccatcctcaccgtggtggcagccacaatggctaatgaaatgggctttcttgagaagaccaaaaaggacctgggattgggctctattgcgactcagcagccagagtccaacatcctggatattgacctccggcctgccagcgcatggacactgtacgctgtcgccacgaccttcgttactcccatgcttcgacattcaatcgaaaatagttctgtgaacgtatccctcacagccattgcaaatcaagctaccgtgctgatggggttgggaaaaggttggccgctgagcaagatggatatcggcgtcccattactagccatagggtgttattcacaggtgaaccctattaccctgacagcggctctccttctgttggttgcccactacgcaatcatcggacccggcctgcaggccaaggctactagagaggcacagaaacgcgccgcggctggtattatgaagaatccaacggtggacgggataaccgtcatcgatctcgaccccattccttatgatccgaaatttgaaaagcaactgggccaggtaatgcttttaatcctgtgcgtgacacaggttctcatgatgaggactacctgggccttgtgtgaggcactgacactagccaccggacccattagtactctgtgggaaggcaacccagggcggttctggaatacgacaatcgctgtgagcatggccaacatatttcgtggatcctacctcgcaggcgctggtcttctgttctctatcatgaaaaataccactaacaccagaagggggacaggaaacattggcgagactttgggtgagaagtggaaaagccgcctgaatgccctcggcaagtccgaatttcaaatctataagaaatcagggattcaggaggtcgaccggaccctggcgaaggaaggaatcaaacgaggcgagacagatcaccatgccgtgtctagagggagtgcaaagttaaggtggttcgtcgagcgcaacatggtgacgcctgaaggaaaagttgtggaccttggctgcggtagagggggatggtcgtactattgtggcggtctgaagaatgtaagagaggtgaagggcctcaccaaagggggacccggccacgaggaacctataccaatgagcacttacgggtggaacctagtccgtctgcagtccggagttgatgtgtttttcattccccctgaaaagtgcgacacattgctgtgtgatatcggcgagtcttcaccaaatcccaccgtcgaggctggtaggactctccgggtgcttaacctggtagaaaattggttgaacaataacacacagttctgcatcaaagtgctgaatccgtacatgcctagcgttattgagaagatggaagccctccaacgcaaatatgggggagcattagtgcgaaacccactgtccagaaatagtacccatgagatgtactgggtctctaacgctagcggcaatatagtgtcatccgtcaacatgatcagtaggatgcttattaaccggtttacgatgcgccacaagaaggccacctatgaacccgacgtggacctgggcagcgggacaagaaatatcggaattgagtctgagatccctaacctagatataatcggtaaaaggattgaaaagatcaaacaggagcatgaaacttcctggcactacgaccaggatcacccatataagacctgggcctaccatggctcatatgagacaaaacagactgggagcgcgtcgtctatggttaatggagtagtgcgactcctgaccaagccctgggacgtcttgccgacagtgacccaaatggctatgactgatacgacacctttcggccagcagcgggtttttaaggaaaaagtggacacccgtactcaggagcccaaggagggtaccaaaaagctgatgaaaattacagcagaatggctctggaaggagcttgggaaaaagaagacgccaagaatgtgtacccgcgaagagttcactaggaaagtccggagtaacgccgctctgggagccatctttacagatgagaataagtggaaatccgcaagagaagccgtggaggacagccgcttctgggaattagtagataaggagaggaacctgcacttggaaggcaaatgcgagacctgtgtgtacaatatgatgggcaagcgagagaagaaactcggggaatttggaaaggctaaaggttcacgggcgatttggtacatgtggctgggcgccagattcctagagtttgaagcacttgggttcctgaacgaggaccattggttttccagggaaaattctctcagcggagttgagggcgagggtctgcacaagttggggtatatactgcgcgatgtcagtaaaaaggaaggaggcgctatgtacgccgacgacactgcaggctgggatacacgtatcaccctcgaggaccttaagaacgaagagatggtgacaaatcacatggaaggggagcataaaaagctggccgaggctattttcaaattaacttatcaaaacaaggtggtccgggttcagagacctacccccaggggaacggtgatggatatcatctcccgccgagaccagcggggtagcggccaagtagggacctacggactgaatacatttactaacatggaagcccagttgattagacagatggagggcgaaggtgtgttcaaaaatatacagcacctcaccgtcacagaggaggtggcggttcaaaactggctggcaagggtggggcgcgaaagactatctcggatggccatctcaggagatgactgcgtcgtgaagccacttgatgacaggttcgctaacgccctgactgcactcaatgatatgggcaagattcgtaaagacatccagcagtgggagcccagtaagggctggaacgattggacccaggtacctttttgctcccatcacttccatgaactgattatgaaagacgggcgagttttggtggtcccatgtcgcaatcaagatgagttaatcggacgggctcggataagccagggtgccggctggtctctgagggaaacggcttgcctcgggaagtcgtatgcccagatgtggtcacttatgtactttcaccgcagagacctgcggctagcagcgaacgccatctgtagcgctgtgccgtcccactgggtgcccacaagtaggaccacttggtctattcatgccaaacacgagtggatgacaaccgaggacatgctgactgtctggaatcgagtttggatccgtgataacccttggatggaagacaagaccccagtggagagctgggaagagattccctatctcggaaagagagaagatcagtggtgcggctccttgatcggtctgacatcacgcgcaacgtgggctaaaaatatacaagccgcaattaaccaggtacggagtcttatcgggaatgaggagtacaccgactacatgccttctatgaagaggttcagacgcgaagaggaagaggccggagtgctgtggtga

SEQ ID NO: 14839 - RNA, 9876 nt, synthetic construct
  misc_feature 1..9876: note = derived and/or modified CDS sequence (opt3) from DENV-2__EU482659__SS-prME
  source 1..9876: mol_type = other RNA
agcgccggcatgataattatgctgatacccaccgtgatggctttccacctcactactagaaacggggagcctcatatgatcgtcggtattcaagaaaaaggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactacagagtgccccaataccaacagagcctggaatagtctggaagtggaggattacggatttggcgtgttcacaactaacatctggctcaagctgaaagaaaagcaggacgcattttgtgactctaagttaatgagcgcggctattaaagataatagggccgtacatgcagacatgggttattggatcgagtccgccctgaacgatacctggaagatagagaaggcttcattcattgaagtcaagaattgccactggcctaaaagccatacgctttggtctaacggggtgttggagtccgaaatgatcatcccaaagaacctcgccggacccgttagtcaacacaattaccgtcctggctaccacacacagattgcaggtccatggcatctgggcaagctagagatggacttcgatttttgtgacgggaccactgtgatcgtcaccgaagattgcggaaaccggggccccagcctgcgaacaactaccgcttctgggaaactcattacagagtggtgctgtagatcctgcacgctgccgcctcttaggtatcgcggagaggacggctgttggtacggtatggaaatacggccattgaaggagaaagaagagaatctggtgaactcattagttaccgccgggcacggacaggtggataatttcagtctcggcgtactgggtatggcgctttttctggaagagatgttgagaactagggtcggcacaaagcatgccatcctcctggtggctgtgagcttcgtcaccctaattactgggaacatgtcgtttaaagacctgggacgcgttgtggtaatggtgggcgcaacaatggccgatgacatcgggatgggagtcacctatctcgctctgcttgccgcattcaaggtgcgacccacgtttgcggccggcttgctgttacggaagctcacttccaaagagctgatgatgaccacaattggtatcgttcttctgtctcaaagcaccatacctgaaactgtgctagagctcacagatgctctggccttggggatgatggtcctgaagatcgtgcgtaatatggaaaaataccagttagcagttaccattatggctatcctctgcgtgcccaacgccgtcattctgcagaatgcatggaaggtatcatgtacaatccttgccgtggttagtgtgtccccactgttgctcacttctagccagcagaaaaccgactggatacctctggctctaacgattaagggactgaaccccacagcgatcttccttaccactctctccagaaccaataaaaagaggtcatggccactgaacgaggccatcatggcagtcggcatggtgagcattttggctagttctctgttaaagaatgacataccgatgacaggccctctcgtagccgggggactgcttactgtgtgctatgtcctgaccggtcgctccgccgatttggaactcgagcgggctacggacgttaaatgggaggatcaggcagaaatcagcggctcgtcacccattctgtctatcacaattagtgaggacgggtccatgagcatcaagaacgaagaggaggaacagaccctaactatactgatcagaacaggacttctcgtgatttctggcctgtttccaatcagcattcccatcaccgccgcggcttggtacttgtgggaggtgaaaaagcagagggccggtgtcttatgggatgtgccttccccaccccctatggggaaagcagaactggaggacggagcctatcgaataaagcaaaagggcattctcggctactcacagatcggggctggagtttacaaagaaggtactttccacacaatgtggcatgtaacccgcggcgcagtgctgatgcacaaggggaaacggatcgagccgagttgggccgatgtcaagaaagaccttattagctatggaggcggttggaagctggagggggaatggaaggagggagaagaggtgcaggttttggcgctagaaccaggcaaaaatcccagagctgtgcagacgaagcctggcctgtttaaaactaacaccgggacaatcggagccgtctctctcgatttctccccaggtacctcaggcagtcccataattgacaagaaagggaaggtggtaggactgtacggcaacggtgtcgtgacaaggagcggggcatatgtttccgccatcgctcaaactgagaagtctattgaggataatcctgaaatcgaggacgatatatttcgtaaacgccggcttaccattatggacttacacccgggagccggcaagacgaaaagatacctgcccgcaatcgtgagggaagctatcaagcgaggcctccggacattgattctggccccaactcgcgtcgtggcggccgagatggaagaggcactcagagggctgcctatcaggtatcagacccccgctattcgggccgagcatacaggacgagaaatagttgaccttatgtgtcacgctaccttcactatgagactgttgtcgccagtgcgcgtccctaactacaatctaatcattatggatgaggcacatttcaccgaccccgccagcatcgccgctaggggttatatctcaacacgtgtggaaatgggcgaggcggcagggatttttatgacggccactccaccgggatcccgggatcctttcccccagagtaacgctccaataatcgacgaggaaagagagattcccgaaaggtcttggaataccggccacgagtgggtaacagattttaaaggtaagaccgtgtggttcgttcctagcatcaaggccgggaacgacattgcagcctgcctgcgcaaaaatggaaagaaagtcatccaactctcccgaaagacttttgattcagaatacgtgaaaacaagaaccaacgactgggatttcgtggtcacgactgacatatctgagatgggcgctaattttaaggcggagcgggtaatcgatccaaggcgctgtatgaaacccgtgattttaacagacggcgaagaacgtgttatcctggccgggcctatgccggtgacccatagcagtgcagctcagagacggggaaggattggtcgcaacccaaagaatgaaaacgaccagtacatctatatgggcgagccccttgaaaatgatgaggactgcgcccactggaaggaggcaaaaatgctgctcgataacataaatacccctgaagggattatcccctccatgttcgagccagaacgagagaaggtcgacgccattgatggagaatacagattgcggggcgaggctaggaaaacttttgtggacctgatgcgcagaggtgatctccctgtttggctggcctataaggtggcggcagaggggatcaactacgccgacaggcggtggtgtttcgatggcatcaaaaacaatcagatccttgaagagaacgtcgaagtggagatttggacaaaggagggagaacgtaagaaactaaagccccgctggctggacgctcgaatctatagcgatccattggccttaaaagagtttaaggagttcgctgcaggcagaaaatctctgaccctcaatctgattacagagatggggaggcttcctactttcatgacgcaaaagacccgggacgccctggataacctcgctgtattgcacacagccgaagcaggaggtcgcgcgtacaatcatgccctgtcagagctaccggagactctggaaaccctccttctgttaacattgctggctaccgtgactggcgggatctttctcttcctgatgtccggaagaggcataggtaagatgacgcttgggatgtgctgcattatcaccgccagtatcctgctctggtatgcacagattcagccccactggatcgctgccagcataattttggagtttttcctgatcgttttactaattccagaacctgagaaacagaggacaccccaagacaaccagctgacttacgtcgtgatcgcaatactcaccgtggtcgccgctacaatggcgaatgaaatgggctttcttgagaagaccaaaaaggacctgggattgggctcgatcgccactcagcagccagagtctaacattctggatatcgacctccggcctgcatccgcttggacactgtacgccgttgccacgaccttcgtgactcccatgcttcgacatagcattgaaaattcaagtgtaaacgtgtctctcacagcaatcgctaatcaagccaccgtcctgatggggttgggaaaaggttggccgctgtccaagatggatattggcgtgccattactagcgatcgggtgttatagccaggttaaccctataaccctgacagctgccctccttctgttggtggcacactacgccattatcggacccggcctgcaggctaaggcaactagagaggcccagaaacgcgcggctgccggtatcatgaagaatccaacggtcgacgggattaccgtaatagatctcgaccccatcccttatgatccgaaatttgaaaagcaactgggccaggtgatgcttttaattctgtgcgttacacaggtgctcatgatgaggactacctgggcattgtgtgaggccctgacactagctaccggacccatctcaactctgtgggaaggcaacccagggcggttctggaatacgacaattgccgtcagtatggcaaacatctttcgtggaagctacctcgctggcgccggtcttctgttctccataatgaaaaataccactaacaccagaagggggacaggaaacatcggcgagactttgggtgagaagtggaaatctcgcctgaatgcgctcggcaagagcgaatttcaaatttataagaaatccgggatccaggaggtggaccggaccctggccaaggaaggaattaaacgaggcgagacagatcaccatgcagtctcaagagggtctgctaagttaaggtggttcgtggagcgcaacatggttacgcctgaaggaaaagtggtagaccttggctgcggtagagggggatggagttactattgtggcggtctgaagaatgtgagagaggtcaagggcctcaccaaagggggacccggccacgaggaacctatcccaatgtcgacttacgggtggaacctagttcgtctgcagagcggagtggatgtctttttcataccccctgaaaagtgcgacacattgctgtgtgatattggcgagtcctctccaaatcccaccgtggaggccggtaggactctccgggtacttaacctggtggaaaattggttgaacaataacacacagttctgcatcaaagttctgaatccgtacatgccttcagtgatcgagaagatggaagcactccaacgcaaacatgggggagctttagtccgaaacccactgagcagaaattccacccacgagatgtattgggtgagtaacgcctctggcaatattgtcagctcagtgaacatgatatccaggatgcttatcaaccggtttacgatgcgccataagaaggccacctacgaacccgacgttgacctgggcagtgggacaagaaatattggaatcgagagcgagattcctaacctagatatcataggtaaaaggatcgaaaagattaaacaggagcacgaaacttcttggcactatgaccaggatcatccatacaagacctgggcgtatcacggctcctacgagacaaaacagactgggtcagctagctcgatggtaaatggagtggtccgactcctgaccaagccctgggacgtgttgccgacagttacccaaatggcaatgactgatacgacacctttcggccagcagcgggtgtttaaggaaaaagtcgacacccgtactcaggagcccaaggagggtaccaaaaagctgatgaaaatcacagccgaatggctctggaaggagcttgggaaaaagaagacgccaagaatgtgtacccgcgaagagttcactaggaaagtgcggtctaacgctgccctgggagcaatttttacagatgagaataagtggaaaagtgccagagaagctgtagaggactcccgcttctgggaattagtggataaggagaggaacctgcatttggaaggcaaatgcgagacctgtgtttataatatgatgggcaagcgagagaagaaactcggggaatttggaaaggcgaaaggtagccgggccatctggtacatgtggctgggcgcaagattcctagagtttgaagctcttgggttcctgaacgaggaccactggttttcaagggaaaattccctctctggagtcgagggcgagggtctgcacaagttggggtacattctgcgcgatgtgagcaaaaaggaaggaggcgccatgtatgcagacgacactgccggctgggatacacgtataaccctcgaggaccttaagaacgaagagatggtgacaaatcatatggaaggggagcacaaaaagctggctgaggccatcttcaaattaacttaccaaaacaaggtcgttcgggtgcagagacctacccccaggggaacggtaatggatattatcagtcgccgagaccagcggggttccggccaagtggggacctatggactgaatacatttactaacatggaagcgcagttgatcagacagatggagggcgaaggtgtcttcaaaaatattcagcatctcaccgtgacagaggaggttgcagtgcaaaactggctggccagggtcgggcgcgaaagactaagccggatggctatatctggagatgactgcgtggtaaagccacttgatgacaggttcgccaacgcactgactgctctcaatgatatgggcaagatccgtaaagacattcagcagtgggagccctcaaagggctggaacgattggacccaggttcctttttgcagtcaccatttccacgaactgatcatgaaagacgggcgagtgttggtcgtgccatgtcgcaatcaagatgagttaattggacgggcccggatctcccagggtgctggctggagcctgagggaaacggcctgcctcgggaagtcttacgcacagatgtggtcgcttatgtattttcaccgcagagacctgcggctagcggccaacgctatatgttcagccgtgccgagccattgggtccccacatccaggaccacttggagtatccacgcaaaacatgagtggatgacaaccgaggacatgctgactgtttggaatcgagtgtggattcgtgaaaacccttggatggaggataagaccccagtagaatcttgggaggaaatcccctacctcggaaagagagaggaccagtggtgcggcagcttgattggtctgacatcccgcgctacgtgggccaaaaatatccaagcagccataaaccaggtgcggtcacttattggggatgaggaatataccgactacatgcctagtatgaagaggttcagacgcgaggaagaggaagcgggagtcctgtggtga

SEQ ID NO: 14840 - RNA, 9876 nt, synthetic construct
  misc_feature 1..9876: note = derived and/or modified CDS sequence (opt3) from DENV-2__EU482661__SS-prME
  source 1..9876: mol_type = other RNA
agcgcaggaatgataattatgctgatacccaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacacgatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagcactggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactgccgagtgccccaatacaaacagagcatggaatagtctggaagtggaggattacggatttggcgtgttcaccacaaacatctggctcaagctgaaagaaaagcaggacgcgttttgtgactctaagttaatgagcgctgccattaaagataatagggcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaaactcattaccgagtggtgctgtagatcctgcacactgccgcctcttaggtatcgcggagaggacggctgttggtacggtatggaaatacggccattgaaggagaaagaagagaatctggtgaactcattagttacggcggggcacggacaggtggataatttcagtctcggcgtactgggtatggccctttttctggaagagatgttgagaaccagggtcggcactaagcatgctatcctcctggtggcagtgagcttcgtcacactaattaccgggaacatgtcgtttaaagacctgggacgcgttgtggtaatggtgggcgccactatggctgatgacatcgggatgggagtcacatatctcgccctgcttgcagcgttcaaggtgcgacccacctttgccgctggcttgctgttacggaagctcacgtccaaagagctgatgatgactaccattggtatcgttcttctgtctcaaagcacaatacctgaaaccgtgctagagctcactgatgccctggcattggggatgatggtcctgaagatcgtgcgtaatatggaaaaataccagttagctgttacaattatggccatcctctgcgtgcccaacgcagtcattctgcagaatgcctggaaggtatcatgtaccatccttgctgtggttagtgtgtccccactgttgctcacatctagccagcagaaaactgactggatacctctggcgctaaccattaagggactgaaccccacggccatcttccttacaaccctctccagaactaataaaaagaggtcatggccactgaacgaggcaatcatggctgtcggcatggtgagcattttggccagttctctgttaaagaatgacataccgatgaccggccctctcgtagccgggggactgcttacagtgtgctatgtcctgactggtcgctccgctgatttggaactcgagcgggcaaccgacgttaaatgggaggatcaggccgaaatcagcggctcgtcacccattctgtctatcacgattagtgaggacgggtccatgagcatcaagaacgaagaggaggaacagacactaaccatactgatcagaactggacttctcgtgatttctggcctgtttccaatcagcattcccatcacagcggctgcctggtacttgtgggaggtgaaaaagcagagggccggtgtcttatgggatgtgccttccccaccccctatggggaaagccgaactggaggacggagcttatcgaataaagcaaaagggcattctcggctactcacagatcggggcaggagtttacaaagaaggtaccttccacactatgtggcatgtaacacgcggcgccgtgctgatgcacaaggggaaacggatcgagccgagttgggcggatgtcaagaaagaccttattagctatggaggcggttggaagctggagggggaatggaaggagggagaagaggtgcaggttttggctctagaaccaggcaaaaatcccagagccgtgcagaccaagcctggcctgtttaaaacgaacactgggaccatcggagcagtctctctcgatttctccccaggtacatcaggcagtcccataattgacaagaaagggaaggtggtaggactgtacggcaacggtgtcgtgaccaggagcggggcctatgtttccgctatcgcccaaacagagaagtctattgaggataatcctgaaatcgagggagacatatttcgtaaacgccggcttactattatggatttacacccgggcgcaggcaagaccaaaagatacctgcccgctatcgtgagggaagccatcaagcgagggctccggacgttgattctggcgccaacacgcgtcgtggccgcagagatggaagaggctctcagaggactgcctatcaggtatcagactcccgccattcgggctgagcataccggtcgagaaatagttgaccttatgtgtcacgcaacattcaccatgagactgttgtcgccagtgcgcgtccctaactacaatctaatcattatggacgaggcccatttcactgatcccgccagcatcgctgcgaggggctatatctcaacccgtgtggaaatgggggaggcagccggaatttttatgacagctacgccaccgggctcccgggaccctttcccccagagtaacgccccaataatcgatgaggaaagagagattcccgaaaggtcttggaatagcggtcacgagtgggtaactgactttaaagggaagaccgtgtggttcgttccttccatcaaggcaggaaacgatattgccgcttgcctgcgcaaaaatggcaagaaagtcatccaactctcacgaaagacatttgactctgaatacgtgaaaaccagaactaacgattgggacttcgtggtcacaaccgatataagcgagatgggcgcgaattttaaggccgagcgggtaatcgacccaaggcgctgtatgaaacccgtgattttaacggatggggaagaacgtgttatcctggcaggacctatgccggtgactcatagttccgctgcccagagacggggtaggattggccgcaacccaaagaatgaaaacgaccagtacatctatatgggggagccccttgaaaatgacgaggattgcgcacactggaaggaggccaaaatgctgctcgacaacataaatacacctgaaggaattatccccagcatgttcgagccagaacgagagaaggtcgatgctattgacggcgaatacagattgcggggtgaggccaggaaaacctttgtggatctgatgcgcagaggggacctccctgtttggctggcgtataaggtggcagccgagggcatcaactacgctgataggcggtggtgtttcgacggaatcaaaaacaatcagatccttgaagagaacgtcgaagtggagatttggaccaaggagggcgaacgtaagaaactaaagccccgctggctggatgcccgaatctattctgacccattggctttaaaagagtttaaggagttcgcagccgggagaaaatcactgactctcaatctgattacagagatgggaaggcttcctaccttcatgacacaaaagactcgggatgctctggacaacctcgccgtattgcacacggcagaagcgggtggccgcgcctacaatcatgctctgtccgagctaccggagaccctggaaacactccttctgttaactttgctggccaccgtgacagggggaatctttctcttcctgatgagtggcagaggtatagggaagatgacccttggcatgtgctgcattatcactgcaagcatcctgctctggtatgctcagattcagccccactggatcgccgcatcgataattttggagtttttcctgatcgttttactaattccagaacctgagaaacagaggacgccccaagataaccagctgacctacgtcgtgatcgccatactcacagtggtcgctgcgactatggccaatgaaatgggatttcttgagaagaccaaaaaggacctgggcttggggtctatcgcaacacagcagccagagtccaacattctggacatcgatctccggcctgctagcgcctggaccctgtacgccgttgcaactacattcgtgacgcccatgcttcgacattcaattgaaaatagttctgtaaacgtgtccctcaccgctatcgccaatcaagcgactgtcctgatgggattgggtaaaggctggccgctgagcaagatggacattggggtgccattactagctatcggatgttattcacaggttaaccctataacactgaccgccgcactccttctgttggtggcccactacgctattatcggccccggtctgcaggcaaaggccaccagagaggcgcagaaacgcgctgccgcagggatcatgaagaatccaacagtcgatggcattactgtaatagacctcgatcccatcccttatgacccgaaatttgaaaagcaactgggacaggtgatgcttttaattctgtgcgttacacaggtgctcatgatgaggaccacatgggccttgtgtgaggctctgactctagccaccggccccatcagtacactgtgggaagggaacccaggacggttctggaataccactattgcagtcagcatggctaacatctttcgtggctcctacctcgccggtgcggggcttctgttctctataatgaaaaatacgacaaacaccagaaggggaactggcaacatcggtgagaccttgggcgagaagtggaaaagccgcctgaatgccctcgggaagtccgaatttcaaatttataagaaatcaggaatccaggaggtggatcggacactggcaaaggaaggcattaaacgaggggagactgaccaccatgctgtctctagaggaagtgccaagttaaggtggttcgtggagcgcaacatggttacccctgaaggcaaagtggtagatcttggttgcgggcggggaggctggtcgtactattgtggtggcctgaagaatgtgagagaggtcaaggggctcacaaaaggaggccccgggcacgaggaacctatcccaatgagcacgtacggatggaacctagttcgtctgcagtccggcgtggacgtctttttcataccccctgaaaagtgcgataccttgctgtgtgacattggtgagtcttcaccaaatcccactgtggaggcagggaggacactccgggtacttaacctggtggaaaattggttgaacaataacacccagttctgcatcaaagttctgaatccgtacatgcctagcgtgatcgagaagatggaagctctccaacgcaaatatggaggcgccttagtccgaaacccactgtccagaaatagtactcatgagatgtactgggtgtctaacgccagcggcaatattgtctcatccgtgaacatgataagtaggatgcttatcaaccggtttacaatgcgccacaagaaggcgacctatgaacccgatgttgacctggggagcggaacgagaaatattggtatcgagtctgagattcctaacctagacatcataggcaaaaggatcgaaaagattaaacaggagcatgaaacctcctggcactacgatcaggaccacccatataagacatgggcttaccatgggtcatatgagactaaacagaccggaagcgcatcgtctatggtaaatggcgtggtccgactcctgacaaagccctgggatgtgttgccgactgttacccaaatggccatgacagacaccactcctttcggtcagcagcgggtgtttaaggaaaaagtcgatacgcgtacacaggagcccaaggaggggaccaaaaagctgatgaaaatcactgctgaatggctctggaaggagcttggcaaaaagaagaccccaagaatgtgtacacgcgaagagttcacgaggaaagtgcggagtaacgccgcactgggcgccatttttaccgacgagaataagtggaaatccgctagagaagcggtagaggatagccgcttctgggaattagtggacaaggagaggaacctgcacttggaaggcaaatgcgagacttgtgtttacaatatgatggggaagcgagagaagaaactcggagaatttggtaaggccaaaggctcacgggcaatctggtacatgtggctgggggctagattcctagagtttgaagcccttggattcctgaacgaggatcattggttttccagggaaaattctctcagcggcgtcgagggtgaggggctgcacaagttgggatatattctgcgcgacgtgagtaaaaaggaaggcggcgcaatgtacgccgatgacacagctgggtgggacacccgtataactctcgaggatcttaagaacgaagagatggtgacaaatcacatggaaggagagcataaaaagctggccgaggcgatcttcaaattaacctatcaaaacaaggtcgttcgggtgcagagacctacacccaggggtactgtaatggacattatctcccgccgagatcagcggggcagcgggcaagtgggaacctacggcctgaatacgtttaccaacatggaagcacagttgatcagacagatggagggtgaaggggtcttcaaaaatattcagcacctcacagtgactgaggaggttgccgtgcaaaactggctggctagggtcggacgcgaaagactatctcggatggccatatcaggcgacgattgcgtggtaaagccacttgacgataggttcgcaaacgctctgaccgccctcaatgacatgggcaagatccgtaaagatattcagcagtgggagcccagtaaggggtggaacgactggacacaggttcctttttgctcccatcacttccatgaactgatcatgaaagatggacgagtgttggtcgtgccatgtcgcaatcaagacgagttaattggtagagctcggatcagccagggcgccgggtggtctctgagggaaactgcatgcctcggaaagtcgtatgcgcagatgtggtcacttatgtactttcaccgcagagatctgcggctagccgctaacgccatatgtagcgcagtgccgtcccactgggtccccaccagtaggacgacatggtctatccatgctaaacacgagtggatgaccactgaggacatgctgacagtttggaatcgagtgtggattcgtgaaaacccttggatggaggacaagaccccagtagaaagctgggaggaaatcccctatctcggcaagagagaggatcagtggtgcggttccttgattgggctgacttcacgcgccacctgggccaaaaatatccaagccgcgataaaccaggtgcggagtcttattggaaatgaggaatacacagactacatgccttctatgaagaggttcagacgcgaggaagaggaagctggcgtcctgtggtga

SEQ ID NO: 14841 - RNA, 9876 nt, synthetic construct
  misc_feature 1..9876: note = derived and/or modified CDS sequence (opt3) from DENV-2__EU482662__SS-prME
  source 1..9876: mol_type = other RNA
accgcaggagtgatcattatgctgatacccaccgctatggcattccacctcactacgagaaacggggaacctcatatgatcgtcgggaggcaggaaaaaggtaaaagccttctgtttaagaccgaggacggcgttaatatgtgcacattgatggcaattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtggcgctggtgccccatgtcggtatggggcttgagaccagaacagaaacttggatgagtagcgagggagcttggaaacacgcccagaggatcgagacctggatactgcggcatcctggcttcacaatcatggcagccattttggcttacaccatcggcacgactcactttcagaaggcactcattttcatcctgctgacagccgtggctccatccatgaccatgcgctgcatagggatttctaacagagattttgttgaaggagtgtcgggtggctcatgggtcgacatcgtgctcgagcacgggagctgtgtaactacaatggccaagaataaacccaccttagatttcgaactgattaagacggaggcgaaacagcctgcaacccttaggaagtattgcatcgaagccaaattgacaaacactaccacagagagtcggtgtccaactcaaggagagccctccctgaatgaagaacaggacaagcgctttgtttgcaagcattctatggtggatcgaggctggggtaacgggtgtggactattcggcaaaggcgggatcgtaacctgcgctatgtttacatgcaagaaaaatatggaaggaaagattgtgcagcctgagaacctcgaatacaccatagtgatcactccacacagcggtgaggagcatgccgtcggcaatgacacggggaaacacggaaaggaaattaaaatcacaccgcagtcctcaataaccgaggcagaactgactggctatggtaccgttacaatggagtgtagtcccagaaccgggcttgatttcaacgaaatggtgctgttgcaaatggaggacaaggcttggctcgtacacaggcagtggtttctggatttacctctgccatggctccccggcgccgacactcagggaagcaattggattcagaaggagacacttgtgacgttcaaaaaccctcatgcgaagaaacaagacgtcgtggttctgggctctcaggaaggggccatgcacaccgcattgactggagctacagagatccagatgtcctcaggtaatctactgtttaccggccatctcaagtgccggctgcgtatggataaacttcaactgaaggggatgagctacagtatgtgtacaggaaagttcaaaatcgtgaaggaaattgccgagactcagcacggcaccatcgtcattcgcgtgcagtatgagggtgacgggtctccatgcaaaatacccttcgaaatcatggatttggagaagagacatgtactcggcaggctgattacggttaacccgatcgtgaccgaaaaagactcccctgtcaacatcgaggctgaacccccatttggagatagctacattataatcggcgtggagcctgggcagttaaagctgaattggttcaagaaaggatcgtctattggtcaaatgtttgagacaactatgcggggcgccaagcgaatggcaatcctaggggacaccgcctgggatttcggatccctcggcggtgtctttacatcaattgggaaagctctgcaccaggtgttcggcgcgatctacggagcagcctttagtggcgttagctggactatgaagatacttatcggggctattatcacctggattggaatgaactcccgctctacgagcttgtcagtgagtctggtactcgtcggcgtgatcacactgtatcttggtgccatggttcaggcagactccgggtgtgtggtcagctggaaaaataaggaactgaagtgcggatctggcatattcattaccgataacgtgcacacttggacagagcagtacaaatttcaacccgaatcaccaagtaagttggccagcgctatccagaaagcccatgaggaaggtatttgtggcatcagatccgtaaccaggctcgagaatctgatgtggaagcagataactcccgagttaaaccacatcctgtctgaaaatgaggtgaaactaaccattatgacaggggacatcaagggaattatgcaggcaggcaaacggtcgctccgccctcaaccaacggaactgaagtatagctggaagacctgggggaaagcgaagatgctttccactgagtcacataaccagacattcttgatcgatggaccggaaaccgctgagtgccccaatacaaacagagcctggaatagtctggaggttgaagactacggctttggtgtcttcactaccaacatatggctcaaactgagggagaagcaggacgtgttttgtgattctaaattaatgagcgcagccattaaggacaatcgtgctgtgcacgccgatatggggtattggatcgaatccgcactgaacgacacgtggaagatggagaaggcttcattcatcgaggtcaagagctgccactggcctaaatctcatacactttggtccaatggagttttggaaagtgagatgattatcccaaagagcttcgccggccccgtgtctcagcacaactaccggcctggttattacacccaaactgcgggcccatggcatctcgggaaactggaaatggattttgacttctgtgagggaaccacagtggtagtcactgaagattgcggcaaccgagggccctccctaagaaccacaacggcctcaggaaagctgattaccgagtggtgctgtaggagttgcactctcccgcctctgcgctaccggggcgaggacggttgttggtatgggatggaaataagaccacttaaggagaaagaagagaatttggtgaacagcctggttacagctggacacggccagatcgataatttttcgttaggtgtgctcggcatggcactgttccttgaagagatgctgaggacccgcgtcgggactaagcatgccattttgctcgtggctgtttcctttatgacactgatcaccggaaacatgtctttccgagacctaggccgggtgatggtaatggtcggggccacgatgactgatgacattggaatgggcgtgacctacctggcactcctggcggcctttaaagtgcgtcccacattcgctgccggtcttttgctgagaaagttaaccagcaaagagctcatgatggcaactatcgggatagctctgctttcacagagtacaatccctgaaaccattctggagctaacagatgccctcgcactgggaatgatggtcttgaagatcgttaggaatatggaaaagtatcaactggccgtgactattatggctatctcctgcgtacccaacgcggtgatattacagaatgcctggaaagtctcttgtaccattctcgcagctgtgagcgtttccccactgcttctgacgtcaagccagcagaaggccgactggatccctttggccctcacaatcaaaggcctgaaccccaccgctatttttctaactaccctgagtcgcacatctaagaaacggtcctggccacttaatgaggcaataatggccgtgggcatggtcagcatcctcgcgtcgtcactgttgaagaacgacattccgatgactgggcctctggtggctggaggtttactcaccgtttgctacgtgctgacgggcagatctgccgatcttgaactggagagggcaacagacgtcaaatgggaggatcaagccgaaatcagtgggtccagccccattttgtctatcaccataagcgaggacggatccatgtcaatcaagaatgaagaggaggaacagactctcacaattctgatccgaaccggcctactggtaattagtggtcttttcccagtgagcatccccataactgctgcagcctggtatctctgggaggttaagaaacagcgcgcgggggtgctgtgggatgtcccttctccaccccctgtgggaaaggctgaattggaggacggcgcctaccggattaaacagaagggcatcttagggtattcccaaatcggagccggtgtctacaaagaaggcacatttcacaccatgtggcacgtgacgagaggggcagtcctgatgcataggggaaagcgtattgagccgtcatgggctgatgttaagaaagacctcatcagttacggcggtgggtggaagctggagggagaatggaaagagggcgaagaggtacaggtgcttgccctggaaccaggcaagaacccccgcgcagtccagactaaacctgggttgttcaagaccaatacaggaaccataggtgctgtgagcctagatttttccccaggcacatctgggtcgcccattgttgaccggaagggaaaagtagtgggcctgtatggtaacggggtcgtgactagaagcggagcctacgtttcagcgatcgcccagaccgagaagtccattgaggataatcctgaaatcgaggacgatatattcaggaaaaagcgactcacgattatggacctgcacccgggcgcaggcaaaacaaagcggtatcttcccgctatcgtgcgcgaagccatcaagagagggttaaggactctgattctcgctccaacccgggtcgtggcagccgagatggaagaggccttgcgaggactgcctatcagataccaaacacccgctattcgcgcggagcataccggtagggaaatagtagacctcatgtgtcacgcaactttcaccatgcgtctgcttagtccagtccgggtgcctaactataacctgatcattatggatgaggcccattttacagaccccgcttctatcgccgcaagaggctacatcagcacgagggttgaaatgggggaggccgctggaattttcatgactgcgaccccaccgggctcccgcgatccttttccccagtcaaatgccccaataatcgacgaggaacgagagattcccgaaagatcttggaacagcggtcacgagtgggtgacagatttcaaagggaagaccgtctggtttgtgcctagtatcaaagcaggaaatgacattgctgcctgcttgcggaagaacggcaaaaaggttatccagctatccaggaagactttcgatagcgaatatgtgaaaacacgcaccaatgactgggattttgtcgtgacgactgacatatctgagatgggcgcaaacttcaaggccgagcgtgtaatcgatccaagacggtgtatgaaacccgtgattctgacagacggggaagagagggttatcctcgctggacctatgccggtcacccactcatccgccgcgcaacgccgaggtagaattggccggaatccaaagaacgaaaatgaccagtacatctacatgggggagcccttagaaaacgatgaggactgcgcacattggaaagaggccaagatgctgcttgataatataaacacccctgaaggaattatccccagtatgtttgagccagaaagggagaaagtggacgctattgatggcgaatatcgcctgagaggtgaggccaggaagactttcgtggacctcatgcggcgtggggatttgcctgtctggctggcttaccgcgtagcagccgagggcatcaattatgctgaccgaagatggtgttttgatggagtgaagaacaatcagatactcgaagagaacgttgaagtggagatctggacaaaagagggcgaaaggaagaaactgaagccccggtggcttgacgcccgcatttacagcgatccactagcactgaaagagttcaaggagttcgcggccgggagaaagtcgttgaccttaaacctgatcacagagatgggaaggctccctacttttatgacgcagaaagctcgggacgccctggataatcttgcagtcctgcacaccgctgaagccggtggccgagcatataaccatgccctctctgagttgccggagacactggaaactctactgctccttaccctgttagctacagtgaccgggggaattttcttgtttctgatgtccggcaagggtgttgggaaaatgactctcggcatgtgctgcatcataacggcgagcattctgctttggtacgcccaaatccagccccactggatcgcagcttcaattatcctggagttctttctcatagtgttgctgattccagaacctgagaagcagagaacaccccaggacaatcaattaacatatgtcgtgatcgccattctaactgtagtggccgcaaccatggctaacgaaatgggattcctggagaaaacaaagaaggacctcggccttgggagtatcgccacccaggagccagaatctaatatactggatatcgacttgcgccctgcgtccgcttggactctgtacgccgttgcaacaacgtttgtcacccccatgctcaggcacagcattgagaactcaagtgtgaatgtgagcctgactgccatcgctaaccaggcaacagtccttatgggactcggtaaaggctggccgctgtccaagatggatattggggttccattgctggccatcggatgttactctcaggtgaatcctattaccttaaccgcggctctactgctccttatcgcccattatgcaataattggccccggtctgcaagccaaagctacacgggaagcccagaagcgtgcagctgccgggatcatgaaaaacccaactgtagacggcatcacggtgattgatttggaccccataccttacgatccgaagttcgagaagcagctgggacaggtcatgctcctgatcctttgcgtgacccaagttttaatgatgagaacaacttgggcgctgtgtgaagccctcaccttggcaacaggccccattagcaccctgtgggaggggaatccaggaaggttttggaacactacgatcgctgtgtccatggccaatattttccgcggctcatatctagccggtgctgggctgctcttttctatcatgaaaaacacaaccaatactcggcgaggaaccggcaacataggtgagacacttggcgaaaagtggaaaagtagactgaatgccttggggaagtcggagttccagatctacaaaaagagcggcattcaggaagtcgacaggactctggccaaagagggcatcaagcgcggggagaccgatcaccatgcggtatcccggggatctgctaagctcagatggtttgtggaacgtaacatggttacacctgagggcaaagtggtcgacctgggttgcgggaggggaggctggtcatattactgtggtggcttaaagaacgtgcgggaagtcaaagggcttacgaagggaggccccgggcacgaggaacctattccaatgagcacctatggatggaatctggtgcgcctccaatccggcgttgatgtgttcttcactccccctgagaaatgcgacacactactgtgtgatatcggtgagagttctccaaaccccaccatagaagcagggcgaactttgagagtactgagcctcgtggagaattggcttaacaatgacacacagttttgcattaaggtcctgaacccgtacatgccttcagttatcgaaaagatggagaccttgcagaggaaatacggaggcgccctggtgcggaatccactctcccgcaacagtacgcatgaaatgtattgggtcagcaatgctaccggcaacatcgtgtcttccgtaaatatgatttcaagaatgttaataaacaggttcacaatgaagcacaaaaaggccacttacgagcccgacgtggatctggggagcggaacccgaaatatcggtattgagtcggaaatccctaaccttgacattatcggcaaacggatagagaagatcaagcaggaacacgagacatcttggcattatgatcaagaccacccatacaaaacttgggcatatcatgggagttacgaaaccaagcagacaggatccgccagctcaatggttaatggcgtggtccgtctgctaaccaaaccctgggatgtggtcccgatggtgactcagatggctatgacggacacaaccccttttggtcagcaaagagttttcaaggagaaagtagatactcgcacccaggagcccaaggaagggacaaagaaactcatgaagattacggcggagtggctgtggaaagaattgggaaagaaaaagaccccaaggatgtgtactcgggaggagtttacaagaaaagtgcgctccaacgccgcactgggcgctatcttcaccgacgaaaacaagtggaagtctgccagggaggcagtcgaagatagccgattttgggagctcgtggacaaagaacggaatcttcacctggagggcaagtgcgagacttgtgtttataacatgatggggaaaagagaaaagaaattaggagagttcggtaaggccaagggcagtagggctatttggtacatgtggctgggggcccgctttttggagttcgaggcgctcggatttctgaatgaagatcactggttctcccgtgagaacagcctatctggcgtggagggtgaagggcttcataaactgggatacatcctccgggacgtctcaaagaaagagggcggcgcaatgtatgccgacgatacagctgggtgggacaccagaattacactggaagatttgaagaatgaggaaatggtgactaaccacatggagggagagcataaaaggctggccgaagcaatatttaagctcacctaccagaataaggtagtgcgcgttcagcgacctacgccccggggtaccgtcatggacatcattagtagaagggatcaacgcggctccggacaggtgggaacatatggccttaacactttcaccaatatggaggctcagctgatcagacaaatggaaggtgaggggatcttcaaaagcattcagcacttaacagtgactgaggaaatagccgtccagaactggctggctcgggttggaagggagcgtttgtctcgaatggccatctcgggcgacgattgcgtggtaaagccactcgacgatcgctttgcatcagcgctgaccgccctaaatgacatgggcaaagtgagaaaggatattcagcaatgggaacccagcaaagggtggaacgactggacgcaggtccctttctgctcccatcactttcacgagcttatcatgaaggatggacgggtgctggttgtgccatgtaggaatcaggacgaactcattggtcgcgctagaatcagtcagggcgccgggtggtctctgaaggagacagcatgcttgggaaaaagctacgctcaaatgtggtccttaatgtatttccatcggagggacctgcgactcgccgcaaacgccatatgttcagcggtcccgagtcactgggtgcccacctctcgtactacatggagcatccatgctaagcacgagtggatgaccactgaagatatgcttaccgtatggaatagagtttggattcaggagaacccttggatggaagacaaaacaccagtggagtcctgggaagaggtcccctacctgggcaagcgcgaggatcagtggtgcggttcactaatcgggctgacgagccgggccacctgggccaaaaacattcagactgccatcaatcaagtgaggtctctcataggaaacgaagagtatacagactacatgccttccatgaagagatttcgccgggaagaggaagaggctggcgtgttgtggtga

SEQ ID NO: 14842 - RNA, 9876 nt, synthetic construct
  misc_feature 1..9876: note = derived and/or modified CDS sequence (opt3) from DENV-2__EU482663__SS-prME
  source 1..9876: mol_type = other RNA
agcgccggcatgataattatgctgatacccaccgtgatggctttccacctcactactcggaacggggaacctcatatgatcgtcggtattcaagaaaagggaaaatcccttctgtttaagacggaagacggcgttaatatgtgcaccttgatggcaatggatttaggggaactgtgtgaggacacaatcacttacaaatgcccacttctcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactgccgagtgccccaatacaaacagagcatggaatagtctggaagtggaggattacggatttggcgtgttcaccacaaacatctggctcaagctgaaagaaaagcaggacgtattttgtgactctaagttaatgagcgcggctattaaagataatagggccgtccatgcagacatgggttattggatcgagtccgccctgaacgatacttggaagatagagaaggcttcattcattgaagtgaagaattgccactggcctaaaagccataccctttggtctaacggggttttggagtccgaaatgatcatcccaaagaacctcgccggacccgtgagtcaacacaattaccgtcctggctaccacacgcagattgcaggtccatggcatctgggcaagctagagatggacttcgatttttgtgacgggacaaccgtcatcgtgactgaagattgcggaaaccggggccccagcctgcgaaccacaactgcttctgggaaactcattaccgagtggtgctgtagatcctgcacactgccgcctcttaggtatcgcggagaggacggctgttggtacggtatggaaatacggccattgaaggagaaagaagagaatctggttaactcattagtgacggccgggcacggacaggtagataatttcagtctcggcgtcctgggtatggcgctttttctggaagagatgttgagaaccagggtgggcactaagcatgccatcctcctggtggctgtcagcttcgttacactaattaccgggaacatgtcgtttaaagacctgggacgcgtggtagtgatggtcggcgcaactatggccgatgacatcgggatgggagtgacatatctcgctctgcttgccgcattcaaggttcgacccacctttgcggccggcttgctgttacggaagctcacgtccaaagagctgatgatgactaccattggtatcgtgcttctgtctcaaagcacaatacctgaaaccgtcctagagctcactgatgctctggccttggggatgatggtgctgaagatcgttcgtaatatggaaaaataccagttagcagtgacaattatggctatcctctgcgtccccaacgccgtaattctgcagaatgcatggaaggtgtcatgtaccatccttgccgttgtgagtgtctccccactgttgctcacatctagccagcagaaaactgactggatacctctggctctaaccattaagggactgaaccccacggcgatcttccttacaaccctctccagaactaataaaaagaggtcatggccactgaacgaggccatcatggcagtgggcatggtaagcattttggctagttctctgttaaagaatgacataccgatgaccggccctctcgtggccgggggactgcttacagtctgctatgttctgactggtcgctccgccgatttggaactcgagcgggctaccgacgtgaaatgggaggatcaggcagaaatcagcggctcgtcacccattctgtctatcacgattagtgaggacgggtccatgagcatcaagaacgaagaggaggaacagacactaaccatactgatcagaactggacttctcgtgatttctggcctgtttccaatcagcattcccatcacagccgcggcttggtacttgtgggaggtcaaaaagcagagggccggtgtgttatgggatgttccttccccaccccctatggggaaagcagaactggaggacggagcctatcgaataaagcaaaagggcattctcggctactcacagatcggggctggagtatacaaagaaggtaccttccacactatgtggcatgtgacacgcggcgcagtcctgatgcacaaggggaaacggatcgagccgagttgggccgatgtgaagaaagaccttattagctatggaggcggttggaagctggagggggaatggaaggagggagaagaggttcaggtgttggcgctagaaccaggcaaaaatcccagagctgtccagaccaagcctggcctgtttaaaacgaacactgggaccatcggagccgtgtctctcgatttctccccaggtacatcaggcagtcccataattgacaagaaagggaaggtagtcggactgtacggcaacggtgtggttaccaggagcggggcatatgtgtccgccatcgctcaaacagagaagtctattgaggataatcctgaaatcgaggacgatatatttcgtaaacgccggcttactattatggacttacacccgggagccggcaagaccaaaagatacctgcccgcaatcgtcagggaagctatcaagcgaggcctccggacgttgattctggccccaacacgcgtggttgcggccgagatggaagaggcactcagagggctgcctatcaggtatcagactcccgctattcgggccgagcataccggacgagaaatagtggaccttatgtgtcacgctacattcaccatgagactgttgtcgccagtccgcgtgcctaactacaatctaatcattatggatgaggcacatttcactgaccccgccagcatcgccgctaggggttatatctcaacccgtgtagaaatgggcgaggcggcagggatttttatgacagccacgccaccgggatcccgggatcctttcccccagagtaacgctccaataatcgacgaggaaagagagattcccgaaaggtcttggaatagcggccacgagtgggtgactgattttaaaggtaagaccgtttggttcgtcccttccatcaaggccgggaacgacattgcagcctgcctgcgcaaaaatggaaagaaagtgatccaactctcacgaaagacatttgattctgaatacgtgaaaaccagaactaacgactgggatttcgtcgtaacaaccgacataagcgagatgggcgctaattttaaggcggagcgggtgatcgatccaaggcgctgtatgaaacccgttattttaacggacggcgaagaacgtgtgatcctggccgggcctatgccggtcactcatagttccgcagctcagagacggggaaggattggtcgcaacccaaagaatgaaaacgaccagtacatctatatgggcgagccccttgaaaatgatgaggactgcgcccactggaaggaggcaaaaatgctgctcgataacataaatacacctgaagggattatccccagcatgttcgagccagaacgagagaaggtggacgccattgatggagaatacagattgcggggcgaggctaggaaaacctttgttgacctgatgcgcagaggtgatctccctgtgtggctggcctataaggtcgcggcagaggggatcaactacgccgacaggcggtggtgtttcgatggcatcaaaaacaatcagatccttgaagagaacgtggaagtagagatttggaccaaggagggagaacgtaagaaactaaagccccgctggctggacgctcgaatctattctgatccattggccttaaaagagtttaaggagttcgctgcaggcagaaaatcactgactctcaatctgattacagagatggggaggcttcctaccttcatgacacaaaagactcgggacgccctggataacctcgctgtgttgcacacggccgaagcaggaggtcgcgcgtacaatcatgccctgtccgagctaccggagaccctggaaacactccttctgttaactttgctggctaccgttacaggcgggatctttctcttcctgatgagtggaagaggcataggtaagatgacccttgggatgtgctgcattatcactgccagcatcctgctctggtatgcacagattcagccccactggatcgctgcctcgataattttggagtttttcctgatcgtcttactaattccagaacctgagaaacagaggacgccccaagacaaccagctgacctacgtggtgatcgcaatactcacagtcgttgccgctactatggcgaatgaaatgggctttcttgagaagaccaaaaaggacttcggactgggctctatcgccacacagcagccagagtccaacattttggatatcgacctgcggcctgcaagcgcttggaccctctacgccgtggccactacatttgtaacgcccatgctgcgacattcaattgaaaatagttctgtgaacgtctcccttaccgcaatcgctaatcaagccactgtgctcatggggctgggaaaaggttggccgttgagcaagatggatattggcgttccactgttagcgatcgggtgttattcacaggtgaaccctataacactaaccgctgccctgctccttctggtcgcacactacgccattatcggacccggcttgcaggctaaggcaaccagagaggcccagaaacgcgcggctgccggtatcatgaagaatccaacagtagacgggattactgtgatagatctggaccccatcccttatgatccgaaattcgaaaagcaactcggccaggttatgctgcttattttatgcgtgacgcaggtcctgatgatgaggaccacatgggcactctgtgaggccttgactctggctaccggacccatcagtacactatgggaaggcaacccagggcggttttggaataccactattgccgtgagcatggcaaacatcttccgtggatcctacctggctggcgccggtctcctattttctataatgaaaaatacgacaaacaccagaagggggactggaaacatcggcgagaccctgggtgagaagtggaaaagccgcttgaatgcgctgggcaagtccgagttccaaatttataagaaatcagggatccaggaggtcgaccggacactcgccaaggaaggaattaaacgaggcgagactgatcaccatgcagtgtctagagggagtgctaagctgaggtggtttgttgagcgcaacatggtgacccctgaaggaaaagtagtggacttaggctgcggtagagggggatggtcgtactattgtggcggtcttagaaatgtccgtgaggttaagggcctgacaaaagggggacccggccacgaagaacctatcccaatgagcacgtacgggtggaacctcgtgaggctacagtccggagtcgatgtgttcttcataccccctgaaaaatgcgacaccctgttgtgtgatattggcgagtcttcaccaaatcccactgtagaggccggtcggacactgcgcgtgctcaaccttgttgaaaattggctgaacaataacacccagttttgcatcaaggtgttgaatccgtacatgcctagcgtcatcgagaaaatggaagcactgcaacgaaagtatgggggagctctcgtgagaaacccattatccaggaatagtactcatgagatgtactgggtctctaacgccagcggcaatattgtgtcatccgttaacatgataagtcggatgctgatcaaccgcttcacaatgagacacaaaaaggccacctatgaacccgacgtagaccttggcagcgggacgaggaatattggaatcgagtctgagattcctaacctggatatcataggtaagcgaatcgagaaaattaagcaggagcatgaaacctcctggcactacgaccaggatcacccatataaaacatgggcgtaccatggctcatatgagactaagcagaccgggagcgcttcgtctatggtgaatggagtcgtgcggctactcacaaaaccctgggacgttctgccgactgtgacccaaatggcaatgacagataccactccttttggccagcagcgtgtcttcaaggaaaaggtggacacgagaacacaggagcccaaagagggtaccaagaaattgatgaagatcactgccgaatggctgtggaaagagctcgggaagaaaaagaccccacgcatgtgtacaagggaagagtttacgcggaaggtaagaagtaacgctgcccttggagcaattttcaccgatgagaataaatggaagtccgcccgcgaagctgtggaggacagcaggttttgggaactggttgataaagagcgaaacttacacctggaaggcaagtgcgagacttgtgtctacaatatgatgggcaaacgggagaagaagttgggggagttcggaaaagcgaagggttcaagagccatctggtacatgtggctcggcgcaaggtttctggagttcgaagctctagggtttcttaacgaggaccattggttctcccgcgaaaattctctgagcggagtggagggcgagggtctccacaaactggggtatattttgcgtgatgtgagtaagaaagaaggaggcgccatgtacgcagacgacacagccggctgggatacccggataactctggaggacctcaagaacgaagagatggtcacaaatcacatggaaggggagcataagaaacttgctgaggccatctttaagctgacctatcaaaacaaagttgtgagagtacagaggcctacaccccgcggaactgtgatggatattatctcccgacgggaccagagaggtagcggccaagtcgggacctacggattaaatacgttcaccaacatggaagcgcagctgatcaggcagatggagggcgaaggtgtgttcaagaatattcagcacttgacagttactgaggaggtggcagtccaaaactggctcgcccgcgtggggagagaacggctgtctaggatggctatatcaggagatgactgcgtagttaaaccactagatgaccgttttgccaacgcacttaccgctctgaatgatatgggcaagatccgaaaggacattcagcagtgggagcccagtaaaggctggaacgattggacacaggtgcctttctgctcccatcactttcatgaactcatcatgaaggacgggcgcgtcctggtggtgccatgtagaaatcaagatgagttgattggacgggccaggatcagccagggtgctggctggtctttacgcgaaactgcctgcctggggaaatcgtatgcacagatgtggtcactcatgtacttccacagacgggaccttaggctggcggccaacgctatatgtagcgccgtcccgtcccactgggttcccaccagtcgaacgacatggtctatccatgcaaagcacgagtggatgaccactgaggacatgctaacagtgtggaatcgtgtatggattagagaaaacccttggatggaggataaaaccccagtggaaagctgggaggaaatcccctatctgggaaagcgcgaggaccagtggtgcggctccctcattggtttgacttcacgggctacctgggccaagaatatccaagcagccataaaccaggtcaggagtctgattgggaatgaggaatacatcgattacatgccttctatgaaaagatttcgccgggaggaagaggaagcgggagtgctttggtga

SEQ ID NO: 14843 - RNA, 9876 nt, synthetic construct
  misc_feature 1..9876: note = derived and/or modified CDS sequence (opt3) from DENV-2__EU482664__SS-prME
  source 1..9876: mol_type = other RNA
accgccggagtgatcattatgctgatacccacagctatggcattccacctcactacgaggaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagacccggacagaaacttggatgagtagcgagggagcttggaaacacgcccagaggatcgagacctggatactgcggcatcctggcttcacaatcatggcagccattttggcttacaccatcggcacgactcactttcagcgcgcactcattttcatcctgctgacagccgtggctccatccatgaccatgcgttgcatagggatttctaacagggattttgttgaaggagtgtcgggtggctcatgggtcgacatcgtgctcgagcacgggagctgtgtaactacaatggccaagaataagcccaccttagatttcgaactgattaaaacggaggcgaagcagcctgcaacccttcggaaatattgcatcgaagccaagttgacaaacactaccacagagagtcgctgtccaactcaaggagagccctccctgaatgaagaacaggacaaacgatttgtttgcaagcattctatggtggatagaggctggggtaacgggtgtggactattcggcaagggcgggatcgtcacatgcgctatgtttacatgcaaaaagaatatggaaggaaaaattgtgcagcctgagaacctcgaatacaccatagtgatcactccacacagcggtgaggagcatgccgtcggcaatgacacggggaagcacggaaaagaaattaagatcacaccgcagtcctcaataaccgaggcagaactgactggctatggtaccgttacaatggagtgtagtcccaggaccgggcttgatttcaacgaaatggtgctgttgcaaatggaggacaaggcttggctcgtacaccggcagtggtttctggatttacctctgccatggctccccggcgccgacactcagggaagcaattggattcagaaggagacacttgtgacgttcaagaaccctcatgcgaaaaagcaagacgtcgtggttctgggctctcaggaaggggccatgcacaccgcattgactggagctacagagatccagatgtcctcaggtaatctactgtttaccggccatctcaaatgccgtctgcgcatggataaacttcaactgaaagggatgagctacagtatgtgtacaggaaagttcaagatcgtgaaagaaattgccgagactcagcacggcaccatcgtcattagagtgcagtatgagggtgacgggtctccatgcaagatacccttcgaaatcatggatttggagaaaaggcatgtactcggccggctgattacggttaacccgatcgtgaccgaaaaggactcccctgtcaacatcgaggctgaacccccatttggagatagctacattataatcggcgtggagcctgggcagttaaaactgaattggttcaagaagggatcgtctattggtcaaatgtttgagacaactatgcgaggcgccaaacgcatggcaatcctaggggacaccgcctgggatttcggatccctcggcggtgtctttacatcaattgggaaggctctgcaccaggtgttcggcgcgatctacggagcagcctttagtggcgttagctggactatgaaaatacttatcggggctattatcacctggattggaatgaactccagatctacgagcttgtcagtgagtctggtactcgtcggcgtgatcacactgtatcttggtgccatggttcaggcagactccgggtgtgtggtcagctggaagaataaagaactgaagtgcggatctggcatattcattaccgataacgtgcacacttggacagagcagtacaagtttcaacccgaatcaccaagtaaattggccagcgctatccagaaggcccatgaggaaggtatttgtggcatcaggtccgtaacccggctcgagaatctgatgtggaaacagataactcccgagttaaaccacatcctgtctgaaaatgaggtgaagctaaccattatgacaggggacatcaaaggaattatgcaggcaggcaagcgctcgctcagacctcaaccaacggaactgaaatatagctggaagacctgggggaaggcgaaaatgctttccactgagtcacataaccagacattcttgatcgatggaccggaaaccgctgagtgccccaatacaaacagggcctggaatagtctggaggttgaagactacggctttggtgtcttcactaccaacatatggctcaagctgcgtgagaaacaggacgtgttttgtgattctaagttaatgagcgcagccattaaagacaatcgggctgtgcacgccgatatggggtattggatcgaatccgcactgaacgacacgtggaagatggagaaggcttcattcatcgaggtcaaaagctgccactggcctaagtctcatacactttggtccaatggagttttggaaagtgagatgattatcccaaaatcattcgccggccccgtgtctcagcacaactaccgacctggttattacacccaaactgcgggcccatggcatctcgggaagctggaaatggattttgacttctgtgagggaaccacagtggtagtcactgaagattgcggcaacagagggccctccctaaggaccacaacggcctcaggaaaactgattaccgagtggtgctgtcgcagttgcactctcccgcctctgcggtacagaggcgaggacggttgttggtatgggatggaaataaggccacttaaggagaaggaagagaatttggtgaacagcctggttacagctggacacggccagatcgataatttttcgttaggtgtgctcggcatggcactgttccttgaagagatgctgcgcacccgagtcgggactaaacatgccattttgctcgtggctgtttcctttgtgacactgatcaccggaaacatgtctttccgggacctaggccgtgtaatggtcatggtgggggccacgatgactgatgacattggaatgggcgtgacctacctggcactcctggcggcctttaaggtcagacccacattcgctgccggtcttttgctgaggaaattaaccagcaaggagctcatgatggcaactatcgggatagctctgctttcacagagtacaatccctgaaaccattctggagctaacagatgccctcgcactgggaatgatggttttgaaaatcgtgcgcaatatggaaaagtatcaactggccgtaactattatggctatctcctgcgtgcccaacgcggtcatattacagaatgcctggaaggtgtcttgtaccattctcgcagctgttagcgtgtccccactgcttctgacgtcaagccagcagaaagccgactggatccctttggccctcacaatcaagggcctgaaccccaccgctatttttctaactaccctgagtcggacatctaaaaagagatcctggccacttaatgaggcaataatggccgtcggcatggtgagcatcctcgcgtcgtcactgttgaaaaacgacattccgatgactgggcctctggttgctggaggtttactcaccgtgtgctacgtcctgacgggcaggtctgccgatcttgaactggagcgagcaacagacgtaaagtgggaggatcaagccgaaatcagtgggtccagccccattttgtctatcaccataagcgaggacggatccatgtcaatcaaaaatgaagaggaggaacagactctcacaattctgatccgcaccggcctactggtgattagtggtcttttcccagttagcatccccataactgctgcagcctggtatctctgggaggtgaagaagcagcgggcgggggtcctgtgggatgtgccttctccaccccctgtaggaaaagctgaattggaggacggcgcctacagaattaagcagaaaggcatcttagggtattcccaaatcggagctggtgtgtacaaggaaggcacatttcacaccatgtggcacgtcacgagaggggcagttctgatgcatcgtggaaaacgcattgagccgtcatgggcagatgtgaagaaggacctcatcagttacggcggtgggtggaaactggagggagaatggaaggagggcgaagaggtgcaggtccttgccctggaaccaggcaaaaacccccgggcagtgcagactaagcctgggttgttcaaaaccaatacaggaaccataggtgctgttagcctagatttttccccaggcacatctgggtcgcccattgtagacagaaagggaaaggtggtcggcctgtatggtaacggggtggttactaggagcggagcctacgtgtcagcgatcgcccagaccgagaaatccattgaggataatcctgaaatcgaggacgatatattccgaaagaaacggctcacgattatggacctgcacccgggcgcaggcaagacaaaacgctatcttcccgctatcgtcagagaagccatcaagagggggttacggactctgattctcgctccaacccgagtggtagcagccgagatggaagaggccttgagaggactgcctatccgctaccaaacacccgctattagggcggagcataccggtcgtgaaatagtcgacctcatgtgtcacgcaactttcaccatgcggctgcttagtccagtgagagttcctaactataacctgatcattatggatgaggcccattttacagaccccgcttctatcgccgcaaggggctacatcagcacgcgcgtggaaatgggggaggccgctggaattttcatgactgcgaccccaccgggctcccgagatccttttccccagtcaaatgccccaataatcgacgaggaaagagagattcccgaacggtcttggaacagcggtcacgagtgggtcacagatttcaaggggaaaaccgtgtggtttgttcctagtatcaaggcaggaaatgacattgctgcctgcttgaggaaaaacggcaagaaagtgatccagctatcccgcaagactttcgatagcgaatatgtcaagacacgtaccaatgactgggattttgtggtaacgactgacatatctgagatgggcgcaaacttcaaagccgagagagtgatcgatccacggaggtgtatgaagcccgttattctgacagacggggaagaacgcgtcatcctcgctggacctatgccggtgacccactcatccgccgcgcaacgaagaggtcggattggcaggaatcccaaaaacgaaaatgaccagtacatctacatgggggagcccttagaaaacgatgaggactgcgcacattggaaggaggccaaaatgctgcttgataatataaacacccctgaaggaattatccccagtatgtttgagccagaacgcgagaaggtggacgctattgatggcgaatatagactgaggggtgaggcccggaaaactttcgtcgacctcatgcgtcgcggggatttgcctgtatggctggcttaccgagtggcagccgagggcatcaattatgctgacagaaggtggtgttttgatggagttaagaacaatcagatactcgaagagaacgtggaagtcgagatctggacaaaggagggcgaacggaaaaagctgaaaccccgctggcttgacgccagaatttacagcgatccactagcactgaaggagttcaaagagttcgcggccgggaggaagtcgttgaccttaaacctgatcacagagatgggacggctccctacttttatgacgcagaaggctcgagacgccctggataatcttgcagtgctgcacaccgctgaagccggtggcagagcatataaccatgccctctctgagttgccggagacactggaaactctactgctccttaccctgttagctacagttaccgggggaattttcttgtttctgatgtccggcaaaggtgtggggaagatgactctcggcatgtgctgcatcataacggcgagcattctgctttggtacgcccaaatccagccccactggatcgcagcttcaattatcctggagttctttctcatagtcttgctgattccagaacctgagaaacagcgcaccccacaggacaatcaattaacatatgtggtaatcgccattctaactgtggttgccgcaaccatggctaacgaaatgggattcctggagaagaccaaaaaggacctcggccttgggagtgtcgccacccaggagccagaatctaatatcctggatatagacttgaggcctgcgtccgcttggactctgtacgccgtggcaacaacgtttgtgacccccatgctccggcacagcatcgagaactcaagtgtcaatgttagcctgactgccattgctaaccaggcaacagtgcttatgggactcggtaagggctggccgctgtccaaaatggatatcggggtaccattgctggccattggatgttactctcaggtgaatcctatcaccttaaccgcggctctactgctccttattgcccattatgcaatcataggccccggtctgcaagccaaggctacacgtgaagcccagaaaagagcagctgccgggattatgaagaacccaactgtcgacggcatcacggtgatcgatttggaccccattccttacgatccgaaattcgagaagcagctgggacaggttatgctcctgatactttgcgtgacccaagtcttaatgatgaggacaacttgggcgctgtgtgaagccctcaccttggcaacaggccccatcagcaccctgtgggaggggaatccaggacgcttttggaacactacgattgctgtatccatggccaatatcttccggggctcatatctagccggtgctgggctgctcttttctattatgaagaacacaaccaatactcgaagaggaaccggcaacatcggtgagacacttggcgaaaaatggaagagtaggctgaatgccttggggaaatcggagttccagatatacaagaaaagcggaatccaggaagtggaccgcactctggccaaggagggcattaaaagaggggaaaccgatcaccatgcggtttccagaggatctgctaagctccgttggtttgtggaaaggaacatggtcacacctgagggcaaggtggtcgacctgggttgcgggcggggaggctggtcatattactgtggtggccttaaaaacgtgcgcgaagttaaggggctaacgaaaggaggccccgggcacgaggaacctatcccaatgagcacctatggatggaatctggtgcgactccaatccggcgtagatgtgttcttcactccccctgagaagtgcgacacactactgtgtgatattggtgagagttctccaaaccccaccatcgaagcagggagaactttgagggtcctgagcctcgttgagaattggcttaacaatgacacacagttttgcataaaagtgctgaacccgtacatgccttcagtcattgaaaagatggagaccttgcagcggaagtacggaggcgccctggtgcgcaatccactctccagaaacagtacgcatgaaatgtattgggtaagcaatgctaccggcaacatcgtgtcttccgttaatatgatctcaaggatgttaattaaccgattcacaatgaaacacaagaaagccacttacgagcccgacgtggatctggggagcggaacccggaatataggtatcgagtcggaaattcctaaccttgacatcattggcaagcgtatcgagaaaataaagcaggaacacgagacatcttggcattatgatcaagaccacccatacaagacttgggcatatcatgggagttacgaaaccaaacagacaggatccgccagctcaatggtcaatggcgtggtcagactgctaaccaagccctgggatgtggttccgatggtaactcagatggctatgacggacacaaccccttttggtcagcaacgcgtgttcaaagagaaggtcgatactaggacccaggagcccaaagaagggacaaagaagctcatgaaaatcacggcggagtggctgtggaaggaattgggcaaaaagaaaaccccacggatgtgtactagagaggagtttacacgcaaggtgaggtccaacgccgcactgggcgctattttcaccgacgaaaacaaatggaagtctgcccgagaggcagttgaagatagccggttttgggagctcgtggacaaggaaagaaatcttcacctggagggcaaatgcgagacttgtgtctataacatgatggggaagagggagaaaaagttaggagagttcggtaaagccaagggcagtcgcgctatctggtacatgtggctgggggccagatttttggagttcgaggcgctcggatttctgaatgaagatcactggttctcccgggagaacagcctatctggcgtggagggtgaagggcttcataagctgggatacattctcagagacgtaagcaaaaaggagggcggcgcaatgtatgccgacgatacagctgggtgggacaccaggatcacactggaagatttgaaaaatgaggaaatggtgactaaccacatggagggagagcataagcgcctggccgaagcaatttttaaactcacctaccagaataaggttgtccgagtgcagcggcctacgcccagaggtaccgtgatggacataatcagtaggcgcgatcaaagaggctccgggcaggtcggaacatatggccttaacactttcaccaatatggaggctcagctgattcggcaaatggaaggtgaggggatcttcaagagcatccagcacttaacagttactgaggaaattgccgtgcagaactggctggctagggtaggacgtgagcgattgtctcgcatggccatatcgggcgacgattgcgtggtcaaaccactcgacgatagatttgcatcagcgctgaccgccctaaatgacatgggcaaggtgcggaaagatatccagcaatgggaacccagcaaggggtggaacgactggacgcaggttcctttctgctcccatcactttcacgagcttattatgaaagatggaagggtgctggtcgtgccatgtcgcaatcaggacgaactcatcggtagagctcggattagtcagggcgccgggtggtctctgaaggagacagcatgcttgggaaagagctacgctcaaatgtggtccttaatgtatttccataggcgagacctgcgtctcgccgcaaacgccatctgttcagcggtaccgagtcactgggttcccacctctagaactacatggagcatacatgctaaacacgagtggatgaccactgaagatatgcttaccgtgtggaatcgcgtctggatccaggagaacccttggatggaagacaagacaccagtggagtcctgggaagaggtgccctacctgggcaaacgggaggatcagtggtgcggttcactaattgggctgacgagcagggccacctgggcaaagaacatccagactgccattaatcaagtcagatctctcatcggaaacgaagagtatacagactacatgccttccatgaaacgctttcggagggaagaggaagaggctggcgttttgtggtga

SEQ ID NO: 14844 - RNA, 9876 nt, synthetic construct
  misc_feature 1..9876: note = derived and/or modified CDS sequence (opt3) from DENV-2__EU482665__SS-prME
  source 1..9876: mol_type = other RNA
agcgcaggcatgataattatgctgatacccaccgtgatggctttccacctcactactagaaacggggaacctcatatgatcgtcggtattcaagaaaagggaaaatcccttctgtttaagacggaggacggcgttaatatgtgcaccttgatggcaatggatttaggggaactgtgtgaggacacgatcacttacaaatgcccacttctcaggcaaaacgaaccggaggatattgactgttggtgcaattctacctcaacatgggtgacctatggaacttgtacaaccacgggcgagcaccggcgcgaaaagcgaagtgtagcactggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactgccgagtgccccaatacaaacagagcatggaatagtctggaagtggaggattacggatttggcgtgttcaccacaaacatctggctcaagctgaaagaaaagcaggacgcgttttgtgactctaagttaatgagcgctgccattaaagataatagggcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaaactcattaccgagtggtgctgtagatcctgcacactgccgcctcttaggtatcgcggagaggacggctgttggtacggtatggaaatacggccattgaaggagaaagaagagaatctggtgaactcattagttacggcggggcacggacaggtggataatttcagtctcggcgtactgggtatggccctttttctggaagagatgttgagaaccagggtcggcactaagcatgctatcctcctggtggcagtgagcttcgtcacactaattaccgggaacatgtcgtttaaagacctgggacgcgttgtggtaatggtgggcgccactatggctgatgacatcgggatgggagtcacatatctcgccctgcttgcagcgttcaaggtgcgacccacctttgccgctggcttgctgttacggaagctcacgtccaaagagctgatgatgactaccattggtatcgttcttctgtctcaaagcacaatacctgaaaccgtgctagagctcactgatgccctggcattggggatgatggtcctgaagatcgtgcgtaatatggaaaaataccagttagctgttacaattatggccatcctctgcgtgcccaacgcagtcattctgcagaatgcctggaaggtatcatgtaccatccttgctgtggttagtgtgtccccactgttgctcacatctagccagcagaagactgactggatacctctggcgctaaccattaagggactgaaccccacggccatcttccttacaaccctctccagaactaataaaaagaggtcatggccactgaacgaggcaatcatggctgtcggcatggtgagcattttggccagttctctgttaaagaatgacataccgatgaccggccctctcgtagccgggggactgcttacagtgtgctatgtcctgactggtcgctccgctgatttggaactcgagcgggcaaccgacgttaaatgggaggatcaggccgaaatcagcggctcgtcacccattctgtctatcacgattagtgaggacgggtccatgagcatcaagaacgaagaggaggaacagacactaaccatactgatcagaactggacttctcgtgatttctggcctgtttccaatcagcattcccatcacagcggctgcctggtacttgtgggaggtgaaaaagcagagggccggtgtcttatgggatgtgccttccccaccccctatggggaaagccgaactggaggacggagcttatcgaataaagcaaaagggcattctcggctactcacagatcggggcaggagtttacaaagaaggtaccttccacactatgtggcatgtaacacgcggcgccgtgctgatgcacaaggggaaacggatcgagccgagttgggcggatgtcaagaaagaccttattagctatggaggcggttggaagctggagggggaatggaaggagggagaagaggtgcaggttttggctctagaaccaggcaaaaatcccagagccgtgcagaccaagcctggcctgtttaaaacgaacactgggaccatcggagcagtctctctcgatttctccccaggtacatcaggcagtcccataattgacaagaaagggaaggtggtaggactgtacggcaacggtgtcgtgaccaggagcggggcctatgtttccgctatcgcccaaacagagaagtctattgaggataatcctgaaatcgaggacgatatatttcgtaaacgccggcttactattatggacttacacccgggagcaggcaagaccaaaagatacctgcccgctatcgtgagggaagccatcaagcgaggcctccggacgttgattctggcgccaacacgcgtcgtggccgcagagatggaagaggctctcagagggctgcctatcaggtatcagactcccgccattcgggctgagcataccggacgagaaatagttgaccttatgtgtcacgcaacattcaccatgagactgttgtcgccagtgcgcgtccctaactacaatctaatcattatggatgaggcccatttcactgaccccgccagcatcgctgcgaggggttatatctcaacccgtgtggaaatgggcgaggcagccgggatttttatgacagctacgccaccgggatcccgggatcctttcccccagagtaacgccccaataatcgacgaggaaagagagattcccgaaaggtcttggaatagcggccacgagtgggtaactgattttaaaggtaagaccgtgtggttcgttccttccatcaaggcagggaacgacattgccgcttgcctgcgcaaaaatggaaagaaagtcatccaactctcacgaaagacatttgattctgaatacgtgaaaaccagaactaacgactgggatttcgtggtcacaaccgacataagcgagatgggcgcgaattttaaggccgagcgggtaatcgatccaaggcgctgtatgaaacccgtgattttaacggacggcgaagaacgtgttatcctggcagggcctatgccggtgactcatagttccgctgcccagagacggggaaggattggtcgcaacccaaagaatgaaaacgaccagtacatctatatgggcgagccccttgaaaatgatgaggactgcgcacactggaaggaggccaaaatgctgctcgataacataaatacacctgaagggattatccccagcatgttcgagccagaacgagagaaggtcgacgctattgatggagaatacagattgcggggcgaggccaggaaaacctttgtggacctgatgcgcagaggtgatctccctgtttggctggcgtataaggtggcagccgaggggatcaactacgctgacaggcggtggtgtttcgatggcatcaaaaacaatcagatccttgaagagaacgtcgaagtggagatttggaccaaggagggagaacgtaagaaactaaagccccgctggctggacgcccgaatctattctgatccattggctttaaaagagtttaaggagttcgcagccggcagaaaatcactgactctcaatctgattacagagatggggaggcttcctaccttcatgacacaaaagactcgggacgctctggataacctcgccgtattgcacacggcagaagcgggaggtcgcgcctacaatcatgctctgtccgagctaccggagaccctggaaacactccttctgttaactttgctggccaccgtgacaggcgggatctttctcttcctgatgagtggaagaggcataggtaagatgacccttgggatgtgctgcattatcactgcaagcatcctgctctggtatgctcagattcagccccactggatcgccgcatcgataattttggagtttttcctgatcgttttactaattccagaacctgagaaacagaggacgccccaagacaaccagctgacctacgtcgtgatcgccatactcacagtggtcgctgcgactatggccaatgaaatgggctttcttgagaagaccaaaaaggacttcggactgggctctatcgcaacacagcagccagagtccaacattttggatatcgacctgcggcctgctagcgcctggaccctctacgccgttgcaactacatttgtgacgcccatgctgcgacattcaattgaaaatagttctgtaaacgtgtcccttaccgctatcgccaatcaagcgactgtcctcatggggctgggaaaaggttggccgttgagcaagatggatattggcgtgccactgttagctatcgggtgttattcacaggttaaccctataacactaaccgccgcactgctccttctggtggcccactacgctattatcggacccggcttgcaggcaaaggccaccagagaggcgcagaaacgcgctgccgcaggtatcatgaagaatccaacagtcgacgggattactgtaatagatctggaccccatcccttatgatccgaaattcgaaaagcaactcggccaggtgatgctgcttattttatgcgttacacaggtgctgatgatgaggaccacatgggccctctgtgaggctttgactctggccaccggacccatcagtacactatgggaaggcaacccagggcggttttggaataccactattgcagtcagcatggctaacatcttccgtggatcctacctggccggcgcgggtctcctattttctataatgaaaaatacgacaaacaccagaagggggactggaaacatcggcgagaccctgggtgagaagtggaaaagccgcttgaatgccctgggcaagtccgagttccaaatttataagaaatcagggatccaggaggtggaccggacactcgcaaaggaaggaattaaacgaggcgagactgatcaccatgctgtctctagagggagtgccaagctgaggtggtttgtggagcgcaacatggttacccctgaaggaaaagtggtagacttaggctgcggtagagggggatggtcgtactattgtggcggtcttaagaatgtgagagaggtcaagggcctgacaaaagggggacccggccacgaagaacctatcccaatgagcacgtacgggtggaacctcgttcgtctacagtccggagtggatgtcttcttcataccccctgaaaagtgcgacaccctgttgtgtgatattggcgagtcttcaccaaatcccactgtggaggcaggtaggacactgcgggtactcaaccttgtggaaaattggctgaacaataacacccagttttgcatcaaagttttgaatccgtacatgcctagcgtgatcgagaagatggaagctctgcaacgcaaatatgggggagccctcgtccgaaacccattatccagaaatagtactcatgagatgtactgggtgtctaacgccagcggcaatattgtctcatccgtgaacatgataagtaggatgctgatcaaccggttcacaatgcgccacaagaaggcgacctatgaacccgacgttgaccttggcagcgggacgagaaatattggaatcgagtctgagattcctaacctggatatcataggtaaaaggatcgaaaagattaaacaggagcatgaaacctcctggcactacgaccaggatcacccatataagacatgggcttaccatggctcatatgagactaaacagaccgggagcgcatcgtctatggtaaatggagtggtccgactactcacaaagccctgggacgtgctgccgactgttacccaaatggccatgacagataccactccttttggccagcagcgggtgttcaaggaaaaagtcgacacgcgtacacaggagcccaaggagggtaccaaaaagttgatgaaaatcactgctgaatggctgtggaaggagctcgggaaaaagaagaccccaagaatgtgtacacgcgaagagtttacgaggaaagtgcggagtaacgccgcacttggagccattttcaccgatgagaataagtggaaatccgctagagaagcggtagaggacagccgcttttgggaactggtggataaggagaggaacttacacctggaaggcaaatgcgagacttgtgtttacaatatgatgggcaagcgagagaagaaattgggggagttcggaaaggccaaaggttcacgggcaatctggtacatgtggctcggcgctagatttctggagttcgaagccctagggtttcttaacgaggaccattggttctccagggaaaattctctgagcggagtcgagggcgagggtctccacaagctggggtatattttgcgcgatgtgagtaaaaaggaaggaggcgcaatgtacgccgacgacacagctggctgggatacccgtataactctggaggacctcaagaacgaagagatggtgacaaatcacatggaaggggagcataagaaacttgccgaggcgatctttaaactgacctatcaaaacaaagtcgttcgggtgcagagacctacacccaggggaactgtaatggatattatctcccgccgagaccagcggggtagcggccaagtggggacctacggattaaatacgttcaccaacatggaagcacagctgatcagacagatggagggcgaaggtgtcttcaaaaatattcagcacttgacagtgactgaggaggttgccgtgcaaaactggctcgctagggtcgggcgcgaaagactgtctcggatggccatatcaggagatgactgcgtggtaaagccactagatgacaggtttgcaaacgctcttaccgccctgaatgatatgggcaagatccgtaaagacattcagcagtgggagcccagtaagggctggaacgattggacacaggttcctttctgctcccatcactttcatgaactcatcatgaaagacgggcgagtgctggtcgtgccatgtcgcaatcaagatgagttgattggacgggctcggatcagccagggtgccggctggtctttaagggaaactgcatgcctggggaagtcgtatgcgcagatgtggtcactcatgtacttccaccgcagagaccttcggctggccgctaacgccatatgtagcgcagtgccgtcccactgggtccccaccagtaggacgacatggtctatccatgctaaacacgagtggatgaccactgaggacatgctaacagtttggaatcgagtgtggattcgtgaaaacccttggatggaggataagaccccagtagaaagctgggaggaaatcccctatctgggaaagagagaggaccagtggtgcggctccctcattggtttgacttcacgcgccacctgggccaaaaatatccaagccgcgataaaccaggtgcggagtctgattgggaatgaggaatacacagattacatgccttctatgaagaggtttagacgcgaggaagaggaagctggagtcctttggtga

SEQ ID NO: 14845 - RNA, 9876 nt, synthetic construct
  misc_feature 1..9876: note = derived and/or modified CDS sequence (opt3) from DENV-2__EU482666__SS-prME
  source 1..9876: mol_type = other RNA
accgccggagtgatcattatgctgatacccacggctatggcattccacctcactacgaggaacggggagcctcatatgatcgtcggaaggcaggaaaagggtaaaagccttctgtttaagaccgaggacggagttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagacccggacagaaacttggatgagtagcgagggagcttggaaacacgcccagaggatcgagacctggatactgcggcatcctggcttcacaatcatggcagccattttggcttacaccatcggcacgactcactttcagcgcgcactcattttcatcctgctgacagccgtggctccatccatgaccatgcgttgcatagggatttctaacagggattttgttgaaggagtgtcgggtggctcatgggtcgacatcgtgctcgagcacgggagctgtgtaactacaatggccaagaataagcccaccttagatttcgaactgattaaaacggaggcgaagcagcctgcaacccttcggaaatattgcatcgaagccaagttgacaaacactaccacagagagtcgctgtccaactcaaggagagccctccctgaatgaagaacaggacaaacgatttgtttgcaagcattctatggtggatagaggctggggtaacgggtgtggactattcggcaagggcgggatcgtcacatgcgctatgtttacatgcaaaaagaatatggaaggaaaaattgtgcagcctgagaacctcgaatacaccatagtgatcactccacacagcggtgaggagcatgccgtcggcaatgacacggggaagcacggaaaagaaattaagatcacaccgcagtcctcaataaccgaggcagaactgactggctatggtaccgttacaatggagtgtagtcccaggaccgggcttgatttcaacgaaatggtgctgttgcaaatggaggacaaggcttggctcgtacaccggcagtggtttctggatttacctctgccatggctccccggcgccgacactcagggaagcaattggattcagaaggagacacttgtgacgttcaagaaccctcatgcgaaaaagcaagacgtcgtggttctgggctctcaggaaggggccatgcacaccgcattgactggagctacagagatccagatgtcctcaggtaatctactgtttaccggccatctcaaatgccgtctgcgcatggataaacttcaactgaaagggatgagctacagtatgtgtacaggaaagttcaagatcgtgaaagaaattgccgagactcagcacggcaccatcgtcattagagtgcagtatgagggtgacgggtctccatgcaagatacccttcgaaatcatggatttggagaaaaggcatgtactcggccggctgattacggttaacccgatcgtgaccgaaaaggactcccctgtcaacatcgaggctgaacccccatttggagatagctacattataatcggcgtggagcctgggcagttaaaactgaattggttcaagaagggatcgtctattggtcaaatgtttgagacaactatgcgaggcgccaaacgcatggcaatcctaggggacaccgcctgggatttcggatccctcggcggtgtctttacatcaattgggaaggctctgcaccaggtgttcggcgcgatctacggagcagcctttagtggcgttagctggactatgaaaatacttatcggggctattatcacctggattggaatgaactccagatctacgagcttgtcagtgagtctggtactcgtcggcgtgatcacactgtatcttggtgccatggttcaggcagactccgggtgtgtggtcagctggaagaataaagaactgaagtgcggatctggcatattcattaccgataacgtgcacacttggacagagcagtacaagtttcaacccgaatcaccaagtaaattggccagcgctatccagaaggcccatgaggaaggtatttgtggcatcaggtccgtaacccggctcgagaatctgatgtggaaacagataactcccgagttaaaccacatcctgtctgaaaatgaggtgaagctaaccattatgacaggggacatcaaaggaattatgcaggcaggcaagcgctcgctcagacctcaaccaacggaactgaaatatagctggaagacctgggggaaggcgaaaatgctttccactgagtcacataaccagacattcttgatcgatggaccggaaaccgctgagtgccccaatacaaacagggcctggaatagtctggaggttgaagactacggctttggtgtcttcactaccaacatatggctcaagctgcgtgagaaacaggacgtgttttgtgattctaagttaatgagcgcagccattaaagacaatcgggctgtgcacgccgatatggggtattggatcgaatccgcactgaacgacacgtggaagatggagaaggcttcattcatcgaggtcaaaagctgccactggcctaagtctcatacactttggtccaatggagttttggaaagtgagatgattatcccaaaatcattcgccggccccgtgtctcagcacaactaccgacctggttatcatacccaaactgcgggcccatggcacctcgggaagctggaaatggattttgacttctgtgagggaaccacagtggtagtcactgaagattgcggcaacagagggccctccctaaggaccacaacggcctcaggaaaactgattaccgagtggtgctgtcgcagttgcactctcccgcctctgcggtacagaggcgaggacggttgttggtacgggatggaaataaggccacttaaggagaaggaagagaatttggtgaacagcctggttacagctggacatggccagatcgataatttttcgttaggtgtgctcggcatggcactgttccttgaagagatgctgcgcacccgagtcgggactaaacacgccattttgctcgtggctgtttcctttatgacactgatcaccggaaacatgtctttccgggacctaggccgtgtgatggtaatggtcggggccacgatgactgatgacattggaatgggcgtgacctatctggcactcctggcggcctttaaggtgagacccacattcgctgccggtcttttgctgaggaaattaaccagcaaggagctcatgatggcaactatcgggatagctctgctttcacagagtacaatccctgaaaccattctggagctaacagatgccctcgcactgggaatgatggtcttgaaaatcatgcgcaatatggaaaagtaccaactggccgttactattatggctatctcctgcgtgcccaacgcggtaatattacagaatgcctggaaggtgtcttgtaccattctcgcagctgtcagcgtgtccccactgcttctgacgtcaagccagcagaaagccgactggatccctttggccctcacaatcaagggcctgaaccccaccgctatttttctaactaccctgagtcggacatctaaaaagagatcctggccacttaatgaggcaataatggccgttggcatggtgagcatcctcgcgtcgtcactgttgaaaaacgacattccgatgactgggcctctggtcgctggaggtttactcaccgtgtgctatgttctgacgggcaggtctgccgatcttgaactggagcgagcaacagacgtgaagtgggaggatcaagccgaaatcagtgggtccagccccattttgtctatcaccataagcgaggacggatccatgtcaatcaaaaatgaagaggaggaacagactctcacaattctgatccgcaccggcctactggtcattagtggtcttttcccagtaagcatccccataactgctgcagcctggtacctctgggaggtgaagaagcagcgggcgggggttctgtgggatgtgccttctccaccccctgtcggaaaagctgaattggaggacggcgcctatagaattaagcagaaaggcatcttagggtactcccaaatcggagctggtgtgtataaggaaggcacatttcacaccatgtggcatgtaacgagaggggcagtgctgatgcaccgtggaaaacgcattgagccgtcatgggcagatgtcaagaaggacctcatcagttacggcggtgggtggaaactggagggagaatggaaggagggcgaagaggttcaggtgcttgccctggaaccaggcaaaaacccccgggcagtgcagactaagcctgggttgttcaaaaccaatacaggaaccataggtgctgtcagcctagatttttccccaggcacatctgggtcgcccattgtggacagaaagggaaaggttgtaggcctgtacggtaacggggtggtcactaggagcggagcctatgtgtcagcgatcgcccagaccgagaaatccattgaggataatcctgaaatcgaggacgatatattccgaaagaaacggctcacgattatggacctgcatccgggcgcaggcaagacaaaacgctaccttcccgctatcgttagagaagccatcaagagggggttacggactctgattctcgctccaacccgagtggtcgcagccgagatggaagaggccttgagaggactgcctatccgctatcaaacacccgctattagggcggagcacaccggtcgtgaaatagtggacctcatgtgtcatgcaactttcaccatgcggctgcttagtccagtaagagtccctaactacaacctgatcattatggatgaggcccactttacagaccccgcttctatcgccgcaaggggctatatcagcacgcgcgtggaaatgggggaggccgctggaattttcatgactgcgaccccaccgggctcccgagatccttttccccagtcaaatgccccaataatcgacgaggaaagagagattcccgaacggtcttggaacagcggtcacgagtgggttacagatttcaaggggaaaaccgtgtggtttgtccctagtatcaaggcaggaaatgacattgctgcctgcttgaggaaaaacggcaagaaagtgatccagctatcccgcaagactttcgatagcgaatacgttaagacacgtaccaatgactgggattttgtggtcacgactgacatatctgagatgggcgcaaacttcaaagccgagagagtgatcgatccacggaggtgtatgaagcccgtaattctgacagacggggaagaacgcgtgatcctcgctggacctatgccggttacccattcatccgccgcgcaacgaagaggtcggattggcaggaatcccaaaaacgaaaatgaccagtatatctacatgggggagcccttagaaaacgatgaggactgcgcacactggaaggaggccaaaatgctgcttgataatataaacacccctgaaggaattatccccagtatgtttgagccagaacgcgagaaggtcgacgctattgatggcgaatacagactgaggggtgaggcccggaaaactttcgtggacctcatgcgtcgcggggatttgcctgtgtggctggcttatcgagtcgcagccgagggcatcaattacgctgacagaaggtggtgttttgatggagtaaagaacaatcagatactcgaagagaacgtggaagttgagatctggacaaaggagggcgaacggaaaaagctgaaaccccgctggcttgacgccagaatttatagcgatccactagcactgaaggagttcaaagagttcgcggccgggaggaagtcgttgaccttaaacctgatcacagagatgggacggctccctacttttatgacgcagaaggctcgagacgccctggataatcttgcagtgctgcataccgctgaagccggtggcagagcatacaaccacgccctctctgagttgccggagacactggaaactctactgctccttaccctgttagctacagtcaccgggggaattttcttgtttctgatgtccggcaaaggtgtggggaagatgactctcggcatgtgctgcatcataacggcgagcattctgctttggtatgcccaaatccagccccactggatcgcagcttcaattatcctggagttctttctcatagttttgctgattccagaacctgagaaacagcgcaccccacaggacaatcaattaacatacgtggtcatcgccattctaactgtggtagccgcaaccatggctaacgaaatgggattcctggagaagaccaaaaaggacctcggccttgggagtatcgccacccaggagccagaatctaatatactggatatcgacttgaggcctgcgtccgcttggactctgtatgccgtggcaacaacgtttgttacccccatgctccggcatagcattgagaactcaagtgtcaatgtgagcctgactgccatcgctaaccaggcaacagtgcttatgggactcggtaagggctggccgctgtccaaaatggatattggggtcccattgctggccatcggatgttactctcaggttaatcctattaccttaaccgcggctctactgctccttatcgcccactacgcaataattggccccggtctgcaagccaaggctacacgtgaagcccagaaaagagcagctgccgggatcatgaagaacccaactgtggacggcatcacggtaattgatttggaccccataccttatgatccgaaattcgagaagcagctgggacaggtgatgctcctgatcctttgcgtcacccaagtgttaatgatgaggacaacttgggcgctgtgtgaagccctcaccttggcaacaggccccattagcaccctgtgggaggggaatccaggacgcttttggaacactacgatcgctgtttccatggccaatattttccggggctcatacctagccggtgctgggctgctcttttctatcatgaagaacacaaccaatactcgaagaggaaccggcaacataggtgagacacttggcgaaaaatggaagagtaggctgaatgccttggggaaatcggagttccagatctataagaaaagcggcattcaggaagtggaccgcactctggccaaggagggcatcaaaagaggggaaaccgatcatcacgcggtctccagaggatctgctaagctccgttggtttgtagaaaggaacatggtgacacctgagggcaaggttgtggacctgggttgcgggcggggaggctggtcatactattgtggtggccttaaaaacgtccgcgaagtgaaggggctaacgaaaggaggccccgggcatgaggaacctattccaatgagcacctacggatggaatctggtccgactccaatccggcgtggatgttttcttcactccccctgagaagtgcgacacactactgtgtgatatcggtgagagttctccaaaccccaccatagaagcagggagaactttgagggtgctgagcctcgtagagaattggcttaacaatgacacacagttttgcattaaagtgctgaacccgtatatgccttcagtcatcgaaaagatggagaccttgcagcggaagtacggaggcgccctggttcgcaatccactctccagaaacagtacgcacgaaatgtactgggtgagcaatgctaccggcaacatcgtctcttccgtgaatatgatttcaaggatgttaataaaccgattcacaatgaaacacaagaaagccacttatgagcccgacgtagatctggggagcggaacccggaatatcggtattgagtcggaaatccctaaccttgacattatcggcaagcgtatagagaaaatcaagcaggaacatgagacatcttggcactacgatcaagaccatccatataagacttgggcataccacgggagttatgaaaccaaacagacaggatccgccagctcaatggtgaatggcgttgtgagactgctaaccaagccctgggatgtcgtgccgatggtcactcagatggctatgacggacacaaccccttttggtcagcaacgcgtgttcaaagagaaggttgatactaggacccaggagcccaaagaagggacaaagaagctcatgaaaattacggcggagtggctgtggaaggaattgggcaaaaagaaaaccccacggatgtgtactagagaggagtttacacgcaaggtaaggtccaacgccgcactgggcgctatcttcaccgacgaaaacaaatggaagtctgcccgagaggcagtggaagatagccggttttgggagctcgtcgacaaggaaagaaatcttcacctggagggcaaatgcgagacttgtgtgtacaacatgatggggaagagggagaaaaagttaggagagttcggtaaagccaagggcagtcgcgctatttggtatatgtggctgggggccagatttttggagttcgaggcgctcggatttctgaatgaagatcattggttctcccgggagaacagcctatctggcgttgagggtgaagggcttcacaagctgggatacatcctcagagacgtgagcaaaaaggagggcggcgcaatgtacgccgacgatacagctgggtgggacaccaggattacactggaagatttgaaaaatgaggaaatggtcactaaccatatggagggagagcacaagcgcctggccgaagcaatatttaaactcacctatcagaataaggtggtacgagtgcagcggcctacgcccagaggtaccgttatggacatcattagtaggcgcgatcaaagaggctccgggcaggtcggaacatacggccttaacactttcaccaatatggaggctcagctgatccggcaaatggaaggtgaggggatcttcaagagcattcagcatttaacagtgactgaggaaatagccgtgcagaactggctggctagggtcggacgtgagcgattgtctcgcatggccatctcgggcgacgattgcgttgtgaaaccactcgacgatagatttgcatcagcgctgaccgccctaaatgacatgggcaaggtacggaaagatattcagcaatgggaacccagcaaggggtggaacgactggacacaggtgcctttctgctcccaccactttcatgagcttatcatgaaagatggaagggtcctggtggttccatgtcgcaatcaggacgaactcattggtagagctcggatcagtcagggcgccgggtggtctctgaaggagacagcatgcttgggaaagagctatgctcaaatgtggtccttaatgtacttccacaggcgagacctgcgtctcgccgcaaacgccatatgttcagcggtgccgagtcattgggtccccacctctagaactacatggagcatccacgctaaacacgagtggatgaccactgaagatatgcttaccgtgtggaatcgcgtatggattcaggagaacccttggatggaagacaagacaccagttgagtcctgggaagaggtgccctatctgggcaaacgggaggatcagtggtgcggttcactaatcgggctgacgagcagggccacctgggcaaagaacattcagactgccatcaatcaagtcagatctctcataggaaacgaagagtacacagactatatgccttccatgaaacgctttcggagggaagaggaagaggctggcgtgttgtggtga

SEQ ID NO: 14846 - RNA, 9876 nt, synthetic construct
  misc_feature 1..9876: note = derived and/or modified CDS sequence (opt3) from DENV-2__EU482667__SS-prME
  source 1..9876: mol_type = other RNA
agcgccggcatgatcattatgctgatacccaccgtgatggctttccacctcacaactagaaacggggagcctcatatgatcgtcggaattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagagcaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaagctcttgttaccttcaagaaccctcatgccaaaaagcaagacgtggtcgtgctgggatcccaggagggcgcgatgcacactgccttgacaggggcaacggaaatacagatgtcaagcggaaatctactgtttaccggtcatctcaaatgccggctgcgtatggacaagcttcaactgaagggcatgagttactctatgtgtactgggaaattcaaggtagttaaagagattgctgagacacagcacggaaccatcgtgatcaaggtccagtatgaaggcgatggttccccatgcaaaattcccttcgagatcatggacttggaaaagcgctacgtgctcgggagactgattacagtcaacccgatagtgactgagaaggatagccctgttaacatcgaagccgagcccccatttggcgactcgtacattatcatcggagtggagcctggccagttaaaactgaattggttcaagaaagggtcttccattggacaaatgtttgaaaccacgatgaggggtgctaagcggatggccatactaggcgataccgcatgggacttcgggtcactcggaggcgtatttacaagtatcggtaaagccctgcatcaggtcttcggggctatttatggcgcggcatttagcggagtgtcctggactatgaagatccttattggcgttatcataacctggatcgggatgaactctcgaagcacatcattgagtgtgtccctggtcctcgtgggaattgtaactctgtaccttggcgtgatggttcaggccgatagcggttgtgtcgtgtcttggaagaataaagagctgaagtgcgggtcaggaatcttcattaccgacaacgtgcacacgtggacagaacagtataaatttcaacccgagagtccaagcaagttggcttccgccatccagaaagcacaggaagagggcatatgtggtattcgctctgtcaccagactcgagaatctgatgtggaagcagatcactcccgaattaaaccacattctggccgagaatgaagttaaactaacaatcatgaccggcgatataaaggggatcatgcaagctggaaagaggtcgctccggcctcagccaactgagctgaaatacagctggaagacctggggcaaagccaagatgctttccacagaatcatataaccagacgttcttgattgacgggccggagaccgcagagtgccccaatactaaccgcgcgtggaatagtctggaagtggaggattacggatttggcgtgttcacaaccaacatctggctcaaactgaaggaaaagcaggacgtattttgtgactctaaattaatgagcgctgccattaaggataatagagcagtccatgccgacatgggttattggatcgagtccgctctgaacgatacatggaaaatagagaaggcctcattcattgaagtgaaaaattgccactggcctaagagccatactctttggtctaacggggttttggagtccgaaatgatcatcccaaagaacctcgcaggacccgtgagtcaacacaattacaggcctggctaccacacccagattgctggtccatggcatctgggcaaactagagatggacttcgatttttgtgacgggacgacagtcatcgtgaccgaagattgcggaaaccgtggccccagcctgcggactaccacagcctctgggaagctcattactgagtggtgctgtcgatcctgcaccctgccgcctcttagatataggggagaggacggctgttggtacggtatggaaatacgcccattgaaagagaaggaagagaatctggttaactcattagtgacagcggggcacggacaggtagataatttcagtctcggcgtcctgggtatggccctttttctggaagagatgttgcggacgagagtgggcaccaaacatgctatcctcctggtggcagtcagcttcgttactctaattacagggaacatgtcgtttaaggacctgggaagggtggtagtgatggtcggcgccaccatggctgatgacatcgggatgggagtgacttatctcgccctgcttgcagcgttcaaggttcgccccacatttgccgctggcttgctgttacgaaaactcacctccaaggagctgatgatgacgactattggtatcgtgcttctgtctcaaagcaccatacctgaaacagtcctagagctcaccgatgccctggcattggggatgatggtgctgaaaatcgttcggaatatggaaaagtaccagttagctgtgactattatggccatcctctgcgtccccaacgcagtaattctgcagaatgcctggaaagtgtcatgtacaatccttgctgttgtgagtgtctccccactgttgctcacctctagccagcaaaagacagactggatacctctggcgctaactattaaaggactgaaccccaccgccatcttccttacgacactctcccgtaccaataagaagagatcatggccactgaacgaggcaatcatggctgtgggcatggtaagcattttggccagttctctgttaaaaaatgacataccgatgactggccctctcgtggccgggggactgcttaccgtctgctatgttctgacaggtaggtccgctgatttggaactcgagcgcgcaactgacgtgaagtgggaggatcaggccgaaatcagcggctcgtcacccattctgtctatcaccattagtgaggacgggtccatgagcatcaaaaacgaagaggaggaacagacgctaacaatactgatccggaccggacttctcgtgatttctggcctgtttccaatcagcattcccatcactgcggctgcctggtacttgtgggaggtcaagaaacagagagcaggtgtgttatgggatgttccttccccaccccctatggggaaggccgaactggaggacggagcttataggataaagcaaaaaggcattctcggctactcacagatcggggcaggagtatacaaggaaggtacattccacaccatgtggcatgtgactcgaggcgccgtcctgatgcacaaagggaagcgcatcgagccgagttgggcggatgtgaaaaaggaccttattagctatggaggcggttggaagctggagggggaatggaaagagggagaagaggttcaggtgttggctctagaaccaggcaagaatccccgggccgtccagacaaaacctggcctgtttaagaccaacacggggactatcggagcagtgtctctcgatttctccccaggtacctcaggcagtcccataattgacaaaaaggggaaggtagtcggactgtacggcaacggtgtggttacaagaagcggggcctatgtgtccgctatcgcccaaaccgagaaatctattgaggataatcctgaaatcgaggacgatatatttaggaagcgtcgccttacaattatggacttacacccgggagcaggcaaaactaagcggtacctgcccgctatcgtcagagaagccatcaaaaggggcctccgaaccttgattctggcgccaacgcgggtggttgccgcagagatggaagaggctctccgcgggctgcctatcagatatcagacacccgccattagggctgagcatactggacgggaaatagtggaccttatgtgtcacgcaaccttcacaatgcgactgttgtcgccagtcagagtgcctaactacaatctaatcattatggatgaggcccatttcaccgaccccgccagcatcgctgcgcgcggttatatctcaactagggtagaaatgggcgaggcagccgggatttttatgaccgctacaccaccgggatcccgtgatcctttcccccagagtaacgccccaataatcgacgaggaacgggagattcccgaaagatcttggaatagcggccacgagtgggtgacggattttaagggtaagactgtttggttcgtcccttccatcaaagcagggaacgacattgccgcttgcctgaggaagaatggaaaaaaggtgatccaactctcacgcaaaacctttgattctgaatacgtgaagacacgaaccaacgactgggatttcgtcgtaactacagacataagcgagatgggcgcgaattttaaagccgagagagtgatcgatccacggaggtgtatgaagcccgttattttaaccgacggcgaagagcgcgtgatcctggcagggcctatgccggtcacgcatagttccgctgcccagcgtagaggacggattggtaggaacccaaagaatgaaaacgaccagtacatctatatgggcgagccccttgaaaatgatgaggactgcgcacactggaaagaggccaagatgctgctcgataacataaatactcctgaagggattatccccagcatgttcgagccagaacgcgagaaagtggacgctattgatggagaataccgattgagaggcgaggcccggaagacatttgttgacctgatgaggcgcggtgatctccctgtgtggctggcgtataaagtcgcagccgaggggatcaactacgctgacagaaggtggtgtttcgatggcataaagaacaatcagatccttgaagagaacgtggaagtagagatttggaccaaggagggagaacggaaaaagctaaaaccccgttggctggacgcccgcatctattctgatccattggctttaaaggagtttaaagaattcgcagccggccgaaagtcactgaccctcaatctgattactgagatggggagacttcctacattcatgacccaaaagacaagggacgctctggataacctcgccgtgttgcacactgcagaagcgggaggtcgggcctacaatcatgctctgtccgagctaccggagacgctggaaaccctccttctgttaacattgctggccactgttaccggcgggatctttctcttcctgatgagtggacgcggcataggtaaaatgacacttgggatgtgctgcattatcaccgcaagcatcctgctctggtatgctcagattcagccccactggatcgccgcatcgataattttggagtttttcctgatcgtcttactaattccagaacctgagaagcagagaactccccaagacaaccagctgacgtacgtggtgatcgccatactcaccgtcgttgctgcgacaatggccaatgaaatgggctttcttgagaaaactaagaaagacttcggactgggctctatcgcaacccagcagccagagtccaacattttggatatcgacctgaggcctgctagcgcctggacactctacgccgtggcaaccacttttgtaacacccatgctgcggcattcaattgaaaatagttctgtgaacgtctcccttacggctatcgccaatcaagcgaccgtgctcatggggctgggaaagggttggccgttgagcaagatggatattggcgttccactgttagctatcgggtgttattcacaggtgaaccctataactctaacagccgcactgctccttctggtcgcccactacgctattatcggacccggcttgcaggcaaaagccacccgagaggcgcagaagagagctgccgcaggtatcatgaaaaatccaaccgtagacgggattacagtgatagatctggaccccatcccttatgatccgaagttcgaaaaacaactcggccaggttatgctgcttattttatgcgtgactcaggtcctgatgatgcgcacgacctgggccctctgtgaggctttgacactggccactggacccatcagtaccctatgggaaggcaacccagggaggttttggaatacaaccattgcagtgagcatggctaacatcttccggggatcctacctggccggcgcgggtctccttttttctataatgaagaatactacgaacacacgtagagggaccggaaacatcggcgagactctgggtgagaaatggaagagcaggttgaatgccctgggcaagtccgaattccaaatttataaaaagtcagggatccaggaggtcgaccgcaccctcgcaaaagaaggaattaagcggggcgagacagatcaccatgctgtgtctcgagggagtgccaaactgagatggtttgttgagaggaacatggtgactcctgaaggaaaggtagtggacttaggctgcggtcgcgggggatggtcgtactattgtggcggtcttaagaatgtccgggaggttaaaggcctgaccaaggggggacccggccacgaagagcctatcccaatgagcacatacgggtggaacctcgtgagactacagtccggagtcgatgtgttcttcataccccctgaaaaatgcgacacgctgttgtgtgatattggcgagtcttcaccaaatcccaccgtagaggcaggtcgtactctgagggtgctcaaccttgttgaaaattggctgaacaataacacacagttttgcatcaaggtgttgaatccgtacatgcctagcgtcatcgagaaaatggaagctctgcaacggaagtatgggggagccctcgtgcgcaacccattatcccgaaatagtacccatgagatgtactgggtctctaacgccagcggcaatattgtgtcatccgttaacatgataagtagaatgctgatcaacaggttcactatgcggcacaagaaagcgacatatgaacccgacgtagaccttggcagcgggacccgcaatattggaatcgagtctgagattcctaacctggatatcataggtaagagaatcgaaaaaattaagcaggagcatgaaacgtcctggcactacgaccaggatcacccatataaaacctgggcttaccatggctcatatgagacaaagcagactgggagcgcatcgtctatggtgaatggagtcgtgaggctactcaccaagccctgggacgttctgccgacagtgactcaaatggccatgaccgatacaaccccttttggccagcagcgagtcttcaaagaaaaggtggacactcggacgcaggagcccaaagagggtacaaagaaattgatgaagatcaccgctgaatggctgtggaaagagctcgggaagaagaaaactccacgtatgtgtaccagagaagagtttacacgcaaggtaaggagtaacgccgcacttggagccattttcacggatgagaataaatggaagtccgctcgggaagcggtggaggacagcagattttgggaactggttgataaagagcgcaacttacacctggaaggcaagtgcgagacctgtgtctacaatatgatgggcaagagggagaaaaagttgggggaattcggaaaagccaagggttcacgagcaatctggtacatgtggctcggcgctcggtttctggagttcgaagccctagggtttcttaacgaggaccattggttctccagagaaaattctctgagcggagtggagggcgagggtctccacaaactggggtatattttgagggatgtgagtaagaaggaaggaggcgcaatgtacgccgacgacactgctggctgggatacacgcataaccctggaggacctcaaaaacgaagagatggtcactaatcacatggaaggggagcataagaaacttgccgaggcgatctttaagctgacatatcaaaacaaagttgtgcgtgtacagcggcctacccccagaggaacagtgatggatattatctccaggcgcgaccagcgaggtagcggccaagtcgggacttacggattaaataccttcacgaacatggaagcacagctgatccggcagatggagggcgaaggtgtgttcaagaatattcagcacttgaccgttacagaggaggtggccgtccaaaactggctcgctagagtggggagggaacgcctgtctagaatggccatatcaggagatgactgcgtagttaagccactagatgaccggtttgcaaacgctcttactgccctgaatgatatgggcaaaatcaggaaggacattcagcagtgggagcccagtaaaggctggaacgattggacccaggtgcctttctgctcccatcactttcatgaactcatcatgaaggacgggcgtgtcctggtggtgccatgtcgaaatcaagatgagttgattggacgcgctagaatcagccagggtgccggctggtctttacgggaaacagcatgcctggggaaatcgtatgcgcagatgtggtcactcatgtacttccacaggcgcgaccttagactggccgctaacgccatatgtagcgcagtcccgtcccactgggttcccactagtcggaccacgtggtctatccatgctaagcacgagtggatgacaaccgaggacatgctaactgtgtggaatagggtatggattcgagaaaacccttggatggaggataagacaccagtggaaagctgggaggaaatcccctatctgggaaaacgtgaggaccagtggtgcggctccctcattggtttgacctcaagagccacttgggcaaagaatatccaagccgcgataaaccaggtccgcagtctgattgggaatgaggaatacaccgattacatgccttctatgaaacggtttaggagagaggaagaggaagctggagtgctttggtga

SEQ ID NO: 14847 - RNA, 9876 nt, synthetic construct
  misc_feature 1..9876: note = derived and/or modified CDS sequence (opt3) from DENV-2__EU482668__SS-prME
  source 1..9876: mol_type = other RNA
agcgcaggcatgataattatgctgatacccaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacacgatcacttacaaatgcccattactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaatggaaatcaaggtaacgccgcagtcaagtattacagaggctgaactgaccggctatggtactgtgaccatggagtgtagccccagaacagggcttgatttcaatgaaatggtcctgttgcaaatggagaacaaagcctggctcgtgcacaggcagtggtttctggacttacctctgccatggctccccggcgcagataagcaggagtctaattggatccagaaggaaacccttgttactttcaaaaaccctcatgctaagaaacaagacgtggtcgtgctgggatcccaggagggcgccatgcacacagcgttgacgggggccaccgaaatacagatgtcaagcggaaatctactgtttactggtcatctcaagtgccggctgcgtatggacaaacttcaactgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccagttaaagctgaattggttcaagaaagggtcttccattggacaaatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacagtataaatttcaacccgagagtccaagcaagttggcctccgctatccagaaagcccaggaagagggcatatgtggtattagatctgtcactaggctcgagaatctgatgtggaagcagatcacacccgaattaaaccacattctggcagagaatgaagttaaactaaccatcatgactggcgatatacgggggatcatgcaagccggaaagcgctcgctcagacctcagccaaccgagctgaaatacagctggaagacatggggcaaggctaaaatgctttccacggaatcatataaccagaccttcttgattgacgggccggagactgccgagtgccccaatacaaacagggcatggaatagtctggaagtggaggattacggatttggcgtgttcaccacaaacatctggctcaagctgaaagaaaagcaggacgcgttttgtgactctaaattaatgagcgctgccattaaggataatcgtgcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcaacacaattaccggcctggctaccacacgcagattgctggtccatggcatctgggcaaactagagatggacttcgatttttgtgacgggacaaccgtgatcgtcactgaagattgcggaaaccgaggccccagcctgagaaccacaactgcctctgggaagctcattaccgagtggtgctgtaggtcctgcacactgccgcctcttcgctatcggggagaggacggctgttggtacggtatggaaataagaccattgaaggagaaagaagagaatctggtgaactcattagttacggcggggcacggacaggtggataatttcagtctcggcgtactgggtatggccctttttctggaagagatgttgaggacccgcgtcggcactaagcatgctatcctcctggtggcagtgagcttcgtcacactaattaccgggaacatgtcgtttaaagacctgggacgagttgtggtaatggtgggcgccactatggctgatgacatcgggatgggagtcacatatctcgccctgcttgcagcgttcaaggtgcggcccacctttgccgctggcttgctgttacgtaaactcacgtccaaggagctgatgatgactaccattggtatcgttcttctgtctcaaagcacaatacctgaaaccgtgctagagctcactgatgccctggcattggggatgatggtcctgaagatcgtgagaaatatggaaaaataccagttagctgttacaattatggccatcctctgcgtgcccaacgcagtcattctgcagaatgcctggaaggtatcatgtaccatccttgctgtggttagtgtgtccccactgttgctcacatctagccagcagaagactgactggatacctctggcgctaaccattaagggactgaaccccacggccatcttccttacaaccctctccaggactaataaaaagcgctcatggccactgaacgaggcaatcatggctgtcggcatggtgagcattttggccagttctctgctcaaaaatgacataccgatgaccggccctctagtagccgggggactgcttacagtgtgctatgtcctgactggtcggtccgctgatttggaactcgagagagcaaccgacgttaagtgggaggatcaggccgaaatcagcggctcgtcacccattctgtctatcacgattagtgaggacgggtccatgagcatcaagaacgaagaggaggaacagacactaaccatactgatcaggactggacttctcgtgatttctggcctgtttccaatcagcattcccatcacagcggctgcctggtacttgtgggaggtgaaaaagcagcgagccggtgtcttatgggatgtgccttccccaccccctatggggaaagccgaactggaggacggagcttatcgcataaagcaaaaaggcattctcggctactcacagatcggggcaggagtttacaaggaaggtaccttccacactatgtggcatgtaacacggggcgccgtgctgatgcacaaggggaaaagaatcgagccgagttgggcggatgtcaagaaagaccttattagctatggaggcggttggaagctggagggggaatggaaagagggagaagaggtgcaggttttggctctagaaccaggcaagaatcccagggccgtgcagaccaagcctggcctgtttaaaacgaacactgggaccatcggagcagtctctctcgatttctccccaggtacatcaggcagtcccataattgacaagaaagggaaggtggtaggactgtacggcaacggtgtcgtgacccgtagcggggcctatgtttccgctatcgcccaaacagagaaatctattgaggataatcctgaaatcgaggacgatatatttcgcaagcggagacttactattatggacttacacccgggagcaggcaagaccaaaaggtacctgcccgctatcgtgcgagaagccatcaagcggggcctccgcacgttgattctggcgccaacaagagtcgtggccgcagagatggaagaggctctcagggggctgcctatccggtatcagactcccgccattcgagctgagcataccggaagagaaatagttgaccttatgtgtcacgcaacattcaccatgcgcctgttgtcgccagtgagggtccctaactacaatctaatcattatggatgaggcccatttcactgaccccgccagcatcgctgcgcgtggttatatctcaacccgggtggaaatgggcgaggcagccgggatttttatgacagctacgccaccgggatccagagatcctttcccccagagtaacgccccaataatcgacgaggaaagggagattcccgaacgctcttggaatagcggccacgagtgggtaactgattttaaaggtaagaccgtgtggttcgttccttccatcaaagcagggaacgacattgccgcttgcctgcgaaagaatggaaagaaagtcatccaactctcaagaaagacatttgattctgaatacgtgaaaacccggactaacgactgggatttcgtggtcacaaccgacataagcgagatgggcgcgaattttaaggccgagagggtaatcgatccacgccgttgtatgaaacccgtgattttaacggacggcgaagagagagttatcctggcagggcctatgccggtgactcatagttccgctgcccagcggaggggacgcattggtcgaaacccaaagaatgaaaacgaccagtacatctatatgggcgagccccttgaaaatgatgaggactgcgcacactggaaagaggccaagatgctgctcgataacataaatacacctgaagggattatccccagcatgttcgagccagaaagagagaaggtcgacgctattgatggagaataccggttgaggggcgaggcccgcaaaacctttgtggacctgatgagaaggggtgatctccctgtttggctggcgtataaggtggcagccgaggggatcaactacgctgaccggcgttggtgtttcgatggcatcaaaaacaatcagatccttgaagagaacgtcgaagtggagatttggaccaaggagggagaacgcaaaaagctaaagccccgatggctggacgccagaatctattctgatccattggctttaaaagagtttaaggagttcgcagccggcaggaaatcactgactctcaatctgattacagagatggggcggcttcctaccttcatgacacaaaagactcgcgacgctctggataacctcgccgtattgcacacggcagaagcgggaggtagagcctacaatcatgctctgtccgagctaccggagaccctggaaacactccttctgttaactttgctggccaccgtgacaggcgggatctttctcttcctgatgagtggaaggggcataggtaaaatgacccttgggatgtgctgcattatcactgcaagcatcctgctctggtatgctcagattcagccccactggatcgccgcatcgataattttggagtttttcctgatcgttttactaattccagaacctgagaagcagcggacgccccaagacaaccagctgacctacgtcgtgatcgccatactcacagtggtcgctgcgactatggccaatgaaatgggctttcttgagaagaccaaaaaggacctgggattgggctctatcgcaacacagcagccagagtccaacattctggatatcgacctccgacctgctagcgcctggaccctgtacgccgttgcaactacattcgtgacgcccatgcttagacattcaattgaaaatagttctgtaaacgtgtccctcaccgctatcgccaatcaagcgactgtcctgatggggttgggaaaaggttggccgctgagcaagatggatattggcgtgccattactagctatcgggtgttattcacaggttaaccctataacactgaccgccgcactccttctgttggtggcccactacgctattatcggacccggcctgcaggcaaaagccacccgcgaggcgcagaagagggctgccgcaggtatcatgaagaatccaacagtcgacgggattactgtaatagatctcgaccccatcccttatgatccgaaatttgaaaagcaactgggccaggtgatgcttttaattctgtgcgttacacaggtgctcatgatgcggaccacatgggccttgtgtgaggctctgactctagccaccggacccatcagtacactgtgggaaggcaacccagggcgtttctggaataccactattgcagtcagcatggctaacatctttagaggatcctacctcgccggcgcgggtcttctgttctctataatgaaaaatacgacaaacaccaggcgcgggactggaaacatcggcgagaccttgggtgagaagtggaaaagccggctgaatgccctcggcaagtccgaatttcaaatttataaaaagtcagggatccaggaggtggaccgaacactggcaaaggaaggaattaaaagaggcgagactgatcaccatgctgtctctagggggagtgccaagttacgctggttcgtggagcggaacatggttacccctgaaggaaaagtggtagaccttggctgcggtagagggggatggtcgtactattgtggcggtctgaagaatgtgcgtgaggtcaaaggcctcacaaaagggggacccggccacgaggaacctatcccaatgagcacgtacgggtggaacctagttaggctgcagtccggagtggatgtctttttcataccccctgaaaagtgcgacaccttgctgtgtgatattggcgagtcttcaccaaatcccactgtggaggcaggtcggacactccgcgtacttaacctggtggaaaattggttgaacaataacacccagttctgcatcaaagttctgaatccgtacatgcctagcgtgatcgagaagatggaagctctccaacgaaaatatgggggagccttagtcagaaacccactgtccaggaatagtactcatgagatgtactgggtgtctaacgccagcggcaatattgtctcatccgtgaacatgataagtcggatgcttatcaaccgctttacaatgagacacaagaaagcgacctatgaacccgacgttgacctgggcagcgggacgaggaatattggaatcgagtctgagattcctaacctagatatcataggtaagcgaatcgaaaagattaaacaggagcatgaaacctcctggcactacgaccaggatcacccatataagacatgggcttaccatggctcatatgagactaaacagaccgggagcgcatcgtctatggtaaatggagtggtccggctcctgacaaagccctgggacgtgttgccgactgttacccaaatggccatgacagataccactcctttcggccagcagcgtgtgtttaaagaaaaggtcgacacgagaacacaggagcccaaggagggtaccaaaaagctgatgaaaatcactgctgaatggctctggaaggagcttgggaaaaagaaaaccccacgcatgtgtacaagggaagagttcacgcggaaggtgagaagtaacgccgcactgggagccatttttaccgatgagaataagtggaaatccgctcgcgaagcggtagaggacagcaggttctgggaattagtggataaggagcgaaacctgcacttggaaggcaaatgcgagacttgtgtttacaatatgatgggcaagcgggagaaaaagctcggggaatttggaaaggccaaaggttcaagagcaatctggtacatgtggctgggcgctaggttcctagagtttgaagcccttgggttcctgaacgaggaccattggttttcccgcgaaaattctctcagcggagtcgagggcgagggtctgcacaagttggggtatattctgcgtgatgtgagtaaaaaggaaggaggcgcaatgtacgccgacgacacagctggctgggatacccggataactctcgaggaccttaaaaacgaagagatggtgacaaatcacatggaaggggagcataagaagctggccgaggcgatcttcaaattaacctatcaaaacaaggtcgttagagtgcagaggcctacaccccgcggaactgtaatggatattatctcccgacgggaccagagaggtagcggccaagtggggacctacggactgaatacgtttaccaacatggaagcacagttgatcaggcagatggagggcgaaggtgtcttcaaaaatattcagcacctcacagtgactgaggaggttgccgtgcataactggctggctcgcgtcgggagagaacggctatctaggatggccatatcaggagatgactgcgtggtaaagccacttgatgaccgtttcgcaaacgctctgaccgccctcaatgatatgggcaaaatccgaaaggacattcaacagtgggagcccagtaagggctggaacgattggacacaggttcctttttgctcccaccatttccacgaactgatcatgaaagacgggcgcattttggtggtcccatgtagaaatcaggatgagttaatcggacgggctaggataagccaaggtgccggctggtctctgcgcgaaactgcatgcctcgggaagtcgtatgcgcagatgtggtcacttatgtactttcacagacgggacctgaggctagccgctaacgccatctgtagcgcagtgccgtcccattgggtgcccaccagtcgaacgacatggtctattcacgctaaacatgagtggatgaccactgaggacatgctgacagtctggaatcgtgtttggatcagagaaaacccttggatggaggataagaccccagtggaaagctgggaggaaattccctatctcggaaaacgcgaggaccagtggtgcggctccttgatcggtctgacttcacgggccacctgggcaaagaatatacaggccgcgattaaccaagtaaggagtcttatcgggaatgaggaatacacagattacatgccttctatgaagagattccgccgggaggaagaggaagctggagtgctgtggtga

SEQ ID NO: 14848 - RNA, 9876 nt, synthetic construct
  misc_feature 1..9876: note = derived and/or modified CDS sequence (opt3) from DENV-2__EU482669__SS-prME
  source 1..9876: mol_type = other RNA
agcgcaggaatgatcattatgctgatacccaccgtgatggctttccacctcacaactagaaacggggaacctcatatgatcgtcggtattcaagaaaagggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcagcctgggtgacatatggaacctgtactacaaccggcgagcaccggcgcgaaaagcgaagtgtagcgctggtgccccatgtcggtatggggcttgagacgcgtactgaaacctggatgagctccgagggagcttggaaacacgcccagagaatcgagacatggatactgaggcatcctggcttcactatcatggcagccattttggcttacaccatcggcacaacccactttcagcgggtgctcattttcatcctgctgacggcagttgccccatctatgactatgcgctgcatagggatttcgaacagagattttgtggaaggagtctcaggtggcagctgggtggacatcgtactcgagcacgggagttgtgttacaaccatggctaagaataagcccactttagatttcgaactgattaaaacagaggccaagcagcctgcgacccttaggaaatattgcatcgaagcaaagttgacgaacaccacaactgagtcccggtgtccaacccaaggagagccctctctgaaagaagaacaggacaagcgctttgtgtgcaagcatagcatggtcgatcgaggctggggtaatgggtgtggactattcggcaaaggcgggatcgtgacatgcgccatgtttacttgcaagaaaaacatggaaggaaagattgtgcagcctgagaatctcgaatacaccatagtcgttacaccacactccggtgaggagcatgctgtgggcaacgacaccgggaaacacggaaaggaaatcaaagtaactccgcagtcaagtattacggaggtggaactgacaggctatggtaccgtcactatggagtgtagccccagaaccgggcttgatttcaatgaaatggtgctgttgcaaatggagaacaaggcctggctcgttcacaggcagtggtttctggacttacctctgccatggctccccggcgcagataagcaggagtctaattggatccagaaagaaacacttgtgaccttcaagaaccctcatgctaaaaagcaagacgtcgtggtactgggatcccaggagggcgccatgcacactgcgttgacaggggccacggaaatacagatgtcaagcggaaatctactgtttaccggtcatctcaaatgccggctgcgtatggacaaacttcaactgaagggcatgagttactctatgtgtactgggaaattcaaggttgtgaaagagattgcagagacacagcacggaaccatcgtcatccgcgtgcagtatgaaggcgatggttccccatgcaagattcccttcgagatcatggacttggagaagagatacgtcctcgggaggctgattacagtgaacccgatagttactgagaaggatagccctgtgaacatcgaagctgagcccccatttggcgactcgtacattatcatcggagtagagcctggccagttaaagctgaattggttcaaaaaggggtcttccattggacaaatgtttgaaaccacgatgcggggtgccaaacgaatggctatactaggcgataccgcctgggacttcgggtcactcggaggcgtctttacaagtatcggtaaggcactgcatcaggtgttcggggccatttatggcgctgcgtttagcggagtttcctggactatgaaaatccttattggcgtgatcataacctggatcgggatgaactctcgcagcacatcattgagtgtctccctggtgctcgtaggaattgtgactctgtaccttggcgttatggtccaggcagatagcggttgtgtggtgtcttggaagaataaggagctgaaatgcgggtcaggaatcttcattaccgacaacgtccacacgtggacagaacagtataagtttcaacccgagagtccaagcaaattggcctccgctatccagaaggcccaggaagagggcatatgtggtattagatctgttaccaggctcgagaatctgatgtggaaacagatcactcccgaattaaaccacattctggcagagaatgaagtgaagctaacaatcatgaccggcgatataaaagggatcatgcaagccggaaagcggtcgctccgccctcagccaactgagctgaagtacagctggaaaacctggggcaaggctaaaatgctttccacagaatcatataaccagacgttcttgattgacgggccggagaccgccgagtgccccaatactaacagagcatggaatagtctggaagtggaggattacggatttggcgtattcacaaccaacatctggctcaagctgaaagaaaagcaggacgcgttttgtgactctaagttaatgagcgctgccattaaagataatagggcagtccatgccgacatgggttattggatcgagtccgctctgaacgatacatggaagatagagaaagcctcattcattgaagtgaagaattgccactggcctaaaagccatactctttggtctaacggggttttggagtccgaaatgatcatcccaaagaacctcgcaggacccgtgagtcaacacaattaccgtcctggctaccacacccagattgctggtccatggcatctgggcaagctagagatggacttcgatttttgtgacgggacgacagtcatcgtgaccgaagattgcggaaaccggggccccagcctgcgaactaccacagcctctgggaaactcattactgagtggtgctgtagatcctgcaccctgccgcctcttaggtatcgcggagaggacggctgttggtacggtatggaaatacggccattgaaggagaaagaagagaatctggttaactcattagtgacagcggggcacggacaggtagataatttcagtctcggcgtcctgggtatggccctttttctggaagagatgttgagaacgagggtgggcaccaagcatgctatcctcctggtggcagtcagcttcgttactctaattacagggaacatgtcgtttaaagacctgggacgcgtggtagtgatggtcggcgccaccatggctgatgacatcgggatgggagtgacttatctcgccctgcttgcagcgttcaaggttcgacccacatttgccgctggcttgctgttacggaagctcacctccaaagagctgatgatgacgactattggtatcgtgcttctgtctcaaagcaccatacctgaaacagtcctagagctcaccgatgccctggcattggggatgatggtgctgaagatcgttcgtaatatggaaaaataccagttagctgtgactattatggccatcctctgcgtccccaacgcagtaattctgcagaatgcctggaaggtgtcatgtacaatccttgctgttgtgagtgtctccccactgttgctcacctctagccagcagaagacagactggatacctctggcgctaactattaagggactgaaccccaccgccatcttccttacgacactctccagaaccaataaaaagaggtcatggccactgaacgaggcaatcatggctgtgggcatggtaagcattttggccagttctctgttaaagaatgacataccgatgactggccctctcgtggccgggggactgcttaccgtctgctatgttctgacaggtcgctccgctgatttggaactcgagcgggcaactgacgtgaaatgggaggatcaggccgaaatcagcggctcgtcacccattctgtctatcaccattagtgaggacgggtccatgagcatcaagaacgaagaggaggaacagacgctaacaatactgatcagaaccggacttctcgtgatttctggcctgtttccaatcagcattcccatcactgcggctgcctggtacttgtgggaggtcaaaaagcagagggccggtgtgttatgggatgttccttccccaccccctatggggaaagccgaactggaggacggagcttatcgaataaagcaaaagggcattctcggctactcacagatcggggcaggagtatacaaagaaggtacattccacaccatgtggcatgtgactcgcggcgccgtcctgatgcacaaggggaaacggatcgagccgagttgggcggatgtgaagaaagaccttattagctatggaggcggttggaagctggagggggaatggaaggagggagaagaggttcaggtgttggctctagaaccaggcaaaaatcccagagccgtccagacaaagcctggcctgtttaaaaccaacacggggactatcggagcagtgtctctcgatttctccccaggtacctcaggcagtcccataattgacaagaaagggaaggtagtcggactgtacggcaacggtgtggttacaaggagcggggcctatgtgtccgctatcgcccaaaccgagaagtctattgaggataatcctgaaatcgaggacgatatatttcgtaaacgccggcttacaattatggacttacacccgggagcaggcaagactaaaagatacctgcccgctatcgtcagggaagccatcaagcgaggcctccggaccttgattctggcgccaacgcgcgtggttgccgcagagatggaagaggctctcagagggctgcctatcaggtatcagacacccgccattaaagctgagcatactggacgggaaatagtggaccttatgtgtcacgcaaccttcacaatgcgactgttgtcgccagtcagagtgcctaactacaatctaatcattatggatgaggcccatttcaccgaccccgccagcatcgctgcgcgcggttatatctcaactagggtagaaatgggcgaggcagccgggatttttatgaccgctacaccaccgggatcccgtgatcctttcccccagagtaacgccccaataatcgacgaggaacgggagattcccgaaagatcttggaatagcggccacgagtgggtgacggattacaagggtaagactgtttggtttgtcccttccatcaaagcagggaacgacattgccgcttgcctgaggaagaatggcaagaaggtgatccaactctcacgcaaaaccttcgattctgaatacgtgaagacacgaaccaacgactgggattttgtcgtaactacagacataagcgagatgggcgcgaatttcaaagccgagagagtgatcgatccacggaggtgtatgaagcccgttattttaaccgacggcgaagaacgcgtgatcctggcagggcctatgccggtcacgcatagttccgctgcccagcgtagaggacggattggtaggaacccaaagaatgaaaacgaccagtatatctacatgggcgagccccttgaaaatgatgaggactgcgcacactggaaagaggccaagatgctgctcgataacataaatactcctgaagggattatccccagcatgtttgagccagaacgcgagaaagtggacgctattgatggagaatatcgattgagaggcgaggcccggaagacattcgttgacctgatgaggcgcggtgatctccctgtgtggctggcgtacaaagtcgcagccgaggggatcaactatgctgacagaaggtggtgttttgatggcataaagaacaatcagatccttgaagagaacgtggaagtagagatttggaccaaggagggagaacggaaaaagctaaaaccccgttggctggacgcccgcatctactctgatccattggctttaaaggagttcaaagaatttgcagccggccgaaagtcactgaccctcaatctgattactgagatggggagacttcctacattcatgacccaaaagacaagggacgctctggataacctcgccgtgttgcacactgcagaagcgggaggtcgggcctataatcatgctctgtccgagctaccggagacgctggaaaccctccttctgttaacattgctggccactgttaccggcgggatcttcctctttctgatgagtggacgcggcataggtaaaatgacacttgggatgtgctgcattatcaccgcaagcatcctgctctggtacgctcagattcagccccactggatcgccgcatcgataattttggagttctttctgatcgtcttactaattccagaacctgagaagcagagaactccccaagacaaccagctgacgtacgtggtgatcgccatactcaccgtcgttgctgcgacaatggccaatgaaatgggcttccttgagaaaactaagaaagacctgggattgggctctatcgcaacccagcagccagagtccaacattctggatatcgacctcaggcctgctagcgcctggacactgtatgccgtggcaaccacttttgtaacacccatgcttcggcattcaattgaaaatagttctgtgaacgtctccctcacggctatcgccaatcaagcgaccgtgctgatggggttgggaaagggttggccgctgagcaagatggatattggcgttccattactagctatcgggtgttactcacaggtgaaccctataactctgacagccgcactccttctgttggtcgcccactatgctattatcggacccggcctgcaggcaaaagccacccgagaggcgcagaagagagctgccgcaggtatcatgaaaaatccaaccgtagacgggattacagtgatagatctcgaccccatcccttacgatccgaagttcgaaaaacaactgggccaggttatgcttttaattctgtgcgtgactcaggtcctcatgatgcgcacgacctgggccttgtgtgaggctctgacactagccactggacccatcagtaccctgtgggaaggcaacccagggaggttttggaatacaaccattgcagtgagcatggctaacatcttccggggatcctatctcgccggcgcgggtcttctgttttctataatgaagaatactacgaacacacgtagagggaccggaaacatcggcgagactttgggtgagaaatggaaaagcaggctgaatgccctcggcaagtccgagttccaaatttacaaaaagtcagggatccaggaggtcgaccgcaccctggcaaaagaaggaattaagcggggcgagacagatcaccatgctgtgtctcgagggagtgccaaattaagatggtttgttgagaggaacatggtgactcctgaaggaaaggtagtggaccttggctgcggtcgcgggggatggtcgtattactgtggcggtctgaagaatgtccgggaggttaaaggcctcaccaaagggggacccggccacgaagaacctatcccaatgagcacatacgggtggaacctagtgagactgcagtccggagtcgatgtgttctttataccccctgaaaaatgcgacacgttgctgtgtgatattggcgagtcttcaccaaatcccaccgtagaggcaggtcgtactctcagggtgcttaacctggttgaaaattggttgaacaataacacacagttctgcatcaaggtgctgaatccgtatatgcctagcgtcatcgagaaaatggaagctctccaacggaagtacgggggagccttagtgcgcaacccactgtcccgaaatagtacccatgagatgtattgggtctctaacgccagcggcaatattgtgtcatccgttaacatgataagtagaatgcttatcaacaggttcactatgcggcacaagaaagcgacatacgaacccgacgtagacctgggcagcgggacccgcaatattggaatcgagtctgagattcctaacctagatatcataggtaagagaatcgagaaaattaagcaggagcatgaaacgtcctggcactatgaccaggatcacccatacaaaacctgggcttatcatggctcatacgagacaaagcagactgggagcgcatcgtctatggtgaatggagtcgtgaggctcctgaccaagccctgggacgttttgccgacagtgactcaaatggccatgaccgatacaaccccttttggccagcagcgagtcttcaaagaaaaggtggacactcggacgcaggagcccaaagagggtacaaagaaactgatgaagatcaccgctgaatggctctggaaagagcttgggaagaagaaaactccacgtatgtgtaccagagaagagtttacacgcaaggtaaggagtaacgccgcactgggagccattttcacggatgagaataaatggaagtccgctcgggaagcggtggaggacagcagattttgggaattagttgataaagagcgcaacctgcacttggaaggcaagtgcgagacctgtgtctacaatatgatgggcaagagggagaaaaagctcggggagttcggaaaagccaagggttcacgagcaatctggtatatgtggctgggcgctcggtttctagagttcgaagcccttgggtttctgaacgaggaccattggttctccagagaaaattctctcagcggagtggagggcgagggtctgcacaaattggggtacattctgagggatgtgagtaagaaggaaggaggcgcaatgtatgccgacgacactgctggctgggatacacgcataaccctcgaggaccttaaaaacgaagagatggtcactaatcacatggaaggggagcataagaaactggccgaggcgatctttaagttaacataccaaaacaaagttgtgcgtgtacagcggcctacccccagaggaacagtgatggatattatctccaggcgcgaccagcgaggtagcggccaagtcgggacttatggactgaataccttcacgaacatggaagcacagttgatccggcagatggagggcgaaggtgtgtttaagaccattcagcacctcacagttactgaggaggtggccgtccaaaattggctggctagagtggggagggaacgcctatctagaatggccatatcaggagatgactgcgtagttaagccacttgatgaccggttcgcaaacgctctgaccgccctcaacgatatgggcaaaatcaggaaggacattcagcagtgggagcccagtaaaggctggaatgattggacacaggtgcctttctgctcccatcactttcatgaactgatcatgaaggacgggcgtgtcttggtggtgccatgtcgaaaccaagatgagttaattggacgcgctagaatcagccagggtgccggctggtctctgcgggaaactgcatgcctcgggaaatcgtacgcgcagatgtggtcacttatgtatttccacaggcgcgacctgagactagccgctaatgccatatgtagcgcagtcccgtcccactgggttcccaccagtcggacgacatggtctatccatgctaagcacgagtggatgaccactgaggacatgctgacagtgtggaacagggtatggattcgagaaaatccttggatggaggataagaccccagtggaaagctgggaggaaatcccctacctcggaaaacgtgaggaccagtggtgcggctccttgattggtctgacttcaagagccacctgggcaaagaacatccaagccgcgataaatcaggtccgcagtcttattgggaacgaggaatacacagattatatgccttctatgaaacggtttaggagagaggaagaggaagctggagtgctgtggtga

SEQ ID NO: 14849 - RNA, 9876 nt, synthetic construct
  misc_feature 1..9876: note = derived and/or modified CDS sequence (opt3) from DENV-2__EU482670__SS-prME
  source 1..9876: mol_type = other RNA
agcgcaggcatgatcattatgctgatacccaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacacgatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagcactggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtaatgaaagagattgcagagacccagcacggaacaatcgttatccgcgtgcagtatgaaggcgatggttccccatgcaagattcccttcgagatcatggacttggagaagagatacgtcctcgggaggctgattactgtgaacccgatagtcaccgagaaggatagccctgtgaacatcgaagctgagcccccatttggcgactcgtacattatcatcggagttgagcctggccagttaaagctgaattggttcaaaaaggggtcttccattggacaaatgtttgaaacgaccatgcggggtgccaaacgaatggctatactaggcgatacagcctgggacttcgggtcactcggaggcgtgtttacaagtatcggtaaggcactgcatcaggtattcggggccatttatggcgctgcgtttagcggagtctcctggaccatgaaaatccttattggcgtgatcataacatggatcgggatgaactctcgcagcacttcattgagtgtttccctggtgctcgtcggaattgtgaccctgtaccttggcgtaatggtgcaggcagatagcggttgtgttgtctcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtgactaggctcgagaatctgatgtggaaacagatcacacccgaattaaaccacattctggcagagaatgaagtcaagctaaccatcatgactggcgatataaaagggatcatgcaagccggaaagcggtcgctccgccctcagccaaccgagctgaagtacagctggaaaacatggggcaaggctaaaatgctttccacggaatcacataaccagaccttcttgattgacgggccggagactgccgagtgccccaatacaaacagagcatggaatagtctggaagttgaggattatggatttggcgtgttcaccacaaacatctggctcaagctgaaagaaaagcaggacgcgttttgtgactctaagttaatgagcgctgccattaaagataatagggcagtgcacgccgacatgggttactggatcgagtccgctctgaacgatacttggaagatagagaaagcctcattcattgaagtaaagaattgccattggcctaaaagccacaccctttggtctaacggggtcttggagtccgaaatgatcatcccaaagaacctcgcaggacccgtgagtcaacacaattatcgtcctggctaccatacgcaggttgctggtccatggcacctgggcaagctagagatggacttcgatttttgtgacgggacaaccgtgattgtcactgaagattgcggaaaccggggccccagcctgcgaaccacaactgcctctgggaaactcatcaccgagtggtgctgtagatcctgcacactgccgcctcttaggtaccgcggagaggacggctgttggtatggtatggaaattcggccattgaaggagaaagaagagaatctggtgaactcattagttacggcggggcatggacaggtggataatttcagtctcggcgtactgggtatggccctttttctggaagagatgttgagaaccagggtcggcactaagcacgctatactcctggtggcagtgagcttcgtcacactaatcaccgggaacatgtcgtttaaagacctgggacgcgttgtggtaatggtgggcgccactatggctgatgacattgggatgggagtcacatacctcgccctgcttgcagcgttcaaggtgcgacccacctttgccgctggcttgctgttacggaagctcacgtccaaagagctgatgatgactaccatcggtattgttcttctgtctcaaagcacaatccctgaaaccgtgctagagctcactgatgccctggcattggggatgatggtcctgaagatagtgcgtaatatggaaaaatatcagttagctgttacaatcatggccattctctgcgtgcccaacgcagtcatcctgcagaatgcctggaaggtatcatgtaccattcttgctgtggttagtgtgtccccactgttgctcacatctagccagcagaaaactgactggatccctctggcgctaaccataaagggactgaaccccacggccattttccttacaaccctctccagaactaataaaaagaggtcatggccactgaacgaggcaatcatggctgtcggcatggtgagcatcttggccagttctctgttaaagaatgacattccgatgaccggccctctcgtagccgggggactgcttacagtgtgctacgtcctgactggtcgctccgctgatttggaactcgagcgggcaaccgacgttaaatgggaggatcaggccgaaataagcggctcgtcacccatcctgtctattacgatcagtgaggacgggtccatgagcattaagaacgaagaggaggaacagacactaaccatcctgataagaactggacttctcgtgatctctggcctgtttccaattagcatccccattacagcggctgcctggtatttgtgggaggtgaaaaagcagagggccggtgtcttatgggatgtgccttccccaccccctatggggaaagccgaactggaggacggagcttaccgaatcaagcaaaagggcatactcggctattcacagattggggcaggagtttacaaagaaggtaccttccatactatgtggcacgtaacacgcggcgccgtgctgatgcacaaggggaaacggatcgagccgagttgggcggatgtcaagaaagaccttatcagctacggaggcggttggaagctggagggggaatggaaggagggagaagaggtgcaggttttggctctagaaccaggcaaaaatcccagagccgtgcagaccaagcctggcctgtttaaaacgaacactgggaccattggagcagtctctctcgatttctccccaggtacatcaggcagtcccatcatagacaagaaagggaaggtggtaggactgtatggcaacggtgtcgtgaccaggagcggggcctacgtttccgctattgcccaaacagagaagtctatcgaggataatcctgaaattgaggacgatatctttcgtaaacgccggcttactataatggacttacatccgggagcaggcaagaccaaaagatatctgcccgctattgtgagggaagccatcaagcgaggcctccggacgttgatcctggcgccaacacgcgtcgtggccgcagagatggaagaggctctcagagggctgcctattaggtaccagactcccgccatccgggctgagcacaccggacgagaaattgttgaccttatgtgtcatgcaacattcaccatgagactgttgtcgccagtgcgcgtccctaactataatctaataatcatggatgaggcccacttcactgaccccgccagcattgctgcgaggggttacatctcaacccgtgtggaaatgggcgaggcagccgggatctttatgacagctacgccaccgggatcccgggatcctttcccccagagtaacgccccaattatagacgaggaaagagagatccccgaaaggtcttggaatagcggccatgagtgggtaactgattttaaaggtaagaccgtgtggttcgttccttccattaaggcagggaacgacatcgccgcttgcctgcgcaaaaatggaaagaaagtcattcaactctcacgaaagacatttgattctgaatatgtgaaaaccagaactaacgactgggatttcgtggtcacaaccgacatcagcgagatgggcgcgaattttaaggccgagcgggtaatagatccaaggcgctgtatgaaacccgtgatcttaacggacggcgaagaacgtgttattctggcagggcctatgccggtgactcacagttccgctgcccagagacggggaaggatcggtcgcaacccaaagaatgaaaacgaccagtacatttacatgggcgagccccttgaaaatgatgaggactgcgcacactggaaggaggccaaaatgctgctcgataacatcaatacacctgaagggataattcccagcatgttcgagccagaacgagagaaggtcgacgctatcgatggagaatatagattgcggggcgaggccaggaaaacctttgtggacctgatgcgcagaggtgatctccctgtttggctggcgtacaaggtggcagccgaggggattaactatgctgacaggcggtggtgtttcgatggcatcaaaaacaatcagatacttgaagagaacgtcgaagtggagatctggaccaaggagggagaacgtaagaaactaaagccccgctggctggacgcccgaatttactctgatccattggctttaaaagagtttaaggagttcgcagccggcagaaaatcactgactctcaatctgatcacagagatggggaggcttcctaccttcatgacacaaaagactcgggacgctctggataacctcgccgtattgcatacggcagaagcgggaggtcgcgcctataatcacgctctgtccgagctaccggagaccctggaaacactccttctgttaactttgctggccaccgtgacaggcgggatttttctcttcctgatgagtggaagaggcatcggtaagatgacccttgggatgtgctgcataattactgcaagcatcctgctctggtacgctcagatccagccccattggattgccgcatcgatcatattggagtttttcctgattgttttactaatcccagaacctgagaaacagaggacgccccaagacaaccagctgacctatgtcgtgattgccatcctcacagtggtcgctgcgactatggccaatgaaatgggctttcttgagaagaccaaaaaggacctgggattgggctctatagcaacacagcagccagagtccaacatcctggatattgacctccggcctgctagcgcctggaccctgtacgccgttgcaactacattcgtgacgcccatgcttcgacactcaatcgaaaatagttctgtaaacgtgtccctcaccgctattgccaatcaagcgactgtcctgatggggttgggaaaaggttggccgctgagcaagatggatatcggcgtgccattactagctattgggtgttactcacaggttaaccctatcacactgaccgccgcactccttctgttggtggcccactatgctataattggacccggcctgcaggcaaaggccaccagagaggcgcagaaacgcgctgccgcaggtatcatgaagaatccaacagtcgacgggatcactgtaattgatctcgaccccataccttacgatccgaaatttgaaaagcaactgggccaggtgatgcttttaatcctgtgcgttacacaggtgctcatgatgaggaccacatgggccttgtgtgaggctctgactctagccaccggacccattagtacactgtgggaaggcaacccagggcggttctggaataccactatcgcagtcagcatggctaacatttttcgtggatcctatctcgccggcgcgggtcttctgttctctatcatgaaaaatacgacaaacaccagaagggggactggaaacatgggcgagaccttgggtgagaagtggaaaagccgcctgaatgccctcggcaagtccgaatttcaaatatacaagaaatcagggatccaggaggtggaccggacactggcaaaggaaggaattaaacgaggcgagactgatcatcacgctgtctctagagggagtgccaagttaaggtggttcgtggagcgcaacatggttacccctgaaggaaaagtggtagaccttggctgcggtagagggggatggtcgtattactgtggcggtctgaagaatgtgagagaggtcaagggcctcacaaaagggggacccggccatgaggaacctatcccaatgagcacgtatgggtggaacctagttcgtctgcagtccggagtggatgtctttttcattccccctgaaaagtgcgacaccttgctgtgtgatatcggcgagtcttcaccaaatcccactgtggaggcaggtaggacactccgggtacttaacctggtggaaaattggttgaacaataacacccagttctgcataaaagttctgaatccgtacatgcctagcgtgattgagaagatggaagctctccaacgcaaatacgggggagccttagtccgaaacccactgtccagaaatagtactcacgagatgtattgggtgtctaacgccagcggcaatatcgtctcatccgtgaacatgatcagtaggatgcttattaaccggtttacaatgcgccataagaaggcgacctacgaacccgacgttgacctgggcagcgggacgagaaatataggaatcgagtctgagattcctaacctagatatcattggtaaaaggatcgaaaagataaaacaggagcacgaaacctcctggcactatgaccaggatcatccatacaagacatgggcttatcacggctcatacgagactaaacagaccgggagcgcatcgtctatggtaaatggagtggtccgactcctgacaaagccctgggacgtgttgccgactgttacccaaatggccatgacagataccactcctttcggccagcagcgggtgtttaaggaaaaagtcgacacgcgtacacaggagcccaaggagggtaccaaaaagctgatgaaaatcactgctgaatggctctggaaggagcttgggaaaaagaagaccccaagaatgtgtacacgcgaagagttcacgaggaaagtgcggagtaacgccgcactgggagccatttttaccgatgagaataagtggaaatccgctagagaagcggtagaggacagccgcttctgggaattagtggataaggagaggaacctgcatttggaaggcaaatgcgagacttgtgtttataatatgatgggcaagcgagagaagaaactcggggaatttggaaaggccaaaggttcacgggcaatctggtacatgtggctgggcgctagattcctagagtttgaagcccttgggttcctgaacgaggaccactggttttccagggaaaattctctcagcggagtcgagggcgagggtctgcacaagttggggtacattctgcgcgatgtgagtaaaaaggaaggaggcgcaatgtatgccgacgacacagctggctgggatacccgtatcactctcgaggaccttaagaacgaagagatggtgacaaatcatatggaaggggagcacaaaaagctggccgaggcgattttcaaattaacctaccaaaacaaggtcgttcgggtgcagagacctacacccaggggaactgtaatggatataatctcccgccgagaccagcggggtagcggccaagtggggacctatggactgaatacgtttaccaacatggaagcacagttgattagacagatggagggcgaaggtgtcttcaaaaatatccagcatctcacagtgactgaggaggttgccgtgcaaaactggctggctagggtcgggcgcgaaagactatctcggatggccatctcaggagatgactgcgtggtaaagccacttgatgacaggttcgcaaacgctctgaccgccctcaatgatatgggcaagattcgtaaagacatacagcagtgggagcccagtaagggctggaacgattggacacaggttcctttttgctcccaccatttccacgaactgatcatgaaagacgggcgaattttggtggtcccatgtcgcaatcaagatgagttaatcggacgggctcggattagccagggtgccggctggtctctgagggaaactgcatgcctcgggaagtcgtacgcgcagatgtggtcacttatgtattttcaccgcagagacctgcggctagccgctaacgccatctgtagcgcagtgccgtcccattgggtgcccaccagtaggacgacatggtctatacacgctaaacatgagtggatgaccactgaggacatgctgacagtctggaatcgagtttggatccgtgaaaacccttggatggaggataagaccccagtggaaagctgggaggaaattccctacctcggaaagagagaggaccagtggtgcggctccttgatcggtctgacttcacgcgccacctgggccaaaaatattcaagccgcgatcaaccaggtacggagtcttatagggaatgaggaatatacagattacatgccttctatgaagaggttcagacgcgaggaagaggaagctggagtgctgtggtga

SEQ ID NO: 14850 - RNA, 9876 nt, synthetic construct
  misc_feature 1..9876: note = derived and/or modified CDS sequence (opt3) from DENV-2__EU482671__SS-prME
  source 1..9876: mol_type = other RNA
agcgcaggaatgataattatgctgataccaaccgtgatggctttccacctcactactagaaacggggagcctcatatgatcgtaggtattcaagaaaagggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccacatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttatctgcaagcatagcatggtggatcgaggctggggtaatgggtgtggactattcggcaaaggcgggattgtcacttgcgcaatgtttacctgcaagaaaaacatggaaggaaagatagtgcagcctgagaatctcgaatacacaatcgtggtcaccccacactccggtgaggagcatgccgttggcaacgacactgggaaacacggaaaggaaattaaagtgacgccgcagtcaagtatcacagaggctgaactgaccggctatggtactgtaaccatggagtgtagccccagaacagggcttgatttcaatgaaatggtgctgttgcaaatggagaacaaggcctggctcgtccacaggcagtggtttctggacttacctctgccatggctccccggcgcagataagcaggagtctaattggatacagaaagaaacccttgtgactttcaagaaccctcatgctaaaaagcaagacgttgtggtcctgggatcccaggagggcgccatgcacacagcgttgacgggggccaccgaaattcagatgtcaagcggaaatctactgtttactggtcatctcaaatgccggctgcgtatggacaaacttcaactgaagggcatgagttactctatgtgtacagggaaattcaaggtggtacgcgagatcgcagagacccagcacggaacaatcgttattagagtgcagtatgaaggcgatggttccccatgcaaaatccccttcgagattatggacttggaaaagaggtacgtcctcgggcggctgataactgtgaacccgatcgtcaccgagaaagatagccctgtgaacattgaagctgagcccccatttggcgactcgtacatcatcattggagttgagcctggccagttaaagctgaattggttcaagaaagggtcttccataggacaaatgtttgaaacgaccatgcgaggtgccaagcgcatggctatcctaggcgatacagcctgggacttcgggtcactcggaggcgtgtttacaagtattggtaaagcactgcatcaggtattcggggccatctatggcgctgcgtttagcggagtctcctggaccatgaagattcttatcggcgtgataatcacatggattgggatgaactctagaagcacttcattgagtgtttccctggtgctcgtcggaatcgtgaccctgtaccttggcgtaatggtgcaggcagatagcggttgtgttgtctcttggaaaaataaggagctgaagtgcgggtcaggaattttcatcacggacaacgtgcacacatggaccgaacagtataaatttcaacccgagagtccaagcaagttggcctccgctatacagaaagcccaggaagagggcatttgtggtatcaggtctgtgactcggctcgagaatctgatgtggaagcagattacacccgaattaaaccacatcctggcagagaatgaagtcaaactaaccataatgactggcgatatcaaggggattatgcaagccggaaaacgctcgctcagacctcagccaaccgagctgaagtacagctggaagacatggggcaaagctaagatgctttccacggaatcatataaccagaccttcttgatcgacgggccggagactgccgagtgccccaatacaaacagggcatggaatagtctggaagttgaggattacggatttggcgtgttcaccacaaacatttggctcaaactgaaggaaaaacaggacgcgttttgtgactctaagttaatgagcgctgccatcaaggataatcgtgcagtgcatgccgacatgggttattggatagagtccgctctgaacgatacttggaaaattgagaaggcctcattcatcgaagtcaagaattgccactggcctaagagccataccctttggtctaacggggtcttggagtccgaaatgatcattcccaagaacctcgcaggacccgtgagtcaacacaattaccggcctggctaccacacgcagatcgctggtccatggcatctgggcaagctagagatggacttcgatttttgtgacgggacaaccgttattgtgactgaagattgcggaaaccgaggccccagcctgagaaccacaactgcctctgggaagctcataaccgagtggtgctgtaggtcctgcacactgccgcctcttcgctatcggggagaggacggctgttggtacggtatggaaatcagaccattgaaagagaaggaagagaatctggtcaactcattagtgacggcggggcacggacaggttgataatttcagtctcggcgtgctgggtatggccctttttctggaagagatgttgaggacccgcgtaggcactaaacatgctattctcctggtcgcagtgagcttcgtgacactaatcaccgggaacatgtcgtttaaggacctgggacgagtcgttgtgatggtaggcgccactatggctgatgacattgggatgggagtgacatatctcgccctgcttgcagcgttcaaagtccggcccacctttgccgctggcttgctgttacgtaagctcacgtccaaggagctgatgatgactaccatcggtatagtgcttctgtctcaaagcacaatccctgaaaccgttctagagctcactgatgccctggcattggggatgatggtgctgaaaattgtcagaaatatggaaaagtaccagttagctgtgacaatcatggccattctctgcgttcccaacgcagtgatcctgcagaatgcctggaaagtctcatgtaccatacttgctgtagtgagtgtttccccactgttgctcacatctagccagcaaaagactgactggattcctctggcgctaaccatcaaaggactgaaccccacggccatcttccttacaaccctctccaggactaataagaaacgctcatggccactgaacgaggcaattatggctgtgggcatggtcagcatattggccagttctctgttaaagaatgacatcccgatgaccggccctctcgtggccgggggactgcttacagtatgctatgtgctgactggtcggtccgctgatttggaactcgagagagcaaccgacgtcaagtgggaggatcaggccgaaattagcggctcgtcacccatcctgtctattacgatcagtgaggacgggtccatgagcatcaagaacgaagaggaggaacagacactaaccatcctgattaggactggacttctcgttatctctggcctgtttccaattagcatccccataacagcggctgcctggtacttgtgggaggtgaagaaacagcgagccggtgtgttatgggatgtcccttccccaccccctatggggaaggccgaactggaggacggagcttatcgcattaaacaaaagggcatcctcggctactcacagatcggggcaggagtgtacaaggaaggtaccttccacactatgtggcatgttacacggggcgccgtactgatgcacaaagggaagagaattgagccgagttgggcggatgtgaaaaaggaccttatcagctatggaggcggttggaaactggagggggaatggaaggagggagaagaggtccaggtgttggctctagaaccaggcaagaatcccagggccgttcagaccaaacctggcctgtttaagacgaacactgggaccataggagcagtgtctctcgatttctccccaggtacatcaggcagtcccattatcgacaaaaaggggaaagtcgtgggactgtacggcaacggtgtagtcacccgtagcggggcctatgtgtccgctattgcccaaacagagaagtctatcgaggataatcctgaaatagaggacgatatttttcgcaagcggagacttactatcatggacttacacccgggagcaggcaaaaccaagaggtacctgcccgctatcgttcgagaagccattaaacggggcctccgcacgttgatcctggcgccaacaagagtggtcgccgcagagatggaagaggctctcagggggctgcctattcggtatcagactcccgccatacgagctgagcataccggaagagaaatcgtggaccttatgtgtcacgcaacattcaccatgcgcctgttgtcgccagttagggtgcctaactacaatctaattatcatggatgaggcccatttcactgaccccgccagcatcgctgcgcgtggttatatttcaacccgggtcgaaatgggcgaggcagccgggatatttatgacagctacgccaccgggatccagagatcctttcccccagagtaacgccccaatcattgacgaggaaagggagatccccgaacgctcttggaatagcggccacgagtgggtgactgattttaagggtaaaaccgtatggttcgtgccttccattaaggcagggaacgacatcgccgcttgcctgcgaaagaatggcaaaaaggttatacaactctcaagaaaaacatttgattctgaatacgtcaagacccggactaacgactgggatttcgtggtgacaaccgacatcagcgagatgggcgcgaattttaaagccgagagggtcattgatccacgccgttgtatgaagcccgtaatcttaacggacggcgaagagagagtgattctggcagggcctatgccggttactcatagttccgctgcccagcggaggggacgcatcggtcgaaaccccaaaaatgaaaacgaccagtacatatatatgggcgagccccttgaaaatgatgaggactgcgcacactggaaggaggccaagatgctgctcgataacattaatacacctgaagggatcattcccagcatgttcgagccagaaagagagaaagtggacgctatcgatggagaataccggttgaggggcgaggcccgcaagacctttgtcgacctgatgagaaggggtgatctccctgtgtggctggcgtataaagttgcagccgaggggataaactacgctgaccggcgttggtgtttcgatggcatcaagaacaatcagattcttgaagagaacgtggaagtcgagatctggaccaaagagggagaacgcaagaagctaaaaccccgatggctggacgccagaatttattctgatccattggctttaaaggagtttaaagagttcgcagccggcaggaagtcactgactctcaatctgatcacagagatggggcggcttcctaccttcatgacacagaaaactcgcgacgctctggataacctcgccgtgttgcacacggcagaagcgggaggtagagcctacaatcatgctctgtccgagctaccggagaccctggaaacactccttctgttaactttgctggccaccgtaacaggcgggatatttctcttcctgatgagtggaaggggcattggtaagatgacccttgggatgtgctgcatcatcactgcaagcattctgctctggtatgctcagatccagccccactggatagccgcatcgattatcttggagtttttcctgattgtgttactaatcccagaacctgagaagcagcggacgccccaagacaaccagctgacctacgttgtcatagccatcctcacagtggtggctgcgactatggccaatgaaatgggctttcttgagaaaaccaagaaagacctgggattgggctctattgcaacacagcagccagagtccaacatcctggatattgacctccgacctgctagcgcctggaccctgtacgccgtcgcaactacattcgttacgcccatgcttagacattcaatcgaaaatagttctgtgaacgtatccctcaccgctattgccaatcaagcgactgtgctgatggggttgggaaagggttggccgctgagcaaaatggatatcggcgtcccattactagctatagggtgttattcacaggtgaaccctattacactgaccgccgcactccttctgttggttgcccactacgctatcatcggacccggcctgcaggcaaaggccacccgcgaggcgcagaagagggctgccgcaggtattatgaaaaatccaacagtggacgggataactgtcatcgatctcgaccccattccttatgatccgaagtttgaaaaacaactgggccaggtaatgcttttaatcctgtgcgtgacgcaggttctcatgatgcggaccacatgggccttgtgtgaggctctgactctagccaccggacccattagtacactgtgggaaggcaacccagggcgtttctggaataccactatcgcagtgagcatggctaacatatttagaggatcctacctcgccggcgcgggtcttctgttctctatcatgaagaatacgacaaacaccaggcgcgggactggaaacatgggcgagaccttgggtgagaaatggaaaagccggctgaatgccctcggcaaatccgaatttcaaatttataagcgatcagggatccaggaggtcgacagaacactggcaaaggaaggaattaaaaggggcgagactgatcaccatgctgtgtctcgcgggagtgccaagttacggtggttcgtcgagagaaacatggtgacccctgaaggaaaagttgtggaccttggctgcggtcgtgggggatggtcgtactattgtggcggtctgaagaatgtaagggaggtgaaaggcctcacaaaagggggacccggccacgaggaacctatcccaatgagcacgtacgggtggaacctagtccggctgcagtccggagttgatgtgtttttcataccccctgaaaagtgcgacaccttgctgtgtgatattggcgagtcttcaccaaatcccactgtcgaggcaggtcgcacactccgagtgcttaacctggtagaaaattggttgaacaataacacccagttctgcatcaaagtgctgaatccgtacatgcctagcgttatcgagaagatggaagctctccaaagaaaatatgggggagccttagtgaggaacccactgtcccggaatagtactcatgagatgtactgggtctctaacgccagcggcaatattgtgtcatccgtcaacatgataagtcgcatgcttatcaacagatttacaatgaggcacaagaaagcgacctatgaacccgacgtggacctgggcagcgggacgcgaaatattggaatcgagtctgagattcctaacctagatatcataggtaagcggatcgaaaagattaaacaggagcatgaaacctcctggcactacgaccaggatcacccatataagacatgggcttaccatggctcatatgagactaaacagaccgggagcgcatcgtctatggttaatggagtagtgcgtctcctgacaaagccctgggacgtcttgccgactgtgacccaaatggccatgacagataccactcctttcggccagcagagagtttttaaagaaaaggtggacacgcgcacacaggagcccaaggagggtaccaaaaagctgatgaaaatcactgctgaatggctctggaaggagcttgggaaaaagaaaaccccaaggatgtgtacacgggaagagttcacgagaaaggtccgcagtaacgccgcactgggagccatttttaccgatgagaataagtggaaatccgctagggaagcggtggaggacagccgattctgggaattagtagataaggagcggaacctgcacttggaaggcaaatgcgagacttgtgtgtacaatatgatgggcaagagagagaaaaagctcggggaatttggaaaggccaaaggttcaagggcaatctggtacatgtggctgggcgctcgcttcctagagtttgaagcccttgggttcctgaacgaggaccattggttttcccgtgaaaattctctcagcggagttgagggcgagggtctgcacaagttggggtatattctgcgggatgtcagtaaaaaggaaggaggcgcaatgtacgccgacgacacagctggctgggataccagaataactctcgaggaccttaaaaacgaagagatggtgacaaatcacatggaaggggagcataagaagctggccgaggcgatcttcaaattaacctatcaaaacaaggtggtcagggttcagcgccctacaccccgaggaactgtgatggatattatctcccggagagaccagaggggtagcggccaagtagggacctacggactgaatacgtttaccaacatggaagcacagttgatccgccagatggagggcgaaggtgtgttcaaaaatattcagcacctcacagtcactgaggaggtggccgttcaaaactggctggctagagtggggcgggaaaggctatctcgtatggccatatcaggagatgactgcgtcgtgaagccacttgatgaccgattcgcaaacgctctgaccgccctcaatgatatgggcaaaatccgcaaggacattcagcagtgggagcccagtaagggctggaacgattggacacaggtacctttttgctcccatcacttccatgaactgatcatgaaagacgggagagttttggtggtcccatgtcggaatcaagatgagttaattggaagggctcgcatcagccagggtgccggctggtctctgagagaaactgcatgcctcgggaagtcgtatgcgcagatgtggtcacttatgtactttcaccggagggacctgcgactagccgctaacgccatatgtagcgcagtgccgtcccactgggtgcccaccagtcgtacgacatggtctatccatgctaaacacgagtggatgaccactgaggacatgctgacagtctggaatagagtttggattcgcgaaaacccttggatggaggataagaccccagtggaaagctgggaggaaatcccctatctcggaaaacgggaggaccagtggtgcggctccttgattggtctgacttcaagggccacctgggcaaagaatatccaagccgcgataaaccaggtaagaagtcttattgggaatgaggaatacacagattacatgccttctatgaagcgcttccggagggaggaagaggaagctggagtgctgtggtga

SEQ ID NO: 14851 - RNA, 9876 nt, synthetic construct
  misc_feature 1..9876: note = derived and/or modified CDS sequence (opt3) from DENV-2__EU482674__SS-prME
  source 1..9876: mol_type = other RNA
agcgccggcatgatcattatgctgataccaaccgtgatggctttccacctcactactagaaacggggagcctcatatgatcgtctccattcaggaaaaggggaaatctcttctgtttaagacggaggacggtgttaatatgtgcaccttgatggcgatggatttaggcgaactgtgtgaggacacgatcacttacaaatgcccactactcaggcaaaacgaaccggaggatattgactgttggtgcaattcaaccagtacatgggtgacctatgggacttgtacaaccacgggagagcaccggcgcgaaaagcgaagcgtagccctggtgccacatgtcggcatgggtcttgagactcgtaccgaaacatggatgtcctctgagggggcgtggaaacacgctcagagaatcgagacttggatactgaggcatcctggattcaccatcatggccgcaattttggcctacacaatcggcaccacgcactttcagcgggtgctcattttcatcctgctgactgctgttgcaccatcgatgacaatgcgctgcataggcatttcaaacagagattttgtggaaggggtcagcggaggtagttgggtggacatcgtactcgagcacggctcctgtgttaccactatggccaagaataagcccacattagatttcgaactgattaaaaccgaggctaagcagcctgccacgcttaggaaatattgcatcgaagcgaagttgaccaacacaactaccgagtctcggtgtccaacacaaggggagcccagcctgaaagaagaacaagacaagcgctttgtgtgcaagcattccatggtcgatcgaggatggggcaatggttgtgggctattcggaaaaggcggcatcgtgacttgcgcaatgtttacctgcaagaaaaacatggaagggaagattgtgcagcctgagaatctcgaatacacaatagtcgttaccccacactcaggagaggagcatgccgtgggtaacgacactggcaaacacgggaaggaaatcaaagtaacgccgcagagtagcattacagaggctgaactgaccggatatggcactgtgaccatggagtgttctcccagaacaggtcttgatttcaatgaaatggtcctgttgcaaatggagaacaaggcctggctcgtgcacaggcagtggtttctggacttacctctgccatggctccccggggcagataagcaggagtccaattggatccagaaagaaacccttgttactttcaagaaccctcatgctaaaaagcaagacgtggtcgtgctgggctcacaggagggagccatgcacacagcgttgacgggcgccaccgaaatacagatgagcagtgggaatctactgtttactggacatctcaaatgccggctgcgtatggacaaacttcaactgaagggtatgtcttactccatgtgtacaggcaaattcaaggtagttaaagagattgcagagacccagcacgggacaatcgtgatccgcgtccagtatgaaggagatggcagcccatgcaagattcccttcgagatcatggacttggagaagcggtacgtgctcggtaggctgattactgtcaacccgatagtgaccgagaaggattcgcctgttaacatcgaagctgagcccccatttggggactcttacattatcatcggcgtggagcctggacagttaaagctgaattggttcaaaaagggctcctcaattgggcaaatgtttgaaacgaccatgcggggagccaaacgaatggctatactaggtgatacagcctgggacttcggcagtctcgggggagtatttactagcatcggcaaggcactgcatcaggtcttcggtgccatttatggggctgcgttttccggcgtgtcttggaccatgaaaatccttattggagttatcataacatggatcggcatgaacagccgctcaacaagtttgtccgtgagcctggtcctcgtggggattgtaaccctgtaccttggagtgatggttcaggcagattctggctgtgtcgtgtcatggaagaataaggagctgaaatgcggtagtgggatcttcattacggacaacgtgcacacatggaccgaacagtataagtttcaacccgagagcccatccaaattggcctctgctatccagaaggcccaggaagagggaatatgtggcattagatcggtcactaggctcgagaatctgatgtggaaacagatcacacccgaattaaaccacattctggcagagaatgaagttaagctaaccatcatgactggtgatatacggggcatcatgcaagccgggaaacgcagcctcagacctcagccaaccgagctgaagtactcctggaagacatggggaaaagctaagatgctttcaacggaaagttataaccagaccttcttgattgacggcccggagactgccgagtgccccaatacaaacagggcatggaactctctggaagtggaggattacgggtttggagtgttcaccacaaacatctggctcaaactgaaggaaaaacaggacgcgttttgtgacagcaagttaatgtccgctgccattaaggataatcgtgcagtacatgccgacatgggctattggatcgagtcagctctgaacgatacttggaaaatagagaaggccagcttcattgaagtcaaaaattgccactggcctaagtctcataccctttggtccaacggtgtgttggagagtgaaatgatcatccccaagaatctcgcagggcccgttagccaacacaattaccggcctggataccacacgcagattgctggcccatggcatctgggtaagctagagatggacttcgatttttgtgacggcacaaccgtgatcgtcactgaagattgcgggaaccgaggaccctctctgagaaccacaactgcctccggcaagctcattaccgagtggtgctgtaggtcatgcacactgccgcctcttcgctatagaggggaagacggatgttggtacggcatggaaataagaccattgaaagagaaggaagagaatctggtgaacagtttagttacggcgggtcacggacaggtggataatttcagcctcggagtactgggcatggccctttttctggaagagatgttgaggacccgcgtcggtactaaacatgctatcctcctggtggcagtgtcgttcgtcacactaattaccggcaacatgtcctttaaggacctggggcgagttgtggtaatggtgggagccactatggctgatgacatcggcatgggggtcacatatctcgccctgcttgcagcgttcaaagtgcggcccacctttgccgctggattgctgttacgtaagctcacgtctaaggagctgatgatgactaccattggcatcgttcttctgagccaatcaacaatacctgaaaccgtgctagagctcactgatgccctggcattgggtatgatggtcctgaaaatcgtgagaaatatggaaaagtaccagttagctgttacaattatggccatcctctgcgtgcccaacgcagtcattctgcagaatgcctggaaagtaagttgtaccatccttgctgtggtttccgtgtctccactgttgctcacaagctcccagcaaaagactgactggatacctctggcgctaaccattaaagggctgaaccccacggccatcttccttacaaccctctcaaggactaataagaaacgcagctggccactgaacgaggcaatcatggctgtcggaatggtgagtattttggcctcttccctgttaaagaatgacataccgatgaccggccctctcgtagccggcgggctgcttacagtgtgctatgtcctgactggacggagcgctgatttggaactcgagagagcaaccgacgttaagtgggaggatcaggccgaaatctcgggttcatctcccattctgagtatcacgatttccgaggacggcagcatgtctatcaaaaacgaagaggaggaacagacactaaccatactgatcaggactgggcttctcgtgattagcggactgtttccaatctccattcccatcacagcggctgcctggtacttgtgggaggtgaagaaacagcgagcaggcgtcttatgggatgtgccttcaccaccccctatgggtaaggccgaactggaggacggggcttatcgcataaaacaaaaggggattctcggccacagtcagatcggcgcaggggtttacaaggaaggaaccttccatactatgtggcacgtaacacggggtgccgtgctgatgcacaaaggcaagagaatcgagccgagctgggcggatgtcaaaaaggaccttatttcttacgggggaggctggaaactggagggtgaatggaaggagggggaagaggtgcaggttttggctctagaaccaggaaagaatcccagggccgtgcagaccaaacctggcctgtttaagacgaacactggcaccatcggggcagtctccctcgatttctcaccaggaacaagtggtagccccataattgacaaaaagggcaaagtggtagggctgtatggaaacggcgtcgtgacccgttccggtgcctacgtttctgctatcgcccaaacagagaagaatattgaggataaccctgaaatcgaggacgatatatttcgcaagcggagacttactattatggacttacatccgggggcaggaaaaaccaagaggtatctgcccgctatcgtgcgagaagccatcaaacggggcctccgcacgttgattctggcgccaacaagagtcgtggccgcagagatggaagaggctctcaggggcctgcctatccggtaccagactcccgccattcgagctgagcacaccgggagagaaatagttgaccttatgtgtcatgcaacattcaccatgcgcctgttgtcgccagtgagggtccctaattataacctaatcattatggatgaggcccacttcactgaccccgccagcatcgctgcgcgtggatacatctcaacccgggtggaaatgggtgaggcagccggcatttttatgacagctacgccaccggggtccagagatcctttcccccagagtaatgccccaataatcgacgaggaaagggagattcccgaacgctcttggaacagcggacatgagtgggtaactgattttaagggcaaaaccgtgtggttcgttccttccatcaaggcaggtaatgacattgccgcttgcctgcgaaagaacgggaaaaaggtcatccaactctcaagaaaaacatttgattctgaatatgtgaagacccggactaatgactgggatttcgtggtcacaaccgacataagcgagatgggagcgaactttaaagccgagagggtaatcgatccacgccgttgtatgaagcccgtgattttaacggacggcgaagagagagttatcctggcaggccctatgccggtgactcacagttccgctgcccagcggagggggcgcattggacgaaatcccaaaaacgaaaatgaccagtacatctacatgggtgagccccttgaaaacgatgaggactgcgcacactggaaggaggccaagatgctgctcgataatataaacacacctgaaggcattatccccagcatgttcgagccagaaagagagaaagtcgacgctattgatggggaatatcggttgaggggagaggcccgcaagacctttgtggacctgatgagaaggggcgatctccctgtttggctggcgtacaaagtggcagccgagggtatcaactatgctgaccggcgttggtgtttcgatgggataaagaataaccagatccttgaagagaatgtcgaagtggagatttggaccaaagagggcgaacgcaagaagctaaaaccccgatggctggacgccagaatctactctgatccattggctttaaaggagtttaaagagttcgcagccggaaggaagtcactgactctcaacctgattacagagatgggccggcttcctaccttcatgacacagaaaactcgcgacgctctggataatctcgccgtattgcatacggcagaagcaggagggagagcatataaccacgctctgtccgagctaccggagaccctggaaacactccttctgttaactttgctggccaccgtgacaggtggcatctttctcttcctgatgagtgggaggggaataggcaagatgacccttggtatgtgctgcattatcactgcaagcatcctgctctggtacgctcagattcagccccattggatcgccgcatcgataattttggagtttttcctgatcgttttactaattccagaacctgagaagcagcggacgccccaagacaatcagctgacctatgtcgtgatcgccatactcacagtggtcgctgcgactatggccaacgaaatggggtttcttgagaaaaccaagaaagacctgggcttgggatctatcgcaacacagcagccagagtccaatattctggatatcgacctccgacctgctagcgcctggaccctgtacgccgttgcaactacattcgtgacgcccatgcttagacactcaattgaaaacagttctgtaaatgtgtccctcaccgctatcgccaaccaagcgactgtcctgatgggcttggggaagggatggccgctgagcaaaatggatattggtgtgccattactagctatcggctgttactcacaggttaatcctataacactgaccgccgcactccttctgttggtggcccactatgctattatcgggcccggactgcaggcaaaggccacccgcgaggcgcagaagagggctgccgcaggcatcatgaaaaacccaacagtcgacggtattactgtaatagatctcgaccccatcccttacgatccgaagtttgaaaaacaactgggacaggtgatgcttttaattctgtgcgttacacaggtgctcatgatgcggaccacatgggccttgtgtgaggctctgactctagccaccggccccatcagtacactgtgggaaggaaatccaggccgtttctggaacaccactattgcagtcagcatggctaatatctttagagggtcctatctcgccggagcgggccttctgttctctataatgaagaacacgacaaacaccaggcgcggtactgggaatatcggagagaccttgggcgagaaatggaaaagccggctgaacgccctcggtaaatccgaatttcaaatttacaagaagtcaggcatccaggaggtggaccgaacactggcaaaagaagggattaagagaggagagactgatcatcacgctgtctctaggggcagtgccaaattacgctggttcgtggagcggaatatggttacccctgaagggaaggtggtagaccttggatgcggcagaggtgggtggtcgtattactgtggaggcctgaaaaacgtgcgtgaggtcaagggtctcacaaagggcgggcccggacatgaggaacctatcccaatgagcacgtatggctggaatctagttaggctgcagtccggggtggatgtctttttcataccccctgaaaaatgcgacaccttgctgtgtgatattggagagtcttcaccaaaccccactgtggaggcaggccggacactccgcgtacttaatctggtggaaaactggttgaataacaatacccagttctgcatcaaggttctgaacccgtacatgcctagcgtgatcgagaaaatggaagctctccaacgaaagtacggtggggccttagtcagaaatccactgtccaggaacagtactcacgagatgtattgggtgtctaatgccagcggaaacattgtctcatccgtgaacatgataagtcggatgcttatcaatcgctttacaatgagacataaaaaggcgacctacgaacccgacgttgacctgggcagcggcacgaggaacattgggatcgagtctgagaagcctaatctagatattatcggaaaacgaatagaaaagatcaaacaggagcacgaaacctcctggcactatgaccaggatcatccatacaagacatgggcttatcacggttcatacgagactaaacagaccggcagcgcatcgtctatggtaaacggggtggtccggctcctgacaaagccctgggacgtgttgccgactgttacccaaatggccatgacagataccactcctttcggacagcagcgtgtgtttaaggaaaaagtcgacacgagaacacaggagcccaaggagggcaccaaaaagctgatgaaaattactgctgaatggctctggaaggagcttggtaaaaagaagaccccacgcatgtgtacaagggaagagttcacgcggaaagtgagaagtaatgccgcactgggggccatctttaccgatgagaacaagtggaaatccgctcgcgaagcggtagaggacagcaggttctgggaattagtggataaggagcgaaatctgcatttggaaggaaaatgcgagacttgtgtttataacatgatgggcaagcgggagaagaaactcggcgaatttgggaaggccaaaggatcaagagcaatttggtacatgtggctgggtgctaggttcctagagtttgaagcccttggcttcctgaatgaggaccactggttttcccgcgaaaactctctcagcggggtcgagggagagggcctgcacaagttgggttacatcctgcgtgatgtgagtaaaaaggaagggggagcaatgtatgccgacgacacagctggctgggatacccggattactctcgaggaccttaagaatgaagagatggtgacaaaccatatggaaggcgagcacaaaaagctggccgaggcgatattcaaattaacctaccaaaataaggtcgttagagtgcagaggcctacaccccgcgggactgtaatggatatcatttcccgacgggaccagagaggaagcggtcaagtgggcacctatgggctgaacacgtttaccaatatggaagcacagttgatcaggcagatggagggagaaggcgtcttcaaaaacatccagcatctcacagtgactgaggaggttgccgtgcacaactggctggctcgcgtcggtagagaacggctatctaggatggccatttcaggggatgactgcgtggtaaagccacttgatgaccgtttcgcaaatgctctgaccgccctcaacgatatgggaaagatacgaaaagacatccaacagtgggagcccagtaagggctggaatgattggacacaggttcctttttgctcccatcacttccacgaactgattatgaaagacggccgcgtgttggtcgtgccatgtagaaaccaggatgagttaatcgggcgggctaggattagccaaggagccggttggtctctgcgcgaaactgcatgcctcggcaagtcgtacgcgcagatgtggtcacttatgtattttcatagacgggacctgaggctagccgctaatgccatctgtagcgcagtgccgtcccactgggtccccaccagtcgaacgacatggtctatacatgctaaacacgagtggatgaccactgaggacatgctgacagtttggaaccgtgtgtggatcagagaaaatccttggatggaggataagaccccagtagaaagctgggaggaaattccctacctcgggaagcgcgaggaccagtggtgcggatccttgatcggcctgacttcacgggccacctgggccaaaaacattcaggccgcgatcaatcaagtgaggagtcttataggtaacgaggaatatacagattacatgccttctatgaagagattccgccgggaggaagaggaagctggggtcctgtggtga

SEQ ID NO: 14852 - RNA, 9876 nt, synthetic construct
  misc_feature 1..9876: note = derived and/or modified CDS sequence (opt3) from DENV-2__EU482676__SS-prME
  source 1..9876: mol_type = other RNA
agcgcctccatgatcattatgctgataccaaccgtgatggctttccacctcactactagaaatggcgagcctcatatgatcgtcgggattcaagaaaagggaaaatctcttctgtttaagacggaggacggtgttaatatgtgcaccttgatggcaatggatttaggcgaactgtgtgaggacacaatcacttacaaatgcccactactcaggcaaaacgaaccggaggatattgactgttggtgcaattcaaccagtacatgggtgacctatgggacttgtacaaccacgggagagcaccggcgcgaaaagcgaagcgtagccctggtgccacatgtcggcatgggtcttgagactcgtaccgaaacatggatgtcctctgagggggcgtggaaacacgctcagagaatcgagacttggatactgaggcatcctggattcaccatcatggccgcaattttggcctacacaatcggcaccacgcactttcagcgggtgctcattttcatcctgctgactgctgttgcaccatcgatgacaatgcgctgcataggcatttcaaacagagattttgtggaaggggtcagcggaggtagttgggtggacatcgtactcgagcacggctcctgtgttaccactatggccaagaataagcccacattagatttcgaactgattaaaaccgaggctaagcagcctgccacgcttaggaaatattgcatcaaggcgaaattgaccaacacaactaccgaatctcggtgtccaacacaaggggagcccagcctgaaggaggaacaggacaagcgctttgtgtgcaaacattccatggtcgatcgaggatggggcaatggttgtgggctattcggaaagggcggcatcgtgacttgcgcaatgtttacctgcaaaaagaacatggaggggagaattgtgcagcctgaaaatctcgagtacacaatagtcgttaccccacactcaggagaggaacatgccgtgggtaacgacactggcaaacacgggaaggagatcaaagtaacgccgcagagtagcattacagaagctgagctgaccggatatggcactgtgaccatggaatgttctcccaggacaggtcttgatttcaatgagatggtcctgttgcaaatggaaaacaaggcctggctcgtgcaccggcagtggtttctggacttacctctgccatggctccccggggcagataagcaggagtccaattggatccagaaagagacccttgttactttcaagaaccctcatgctaaaaagcaagacgtggtcgtgctgggctcacaggaaggagccatgcacacagcgttgacgggcgccaccgagatacagatgagcagtgggaatctactgtttactggacatctcaaatgccgtctgcgcatggacaaacttcaactgaagggtatgtcttactccatgtgtacaggcaaattcaaggtagttaaagaaattgcagagacccagcacgggacaatcgtgatcagagtccagtatgagggagatggcagcccatgcaagattcccttcgaaatcatggacttggagaaaaggtacgtgctcggtcggctgattactgtcaacccgatagtgaccgaaaaggattcgcctgttaacatcgaggctgaacccccatttggggactcttacattatcatcggcgtggagcctggacagttaaagctgaattggttcaaaaagggctcctcaattgggcaaatgtttgagacgaccatgcgaggagccaaacgcatggctatactaggtgatacagcctgggacttcggcagtctcgggggagtatttactagcatcggcaaggcactgcatcaggtcttcggtgccatttatggggctgcgttttccggcgtgtcttggaccatgaaaatccttattggagttatcataacatggatcggcatgaacagcagatcaacaagtttgtccgtgagcctggtcctcgtggggattgtaaccctgtaccttggagtgatggttcaggcagattctggctgtgtcgtgtcatggaagaataaggaactgaaatgcggtagtgggatcttcattacggacaacgtgcacacatggaccgagcagtataagtttcaacccgaaagcccatccaaattggcctctgctatccagaaggcccaggaggaaggaatatgtggcattaggtcggtcactcggctcgagaatctgatgtggaaacagatcacacccgagttaaaccacattctggcagaaaatgaggttaagctaaccatcatgactggtgatataaaaggcatcatgcaagccgggaagcgcagcctcagacctcagccaaccgaactgaagtactcctggaaaacatggggaaaggctaaaatgctttcaacggagagttataaccagaccttcttgattgacggcccggaaactgccgagtgccccaatacaaacagggcatggaactctctggaggtggaagattacgggtttggagtgttcaccacaaacatctggctcaagctgaaagagaagcaggacgtattttgtgacagcaagttaatgtccgcggctattaaagataatcgtgccgtccatgcagacatgggctattggatcgaatcagccctgaacgatacttggaagatagagcgggctagcttcattgaggtgaaaaattgccactggcctaagtctcataccctttggtccaacggtgttttggaaagtgagatgatcatccccaagaatctcgccgggcccgtgagccaacacaattaccgacctggataccacacgcagattgcaggcccatggcatctgggtaagctagaaatggacttcgatttttgtgacggcacaaccgtcatcgtgactgaggattgcgggaacagaggaccctctctgaggaccacaactgcttccggcaagctcattaccgaatggtgctgtcgctcatgcacactgccgcctcttcggtatagaggggaggacggatgttggtacggcatggagataaggccattgaaagaaaaggaggaaaatctggttaacagtttagtgacggccggtcacgggcaggtagataatttcagcctcggagtcctgggcatggcgctttttctggaggaaatgttgcgcacccgagtgggtactaaacatgccatcctcctggtggctgtctcgttcgttacactaattaccggcaacatgtcctttaaggacctggggcgggtggtagtgatggtcggagcaactatggccgatgacatcggcatgggggtgacatatctcgctctgcttgccgcattcaaagttcgtcccacctttgcggccggattgctgttaagaaagctcacgtctaaggagctgatgatgactaccattggcatcgtgcttctgagccaatcaacaatacctgagaccgtcctagaactcactgatgctctggccttgggtatgatggtgctgaaaatcgttaggaatatggagaagtaccagttagcagtgacaattatggctatcctctgcgtccccaacgccgtaattctgcagaatgcatggaaagtgagttgtaccatccttgccgttgtgtccgtctctccactgttgctcacaagctcccagcaaaagactgactggatacctctggctctaaccattaaagggctgaaccccacggcgatcttccttacaaccctctcacgcactaataagaaacggagctggccactgaacgaagccatcatggcagtgggaatggtaagtattttggcttcttccctgttaaagaatgacataccgatgaccggccctctcgtggccggcgggctgcttacagtctgctatgttctgactggaagaagcgccgatttggagctcgaaagggctaccgacgtgaagtgggaggatcaggcagagatctcgggttcatctcccattctgagtatcacgatttccgaagacggcagcatgtctatcaaaaacgaggaagaggagcagacactaaccatactgatccgaactgggcttctcgtgattagcggactgtttccaatctccattcccatcacagccgcggcttggtacttgtgggaagtcaagaaacagcgcgccggcgtgttatgggatgttccttcaccaccccctatgggtaaggcagagctggaagacggggcctatcggataaaacaaaagggcattctcggatacagtcagatcggcgctggggtatacaaggagggaaccttccacactatgtggcatgtgacaagaggtgcagtcctgatgcacaaaggcaagaggatcgaaccgagctgggccgatgtgaaaaaggaccttatttcttatgggggaggctggaaactggagggtgagtggaaggaaggggaggaagttcaggtgttggcgctagagccaggaaagaatccccgtgctgtccagaccaaacctggcctgtttaagacgaacactggcaccatcggggccgtgtccctcgatttctcaccaggaacaagtggtagccccataattgacaaaaagggcaaagtagtcgggctgtacggaaacggcgtggttacccgctccggtgcatatgtgtctgccatcgctcaaacagaaaagtcgattgaggataatcctgagatcgaagacgatatatttcggaagagaaggcttactattatggacttacacccgggggccggaaaaaccaagcgatacctgcccgcaatcgtccgggaggctatcaaacgcggcctcagaacgttgattctggccccaacaagggtggttgcggccgaaatggaggaagcactccggggcctgcctatccgatatcagactcccgctattagagccgagcataccgggcgcgagatagtggaccttatgtgtcacgctacattcaccatgaggctgttgagcccagtccgtgtgcctaactacaatctaatcattatggatgaagcacatttcactgaccccgcctcaatcgccgctcggggatatatctccaccagagtagagatgggtgaagcggcaggcatttttatgacagccacgccaccggggagtagggatcctttcccccagtctaacgctccaataatcgacgaggagcgcgaaattcccgagcgaagctggaactccggacacgaatgggtgactgattttaagggcaaaaccgtttggttcgtcccttcaatcaaggccggtaacgacattgcagcctgcctgagaaagaatgggaaaaaggtgatccaactctctcggaaaacatttgatagcgagtacgtgaagaccaggactaacgactgggatttcgtcgtaacaaccgacataagtgaaatgggagctaattttaaagcggagcgcgtgatcgatccacgtagatgtatgaagcccgttattttaacggacggcgaggaacgggtgatcctggccggccctatgccggtcactcattccagcgcagctcagaggcgcgggcgaattggaagaaaccccaagaatgagaacgaccagtacatctatatgggtgaaccccttgagaatgatgaagactgcgcccactggaaggaggcaaagatgctgctcgataacataaatacacctgagggcattatcccctctatgttcgaaccagagcgggaaaaagtggacgccattgatggggagtacaggttgcgcggagaagctagaaagacctttgttgacctgatgaggcggggcgatctccctgtgtggctggcctataaagtcgcggcagagggtatcaactacgccgaccgtcgctggtgtttcgatgggataaagaacaatcagatccttgaggaaaacgtggaggtagaaatttggaccaaagagggcgagcgaaagaagctaaaacccagatggctggacgctaggatctattcagatccattggccttaaaggaatttaaagagttcgctgcaggacggaagtccctgactctcaatctgattacagaaatgggccgccttcctaccttcatgacacagaaaactagagacgccctggataacctcgctgtgttgcacacggccgaggcagggggaagggcgtacaatcatgccctgagtgaactaccggagaccctggagacactccttctgttaactttgctggctaccgttacaggtggcatctttctcttcctgatgagcgggcggggaataggcaagatgacccttggtatgtgctgcattatcactgcctcgatcctgctctggtatgcacagattcagccccactggatcgctgcctctataattttggaatttttcctgatcgtcttactaattccagagcctgaaaagcagcgaacgccccaagacaaccagctgacctacgtggtgatcgcaatactcacagtcgttgccgctactatggcgaatgagatggggtttcttgagaaaaccaagaaagacttcggcctgggatccatcgccacacagcagccagagagcaacattttggatatcgacctgagacctgcatcagcttggaccctctacgccgtggccactacatttgtaacgcccatgctgcgccatagtattgaaaattcttccgtgaacgtcagccttaccgcaatcgctaatcaagccactgtgctcatgggcctggggaagggatggccgttgtcaaaaatggatattggtgttccactgttagcgatcggctgttatagtcaggtgaaccctataacactaaccgctgccctgctccttctggtcgcacactacgccattatcgggcccggattgcaggctaaggcaaccagggaagcccagaagcgggcggctgccggcatcatgaaaaatccaacagtagacggtattactgtgatagatctggaccccatcccttatgatccgaagttcgagaaacaactcgggcaggttatgctgcttattttatgcgtgacgcaggtcctgatgatgcgtaccacatgggcactctgtgaagccttgactctggctaccggccccatcagcacactatgggagggaaacccaggcagattttggaataccactattgccgtgtccatggcaaacatcttcagggggtcttacctggctggagccggcctcctttttagcataatgaagaatacgacaaacacccgccggggtactgggaacatcggagaaaccctgggcgagaaatggaagtcccgattgaatgcgctgggtaaatcagagttccaaatttataagaagtctggcatccaggaagtcgacagaacactcgccaaagaggggattaagaggggagaaactgatcaccatgcagtgagtcgcggctcggctaaactgcggtggtttgttgagagaaacatggtgacccctgaggggaaggtagtggacttaggatgcggccgtggtgggtggagctactattgtggaggccttaggaatgtccgggaagttaaaggtctgacaaagggcgggcccggacacgaggaacctatcccaatgtccacgtacggctggaacctcgtgcgcctacagtctggggtcgatgtgttcttcataccccctgagaagtgcgacaccctgttgtgtgatattggagaatcaagcccaaatcccactgtagaggccggccgaacactgagagtgctcaaccttgttgagaattggctgaacaataacacccagttttgcatcaaagtgttgaatccgtacatgccttccgtcatcgaaaagatggaggcactgcaaaggaaatatggtggggctctcgtgcggaacccattaagtcgcaattctactcatgaaatgtactgggtcagcaacgcctcaggaaatattgtgtccagtgttaacatgataagcagaatgctgatcaacaggttcacaatgcgacacaagaaagccacctatgagcccgacgtagaccttggctctggcacgcggaatattgggatcgaatccgagattcctaacctggatatcataggaaagcgtatcgagaagattaaacaggaacatgagacctcatggcactacgaccaggatcacccatataagacatgggcgtaccatggtagctatgaaactaaacagaccggctcggcttctagtatggtgaatggggtcgtgagactactcacaaagccctgggacgttctgccgactgtgacccaaatggcaatgacagataccactccttttggacagcagcgcgtcttcaaagagaaggtggacacgaggacacaggaacccaaggagggcaccaaaaagttgatgaaaatcactgccgagtggctgtggaaggaactcggtaaaaagaaaaccccacggatgtgtacaagagaggaatttacgcgcaaggtaaggtccaacgctgcccttggggcaattttcaccgatgagaataagtggaaaagcgcccgagaggctgtggaagactcacggttttgggagctggttgataaggaaagaaacttacacctggagggaaaatgcgaaacttgtgtctacaatatgatgggcaagagggagaaaaagttgggcgagttcgggaaggcgaaaggatcccgcgccatctggtacatgtggctcggtgcacgttttctggagttcgaggctctaggctttcttaacgaagaccattggttctctcgggagaatagcctgagtggggtggaaggagagggcctccacaagctgggttatattttgagagatgtgtccaaaaaggaagggggagccatgtacgcagacgacacagccggctgggataccaggataactctggaagacctcaaaaacgaggaaatggtcacaaatcacatggagggcgaacataagaaacttgctgaggccatctttaaactgacctatcaaaacaaggttgtgcgcgtacagcgacctacaccccgggggactgtgatggatattatcagcagaagggaccagcgcggatctggtcaagtcggcacctacgggttaaatacgttcaccaacatggaggcgcagctgatcagacagatggaaggagagggcgtgttcaaaaatattcagcacttgacagttactgaagaggtggcagtccaaaactggctcgcccgggtgggtagggagcgtctgtcacgaatggctataagtggggatgactgcgtagttaagccactagatgaccgctttgccaacgcacttaccgctctgaatgatatgggaaaaatcagaaaggacattcagcagtgggaaccctccaagggctggaacgattggacacaggtgcctttctgcagccatcactttcatgagctcatcatgaaagacggccgggtcctggtggtgccatgtaggaatcaagatgaattgattgggcgcgccagaatctctcagggagctggttggtcgttacgggagactgcctgcctgggcaagtcatatgcacagatgtggagcctcatgtacttccacaggcgagaccttcgtctggcggccaacgctatatgttccgccgtcccgagtcactgggttcccacctctagaacgacatggagcatccatgcaaaacacgaatggatgaccactgaggacatgctagctgtgtggaatcgcgtatggattcgggagaacccttggatggaagataagacaccagtggagtcctgggaagagatcccctatctggggaaaagggaagaccagtggtgcggatcactcattggcttgaccagtagagccacttgggcaaagaatatccaagccgcgataaaccaggtccgctctctgattggtaatgaggagtacaccgattacatgcctagcatgaagcggtttaggcgagaagaggaagaggctggggtgctttggtga

SEQ ID NO: 14853 - RNA, 9876 nt, synthetic construct
  misc_feature 1..9876: note = derived and/or modified CDS sequence (opt3) from DENV-2__EU482677__SS-prME
  source 1..9876: mol_type = other RNA
agcgcaggcatgatcattatgctgatacccaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacactatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcgtgacggacaacgtccacacatggaccgaacagtataagtttcaacccgagagtccaagcaaattggcctccgctattcagaaggcccaggaagagggcatctgtggtataagatctgttactaggctcgagaatctgatgtggaaacagattacacccgaattaaaccacatcctggcagagaatgaagtgaagctaaccattatgactggcgatatcaaagggataatgcaagccggaaagcggtcgctccgccctcagccaaccgagctgaagtacagctggaaaacatggggcaaggctaaaatgctttccacggaatcatataaccagaccttcttgatcgacgggccggagactgccgagtgccccaatacaaacagagcatggaatagtctggaagtggaggattacggatttggcgtattcaccacaaacatttggctcaagctgaaagaaaagcaggacgcgttttgtgactctaagttaatgagcgctgccatcaaagataatagggcagtccatgccgacatgggttattggattgagtccgctctgaacgatacttggaagatcgagaaagcctcattcatagaagtgaagaattgccactggcctaaaagccataccctttggtctaacggggttttggagtccgaaatgattatcccaaagaacctcgcaggacccgtgagtcaacacaattaccgtcctggctaccacacgcagatcgctggtccatggcatctgggcaagctagagatggacttcgatttttgtgacgggacaaccgtcattgtgactgaagattgcggaaaccggggccccagcctgcgaaccacaactgcctctgggaaactcatcaccgagtggtgctgtagatcctgcacactgccgcctcttaggtatcgcggagaggacggctgttggtacggtatggaaattcggccattgaaggagaaagaagagaatctggttaactcattagtgacggcggggcacggacaggtagataatttcagtctcggcgtcctgggtatggccctttttctggaagagatgttgagaaccagggtgggcactaagcatgctatactcctggtggcagtcagcttcgttacactaatcaccgggaacatgtcgtttaaagacctgggacgcgtggtagtgatggtcggcgccactatggctgatgacattgggatgggagtgacatatctcgccctgcttgcagcgttcaaggttcgacccacctttgccgctggcttgctgttacggaagctcacgtccaaagagctgatgatgactaccatcggtattgtgcttctgtctcaaagcacaatccctgaaaccgtcctagagctcactgatgccctggcattggggatgatggtgctgaagatagttcgtaatatggaaaaataccagttagctgtgacaatcatggccattctctgcgtccccaacgcagtaatcctgcagaatgcctggaaggtgtcatgtaccattcttgctgttgtgagtgtctccccactgttgctcacatctagccagcagaagactgactggatccctctggcgctaaccataaagggactgaaccccacggccattttccttacaaccctctccagaactaataaaaagaggtcatggccactgaacgaggcaatcatggctgtgggcatggtaagcatcttggccagttctctgttaaagaatgacattccgatgaccggccctctcgtggccgggggactgcttacagtctgctatgttctgactggtcgctccgctgatttggaactcgagcgggcaaccgacgtgaaatgggaggatcaggccgaaataagcggctcgtcacccatcctgtctattacgatcagtgaggacgggtccatgagcattaagaacgaagaggaggaacagacactaaccatcctgataagaactggacttctcgtgatctctggcctgtttccaattagcatccccattacagcggctgcctggtacttgtgggaggtcaaaaagcagagggccggtgtgttatgggatgttccttccccaccccctatggggaaagccgaactggaggacggagcttatcgaatcaagcaaaagggcatactcggctactcacagattggggcaggagtatacaaagaaggtaccttccacactatgtggcatgtgacacgcggcgccgtcctgatgcacaaggggaaacggatcgagccgagttgggcggatgtgaagaaagaccttatcagctatggaggcggttggaagctggagggggaatggaaggagggagaagaggttcaggtgttggctctagaaccaggcaaaaatcccagagccgtccagaccaagcctggcctgtttaaaacgtctactgggaccattggagcagtgtccctcgatttctcaccaggtacaagtggcagccccatcatagacaagaaagggaaggtagtcggactgtacggcaacggtgtggttaccaggtccggggcctatgtgtctgctattgcccaaacagagaagtcgatcgaggataaccctgaaattgaggacgatatctttcgtaaacgccggcttactataatggacttacacccgggagcaggcaagaccaaaagatacctgcccgctattgtcagggaagccatcaagcgaggcctccggacgttgatcctggcgccaacacgcgtggttgccgcagagatggaagaggctctcagagggctgcctattaggtatcagactcccgccatccgggctgagcataccggacgagaaattgtggaccttatgtgtcacgcaacattcaccatgagactgttgagcccagtccgcgtgcctaattacaacctaataatcatggatgaggcccatttcactgaccccgcctcaattgctgcgaggggttatatctccacccgtgtagaaatgggcgaggcagccgggatctttatgacagctacgccaccgggaagtcgggatcctttcccccagtctaatgccccaattatagacgaggaaagagagatccccgaaaggagctggaactccggccacgagtgggtgactgattttaaaggtaagaccgtttggttcgtcccttcaattaaggcagggaatgacatcgccgcttgcctgcgcaaaaacggaaagaaagtgattcaactctctcgaaagacatttgatagcgaatacgtgaaaaccaagactaatgactgggatttcgtcgtaacaaccgacatcagtgagatgggcgcgaactttaaagccgagagagtgatagatccacggaggtgtatgaagcccgttatcttaacggacggcgaagaacgcgtgattctggcagggcctatgccggtcactcattccagcgctgcccagcgtagaggacggatcggtaggaatccaaagaacgaaaatgaccagtacatttatatgggcgagccccttgaaaacgatgaggactgcgcacactggaaagaggccaagatgctgctcgataatatcaacacacctgaagggataattccctctatgttcgagccagaacgcgagaaagtggacgctatcgatggagaataccgattgagaggcgaggcccggaagacctttgttgacctgatgaggcgcggtgatctccctgtgtggctggcgtataaagtcgcagccgaggggattaattacgctgacagaaggtggtgtttcgatggcatcaagaacaaccagatacttgaagagaatgtggaagtagagatctggaccaaggagggagaacggaaaaagctaaaaccccgttggctggacgcccgcatttattcagatccattggctttaaaggagtttaaagagttcgcagccggccgaaagtccctgactctcaacctgatcacagagatggggagacttcctaccttcatgacacaaaaggctagggacgccctggataatctcgcagtgttgcacactgcggaagccggaggtcgggcttacaaccatgccctgagtgagctaccggagacgctggaaaccctccttctgttaacattgctggcaactgttaccggcgggatttttctcttcctgatgagcggacgcggcatcggtaaaatgacacttgggatgtgctgcataattaccgcttcgatcctgctctggtatgcccagatccagccccactggattgcagcctctatcatattggagtttttcctgattgtcttactaatcccagaacctgagaagcagagaactccccaagacaatcagctgacgtacgtggtgattgctatcctcaccgtcgttgcggccacaatggcaaacgaaatgggctttcttgagaaaactaagaaagacctgggattgggctccatagctacccagcagccagagagcaatatcctggatattgacctcaggcctgcctcagcctggacactgtacgcagtggctaccactttcgtaacacccatgcttcggcatagtatcgaaaactcttccgtgaatgtcagcctcacggccattgcgaaccaagctaccgtgctgatggggttgggaaagggttggccgctgtcaaagatggatatcggcgttccattactagccattgggtgttatagtcaggtgaatcctatcactctgacagcagccctccttctgttggtcgctcactacgcaataattggacccggcctgcaggccaaagcgacccgagaggctcagaagagagccgcagccggtatcatgaaaaacccaaccgtagacgggatcacagtgattgatctcgaccccataccttatgatccgaagtttgaaaaacaactgggccaggttatgcttttaatcctgtgcgtgactcaggtcctcatgatgcgcacgacctgggctttgtgtgaggccctgacactagcaactggacccattagcaccctgtgggaaggcaatccagggaggttctggaacacaaccatcgctgtgtccatggccaatatttttcggggatcttacctcgcgggcgccggtcttctgttcagcatcatgaagaacactacgaatacacgtagagggaccggaaacataggcgagactttgggtgagaaatggaagtccaggctgaacgcactcggcaagtcagaatttcaaacctataaaaagtctgggatccaggaggtcgaccgcacactggctaaagaaggaattaagcggggcgagactgatcaccatgccgtgagtcgagggtcggcaaaattaagatggttcgttgagaggaatatggtgacccctgaaggaaaggtagtggaccttggctgcggtcgcgggggatggagctactattgtggcggtctgaagaacgtccgggaggttaaaggcctcacaaaagggggacccggccacgaagaacctatcccaatgtccacgtacgggtggaatctagtgagactgcagtctggagtcgatgtgtttttcattccccctgaaaaatgcgacaccttgctgtgtgatatcggcgagtcaagcccaaaccccactgtagaggctggtcgtacactcagggtgcttaatctggttgaaaactggttgaataacaatacccagttctgcataaaggtgctgaacccgtacatgccttccgtcattgagaaaatggaagccctccaacggaagtatgggggagccttagtgcgcaatccactgagtcgaaactctactcatgagatgtactgggtcagcaatgcgtcaggcaacatcgtgtccagtgttaatatgatcagcagaatgcttattaacaggtttacaatgcggcacaagaaagctacctatgaacccgacgtagacctgggctctgggacgcgcaacataggaaatgagtccgagatccctaacctagatattatcggtaagagaattgagaagatcaagcaggagcatgaaacctcatggcactacgaccaggatcacccatataaaacatgggcataccatggcagctatgagactaagcagaccgggtcggcctctagtatggtgaatggagtcgtgaggctcctgacaaagccctgggacgttttgccgactgtgacccaaatggctatgacagataccactcctttcggccagcagcgagtctttaaagaaaaggtggacacgcggacacaggagcccaaagagggtaccaagaaactgatgaagataactgccgaatggctctggaaagagcttgggaagaagaaaaccccacgtatgtgtacaagagaagagttcacgcgcaaggtaaggtccaacgcagccctgggagctatctttaccgatgagaataaatggaaaagcgcgcgggaagccgtggaggactcaagattctgggaattagttgataaagagcgcaacctgcacttggaaggcaagtgcgagacttgtgtctacaatatgatgggcaagagggagaaaaagctcggggaatttggaaaagcaaagggttcccgagctatttggtacatgtggctgggcgcccggttcctagagtttgaagcacttgggttcctgaacgaggaccattggttttctagagaaaatagcctcagtggagtggagggcgagggtctgcacaaattggggtatatcctgagggatgtgtccaagaaggaaggaggcgccatgtacgctgacgacacagccggctgggatacccgcattactctcgaggaccttaaaaacgaagagatggtcacaaatcacatggaaggggagcataagaaactggcggaggcaatcttcaagttaacctatcaaaacaaagttgtgcgtgtacagcggcctacacccagaggaactgtgatggatattataagcaggcgcgaccagcgaggttctggccaagtcgggacctacggactgaatacgtttaccaacatggaagcccagttgatccggcagatggagggcgaaggtgtgttcaagaatattcagcacctcacagttactgaggaggtggctgtccaaaactggctggccagagtggggagggaacgcctatcaagaatggcaatcagtggagatgactgcgtagttaagccacttgatgaccggttcgctaacgccctgaccgctctcaatgatatgggcaaaatcaggaaggacattcagcagtgggagccctccaaaggctggaacgattggacacaggtgcctttttgcagccatcacttccatgaactgataatgaaggacgggcgtgtcttggtggtgccatgtcgaaatcaagatgagttaatcggacgcgccagaatttctcagggtgcaggctggtcgctgcgggaaactgcgtgcctcgggaaatcatatgcccagatgtggagccttatgtactttcacaggcgcgacctgagactagctgccaacgcaatctgttccgctgtcccgagtcactgggttcccacctctcggacgacatggagcattcatgccaagcacgagtggatgaccactgaggacatgctgacagtgtggaatagggtatggatccgagaaaacccttggatggaggataagaccccagtggaatcctgggaggaaataccctatctcggaaaacgtgaggaccagtggtgcggctcattgatcggtctgacaagtagagcaacctgggccaagaatattcaagtcgcgatcaaccaggtgcgctctcttattgggaatgaggaatacacagattacatgcctagcatgaaacggttcaggagagaggaagaggaagctggagttctgtggtga

SEQ ID NO: 14854 - RNA, 9876 nt, synthetic construct
  misc_feature 1..9876: note = derived and/or modified CDS sequence (opt3) from DENV-2__EU482678__SS-prME
  source 1..9876: mol_type = other RNA
agcgcaggaatgatcattatgctgataccaaccgtgatggctttccacctcactactcggaacggggagcctcatatgatcgtcggtattcaagaaaagggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagcactggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaggaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagatgagcaggaatctaattggatccagaaggagacccttgttactttcaaaaaccctcatgctaagaaacaagacgtggtcgtgctgggatcccaggaaggcgccatgcacacagcgttgacgggggccaccgagatacagatgtcaagcggaaatctactgtttactggtcatctcaagtgccggctgcgtatggacaaacttcaactgaagggcatgagttactctatgtgtacagggaagttcaaagtagttaaggagattgcagaaacccagcacggaacaatcgtgatccgcgtccagtatgagggcgatggttccccatgcaaaattcccttcgaaatcatggacttggagaagagatacgtgctcgggaggctgattactgtcaacccgatagtgaccgaaaaagatagccctgttaacatcgaggctgagcccccatttggcgactcgtacattatcatcggagtggaacctggccagttaaagctgaattggttcaagaaagggtcttccattggacaaatgtttgagacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggaactgaagtgcgggtcaggaatcttcattacggacaacgtgcacacatggaccgagcagtataaatttcaacccgaaagtccaagcaagttggcctccgctatccagaaagcccaggaggagggcatatgtggtattagatctgtcactaggctcgaaaatctgatgtggaagcagatcacacccgagttaaaccacattctggcagaaaatgaggttaaactaaccatcatgactggcgatataaaggggatcatgcaagccggaaaacggtcgctccgccctcagccaaccgaactgaagtacagctggaagacatggggcaaagctaagatgctttccacggagtcatataaccagaccttcttgattgacgggccggagactacagaatgccccaataccaacagagcctggaatagtctggaggtggaagattacggatttggcgtgttcacaactaacatctggctcaaactgaaggagaaacaggacgcattttgtgactctaagttaatgagcgcggctattaaggataatagggccgtacatgcagacatgggttattggatcgagtccgccctgaacgatacctggaaaatagaaaaggcttcattcattgaggtcaaaaattgccactggcctaagagccatacgctttggtctaacggggtgttggaatccgagatgatcatccccaagaacctcgccggacccgttagtcaacacaattaccgtcctggctaccacacacagattgcaggtccatggcatctgggcaagctagaaatggacttcgatttttgtgacgggaccactgtgatcgtcaccgaggattgcggaaaccggggccccagcctgcgaacaactaccgcttctgggaagctcattacagagtggtgctgtagatcctgcacgctgccgcctcttaggtatcgcggagaagacggctgttggtacggtatggagatacggccattgaaagaaaaggaggaaaatctggtgaactcattagttaccgccgggcacggacaggtggataatttcagtctcggcgtactgggtatggcgctttttctggaggagatgttgagaactagggtcggcacaaaacatgccatcctcctggtggctgtgagcttcgtcaccctaattactgggaacatgtcgtttaaggacctgggacgcgttgtggtaatggtgggcgcaacaatggccgatgacatcgggatgggagtcacctatctcgctctgcttgccgcattcaaagtgcgacccacgtttgcggccggcttgctgttacggaagctcacttccaaggaactgatgatgaccacaattggtatcgttcttctgtctcaaagcaccatacctgagactgtgctagaactcacagatgctctggccttggggatgatggtcctgaaaatcgtgcgtaatatggagaagtaccagttagcagttaccattatggctatcctctgcgtgcccaacgccgtcattctgcagaatgcatggaaagtatcatgtacaatccttgccgtggttagtgtgtccccactgttgctcacttctagccagcaaaagaccgactggatacctctggctctagcgattaaaggactgaaccccacggccatcttccttacaaccctctccagaactaataagaaaaggtcatggccactgaacgaagcaatcatggctgtcggcatggtgagcattttggccagttctctgttaaagaatgacataccgatgaccggccctctcgtagccgggggactgcttacagtgtgctatgtcctgactggtcgctccgctgatttggagctcgagcgggcaaccgacgttaagtgggaagatcaggccgagatcagcggctcgtcacccattctgtctatcacgattagtgaagacgggtccatgagcatcaaaaacgaggaggaggagcagacactaaccatactgatcagaactggacttctcgtgatttctggcctgtttccaatcagcattcccatcacagcggctgcctggtacttgtgggaagtgaagaaacagagggccggtgtcttatgggatgtgccttccccaccccctatggggaaggccgagctggaagacggagcttatcgaataaaacaaaagggcattctcggctactcacagatcggggcaggagtttacaaggagggtaccttccacactatgtggcatgtaacacgcggcgccgtgctgatgcacaaagggaagcggatcgagccgagttgggcggatgtcaaaaaggaccttattagctatggaggcggttggaaactggaaggggagtggaaggaaggagaggaagtgcaggttttggctctagagccaggcaagaatcccagagccgtgcagaccaaacctggcctgtttaagacgaacactgggaccatcggagcagtctctctcgatttctccccaggtacatcaggcagtcccataattgacaaaaaggggaaagtggtaggactgtacggcaacggtgtcgtgaccaggagcggggcctatgtttccgctatcgcccaaacagagaagtctattgaagataatcctgagatcgaagacgatatatttcgtaagcgccggcttactattatggacttacacccgggagcaggcaaaaccaagagatacctgcccgctatcgtgagggaggccatcaaacgaggcctccggacgttgattctggcgccaacacgcgtcgtggccgcagaaatggaggaggctctcagagggctgcctatcaggtatcagactcccgccattcgggctgaacataccggacgagagatagttgaccttatgtgtcacgcaacattcaccatgagactgttgtcgccagtgcgcgtccctaactacaatctaatcattatggatgaagcccatttcactgaccccgccagcatcgctgcgaggggttatatctcaacccgtgtggagatgggcgaggcagccgggatttttatgacagctacgccaccgggatcccgggatcctttcccccagagtaacgccccaataatcgacgaagagagagaaattcccgagaggtcttggaatactggccacgaatgggtaaccgattttaagggtaaaacagtgtggttcgttcctagcatcaaggcagggaacgacattgccgcttgcctgcgcaagaatggcaaaaaggtcatccaactctcccgaaaaacctttgattcagagtacgtgaagactagaacaaacgactgggatttcgtggtcaccacggacatatctgagatgggcgcgaattttaaagccgaacgggtaatcgatccaaggcgctgtatgaagcccgtgattttaactgacggcgaggaacgtgttatcctggcagggcctatgccggtgacacatagcagtgctgcccagagacggggaaggattggtcgcaaccccaaaaatgagaacgaccagtacatctatatgggcgaaccccttgagaatgatgaggactgcgcacactggaaggaagccaagatgctgctcgataacataaatacccctgaggggattatcccctccatgttcgaaccagagcgagaaaaagtcgacgctattgatggagagtacagattgcggggcgaggccaggaagacctttgtggacctgatgcgcagaggtgatctccctgtttggctggcgtataaagtggcagccgaagggatcaactacgctgacaggcggtggtgtttcgatggcataaagaacaatcagatccttgaggaaaacgtcgaggtggagatttggactaaagaaggagagcgtaagaagctaaaaccccgctggctggacgcccgaatctatagcgatccattggctttaaaggaatttaaagagttcgcagccggcagaaagtctctgacactcaatctgattaccgaaatggggaggcttcctacattcatgactcagaaaacgcgggacgctctggataacctcgccgtattgcacaccgcagaggcgggaggtcgcgcctacaatcatgctctgtcagagctaccggaaacactggagactctccttctgttaaccttgctggccacagtgaccggcgggatctttctcttcctgatgtccggaagaggcataggtaagatgactcttgggatgtgctgcattatcacggcaagtatcctgctctggtatgctcagattcagccccactggatcgccgcaagcataattttggaatttttcctgatcgttttactaattccagagcctgaaaagcagaggaccccacaagacaaccagctgacatacgtcgtgatcgccatactcactgtggtcgctgcgaccatggccaatgagatgggctttcttgagaaaacaaagaaagacctgggattgggctcgatcgcaacccagcagccagaatctaacattctggatatcgacctccggcctgcttccgcctggactctgtacgccgttgcaacaacgttcgtgacccccatgcttcgacatagcattgaaaattcaagtgtaaacgtgtctctcactgctatcgccaatcaagcgacagtcctgatggggttgggaaagggttggccgctgtccaaaatggatattggcgtgccattactagctatcgggtgttatagccaggttaaccctataaccctgaccgccgcactccttctgttggtggcccactacgctattatcggacccggcctgcaggcaaaggccacaagagaagcgcagaagcgcgctgccgcaggtatcatgaaaaatccaactgtcgacgggattacggtaatagatctcgaccccatcccttatgatccgaagtttgagaaacaactgggccaggtgatgcttttaattctgtgcgttacccaggtgctcatgatgaggacaacttgggccttgtgtgaagctctgaccctagccacaggacccatctcaaccctgtgggagggcaacccagggcggttctggaatactacgattgcagtcagtatggctaacatctttcgtggaagctacctcgccggcgcgggtcttctgttctccataatgaagaatacaaccaacactagaagggggaccggaaacatcggcgagacattgggtgaaaaatggaagtctcgcctgaatgccctcggcaaaagcgagtttcaaatttataagaagtccgggatccaggaagtggaccggactctggcaaaagagggaattaagcgaggcgagaccgatcaccatgctgtctcaagagggtctgccaaattaaggtggttcgtggaacgcaacatggttacacctgagggaaaggtggtagaccttggctgcggtagagggggatggagttactattgtggcggtctgaaaaatgtgagagaagtcaagggcctcacgaaagggggacccggccacgaggaacctatcccaatgtcgacctacgggtggaacctagttcgtctgcagagcggagtggatgtctttttcataccccctgagaaatgcgacactttgctgtgtgatattggcgagtcctctccaaatcccacagtggaagcaggtaggaccctccgggtacttaacctggtggagaattggttgaacaataacactcagttctgcatcaaggttctgaatccgtacatgccttcagtgatcgagaaaatggaggctctccaacgcaagtatgggggagccttagtccgaaacccactgagcagaaattccacacatgaaatgtactgggtgagtaacgcctctggcaatattgtcagctcagtgaacatgatatccaggatgcttatcaaccggtttaccatgcgccacaaaaaggcgacgtatgagcccgacgttgacctgggcagtgggaccagaaatattggaatcgagagcgaaattcctaacctagatatcataggtaagaggatcgagaaaattaagcaggaacatgagacatcttggcactacgaccaggatcacccatataaaacttgggcttaccatggctcctatgaaaccaagcagacagggtcagcaagctcgatggtaaatggagtggtccgactcctgactaaaccctgggacgtgttgccgaccgttacacaaatggccatgaccgatactacgcctttcggccagcagcgggtgtttaaggagaaggtcgacacacgtacccaggagcccaaagaaggtactaagaaactgatgaagatcaccgctgagtggctctggaaagaacttgggaagaaaaagacaccaagaatgtgtacgcgcgaggagttcaccaggaaggtgcggtctaacgccgcactgggagccatttttactgatgaaaataaatggaagagtgctagagaggcggtagaagactcccgcttctgggagttagtggataaagaaaggaacctgcacttggagggcaagtgcgagacatgtgtttacaatatgatgggcaaacgagaaaagaagctcggggagtttggaaaagccaagggtagccgggcaatctggtacatgtggctgggcgctagattcctagaatttgaggcccttgggttcctgaacgaagaccattggttttcaagggaaaattccctctctggagtcgagggcgaaggtctgcacaaattggggtatattctgcgcgatgtgagcaagaaagagggaggcgcaatgtacgccgacgacaccgctggctgggatactcgtataacactcgaagaccttaagaacgaggaaatggtgaccaatcacatgaagggggagcataaaaagctggccgaggcgatcttcaaattaacatatcaaaacaaggtcgttcgggtgcagagacctactcccaggggaaccgtaatggatattatcagtcgccgagaccagcggggttccggccaagtggggacgtacggactgaatacctttacaaacatggaagcacagttgatcagacagatggagggcgaaggtgtcttcaaaaatattcagcacctcactgtgaccgaggaggttgccgtgcaaaactggctggctagggtcgggcgcgaaagactaagccggatggccatatctggagatgactgcgtggtaaagccacttgatgacaggttcgcaaacgctctgacagccctcaatgatatgggcaagatccgtaaagacattcagcagtgggagccctcaaagggctggaacgattggactcaggttcctttttgcagtcatcacttccatgaactgatcatgaaagacgggcgagtgttggtcgtgccatgtcgcaatcaagatgagttaattggtagagctcggatctcccagggagccggctggagcctgagggaaaccgcatgcctcgggaagtcttatgcgcagatgtggtcgcttatgtactttcaccgcagagacctgcggctagccgctaacgccatatgttcagcagtgccgagccactgggtccccacgtccaggacaacctggagtatccatgctaaacacgagtggatgactacagaggacatgctgaccgtttggaatcgagtgtggattcgtgaaaacccttggatggaggataagactccagtagaatcttgggaggaaatcccctatctcggaaagagagaggaccagtggtgcggcagcttgattggtctgacctcccgcgccacatgggccaaaaatatccaagccgcgataaaccaggtgcggtcacttattgggaatgaggaatacacggattacatgcctagtatgaagaggttcagacgcgaggaagaggaagctggagtcctgtggtga

SEQ ID NO: 14855 - RNA, 9876 nt, synthetic construct
  misc_feature 1..9876: note = derived and/or modified CDS sequence (opt3) from DENV-2__EU482679__SS-prME
  source 1..9876: mol_type = other RNA
agcgcaggcatgatcattatgctgatacccaccgtgatggctttccacctcactactcggaacggggagcctcatatgatcgtcggtattcaagaaaagggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagcactggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcacataaccagaccttcttgattgacgggccggagactgccgagtgccccaatacaaacagagcatggaatagtctggaagtggaggattatggatttggcgtgttcaccacaaacatctggctcaagctgaaagaaaagcaggacgcgttttgtgactctaagttaatgagcgctgccattaaagataatagggcagtacacgccgacatgggttactggatcgagtccgctctgaacgatacttggaagatagagaaagcctcattcattgaagtcaagaattgccattggcctaaaagccacaccctttggtctaacggggtgttggagtccgaaatgatcatcccaaagaacctcgcaggacccgttagtcaacacaattatcgtcctggctaccatacgcagattgctggtccatggcacctgggcaagctagagatggacttcgatttttgtgacgggacaaccgtgatcgtcactgaagattgcggaaaccggggccccagcctgcgaaccacaactgcctctgggaaactcattaccgagtggtgctgtagatcctgcacactgccgcctcttaggtaccgcggagaggacggctgttggtatggtatggaaatacggccattgaaggagaaagaagagaatctggtgaactcattagttacggcggggcatggacaggtggataatttcagtctcggcgtactgggtatggccctttttctggaagagatgttgagaaccagggtcggcactaagcacgctatcctcctggtggcagtgagcttcgtcacactaattaccgggaacatgtcgtttaaagacctgggacgcgttgtggtaatggtgggcgccactatggctgatgacatcgggatgggagtcacatacctcgccctgcttgcagcgttcaaggtgcgacccacctttgccgctggcttgctgttacggaagctcacgtccaaagagctgatgatgactaccattggtatcgttcttctgtctcaaagcacaatacctgaaaccgtgctagagctcactgatgccctggcattggggatgatggtcctgaagatcgtgcgtaatatggaaaaatatcagttagctgttacaattatggccatcctctgcgtgcccaacgcagtcattctgcagaatgcctggaaggtatcatgtaccatccttgctgtggttagtgtgtccccactgttgctcacatctagccagcagaaaactgactggatacctctggcgctaaccattaagggactgaaccccacggccatcttccttacaaccctctccagaactaataaaaagaggtcatggccactgaacgaggcaatcatggctgtcggcatggtgagcattttggccagttctctgttaaagaatgacataccgatgaccggccctctcgtagccgggggactgcttacagtgtgctacgtcctgactggtcgctccgctgatttggaactcgagcgggcaaccgacgttaaatgggaggatcaggccgaaatcagcggctcgtcacccattctgtctatcacgattagtgaggacgggtccatgagcatcaagaacgaagaggaggaacagacactaaccatactgatcagaactggacttctcgtgatttctggcctgtttccaatcagcattcccatcacagcggctgcctggtatttgtgggaggtgaaaaagcagagggccggtgtcttatgggatgtgccttccccaccccctatggggaaagccgaactggaggacggagcttaccgaataaagcaaaagggcattctcggctattcacagatcggggcaggagtttacaaagaaggtaccttccatactatgtggcacgtaacacgcggcgccgtgctgatgcacaaggggaaacggatcgagccgagttgggcggatgtcaagaaagaccttattagctacggaggcggttggaagctggagggggaatggaaggagggagaagaggtgcaggttttggctctagaaccaggcaaaaatcccagagccgtgcagaccaagcctggcctgtttaaaacgaacactgggaccatcggagcagtctctctcgatttctccccaggtacatcaggcagtcccataattgacaagaaagggaaggtggtaggactgtatggcaacggtgtcgtgaccaggagcggggcctacgtttccgctatcgcccaaacagagaagtctattgaggataatcctgaaatcgaggacgatatatttcgtaaacgccggcttactattatggacttacatccgggagcaggcaagaccaaaagatatctgcccgctatcgtgagggaagccatcaagcgaggcctccggacgttgattctggcgccaacacgcgtcgtggccgcagagatggaagaggctctcagagggctgcctatcaggtaccagactcccgccattcgggctgagcacaccggacgagaaatagttgaccttatgtgtcatgcaacattcaccatgagactgttgtcgccaatccgcgtgcctaactataatctaattatcatggatgaggcccacttcactgaccccgccagcatcgctgcgaggggttacatttcaacccgtgtcgaaatgggcgaggcagccgggatatttatgacagctacgccaccgggatcccgggatcctttcccccagagtaacgccccaatcattgacgaggaaagagagatccccgaaaggtcttggaatagcggccatgagtgggtgactgattttaaaggtaagaccgtatggttcgtgccttccattaaggcagggaacgacatcgccgcttgcctgcgcaaaaatggaaagaaagttatacaactctcacgaaagacatttgattctgaatatgtcaaaaccagaactaacgactgggatttcgtggtgacaaccgacatcagcgagatgggcgcgaattttaaggccgagcgggtcattgatccaaggcgctgtatgaaacccgtaatcttaacggacggcgaagaacgtgtgattctggcagggcctatgccggttactcacagttccgctgcccagagacggggaaggatcggtcgcaacccaaagaatgaaaacgaccagtacatatacatgggcgagccccttgaaaatgatgaggactgcgcacactggaaggaggccaaaatgctgctcgataacattaatacacctgaagggatcattcccagcatgttcgagccagaacgagagaaggtggacgctatcgatggagaatatagattgcggggcgaggccaggaaaacctttgtcgacctgatgcgcagaggtgatctccctgtgtggctggcgtacaaggttgcagccgaggggataaactatgctgacaggcggtggtgtttcgatggcatcaaaaacaatcagattcttgaagagaacgtggaagtcgagatctggaccaaggagggagaacgtaagaaactaaagccccgctggctggacgcccgaatttactctgatccattggctttaaaagagtttaaggagttcgcagccggcagaaaatcactgactctcaatctgatcacagagatggggaggcttcctaccttcatgacacaaaagactcgggacgctctggataacctcgccgtgttgcatacggcagaagcgggaggtcgcgcctataatcacgctctgtccgagctaccggagaccctggaaacactccttctgttaactttgctggccaccgtaacaggcgggatatttctcttcctgatgagtggaagaggcattggtaagatgacccttgggatgtgctgcatcatcactgcaagcattctgctctggtacgctcagatccagccccattggatagccgcatcgattatcttggagtttttcctgattgtgttactaatcccagaacctgagaaacagaggacgccccaagacaaccagctgacctatgttgtcatagccatcctcacagtggtggctgcgactatggccaatgaaatgggctttcttgagaagaccaaaaaggacctgggattgggctctattgcaacacagcagccagagtccaacatcctggatattgacctccggcctgctagcgcctggaccctgtacgccgtcgcaactacattcgttacgcccatgcttcgacactcaatcgaaaatagttctgtgaacgtatccctcaccgctattgccaatcaagcgactgtgctgatggggttgggaaaaggttggccgctgagcaagatggatatcggcgtcccattactagctatagggtgttactcacaggtgaaccctattacactgaccgccgcactccttctgttggttgcccactatgctatcatcggacccggcctgcaggcaaaggccaccagagaggcgcagaaacgcgctgccgcaggtattatgaagaatccaacagtggacgggataactgtcatcgatctcgaccccattccttacgatccgaaatttgaaaagcaactgggccaggtaatgcttttaatcctgtgcgtgacgcaggttctcatgatgaggaccacatgggccttgtgtgaggctctgactctagccaccggacccattagtacactgtgggaaggcaacccagggcggttctggaataccactatcgcagtgagcatggctaacatatttcgtggatcctatctcgccggcgcgggtcttctgttctctatcatgaaaaatacgacaaacaccagaagggggactggaaacatgggcgagaccttgggtgagaagtggaaaagccgcctgaatgccctcggcaagtccgaatttcaaatttacaagaaatcagggatccaggaggtcgaccggacactggcaaaggaaggaattaaacgaggcgagactgatcatcacgctgtgtctagagggagtgccaagttaaggtggttcgtcgagcgcaacatggtgacccctgaaggaaaagttgtggaccttggctgcggtagagggggatggtcgtattactgtggcggtctgaagaatgtaagagaggtgaagggcctcacaaaagggggacccggccatgaggaacctatcccaatgagcacgtatgggtggaacctagtccgtctgcagtccggagttgatgtgtttttcataccccctgaaaagtgcgacaccttgctgtgtgatattggcgagtcttcaccaaatcccactgtcgaggcaggtaggacactccgggtgcttaacctggtagaaaattggttgaacaataacacccagttctgcatcaaagtgctgaatccgtacatgcctagcgttatcgagaagatggaagctctccaacgcaaatacgggggagccttagtgcgaaacccactgtccagaaatagtactcacgagatgtattgggtctctaacgccagcggcaatattgtgtcatccgtcaacatgataagtaggatgcttatcaaccggtttacaatgcgccataagaaggcgacctacgaacccgacgtggacctgggcagcgggacgagaaatattggaatcgagtctgagattcctaacctagatatcataggtaaaaggatcgaaaagattaaacaggagcacgaaacctcctggcactatgaccaggatcatccatacaagacatgggcttatcacggctcatacgagactaaacagaccgggagcgcatcgtctatggttaatggagtagtgcgactcctgacaaagccctgggacgtcttgccgactgtgacccaaatggccatgacagataccactcctttcggccagcagcgggtttttaaggaaaaagtggacacgcgtacacaggagcccaaggagggtaccaaaaagctgatgaaaatcactgctgaatggctctggaaggagcttgggaaaaagaagaccccaagaatgggaacacgcgaagagttcacgaggaaagtccggagtaacgccgcactgggcgccatttttaccgatgagaataagtggaaatccgctagagaagcggtggaggacagccgcttctgggaattagtagataaggagaggaacctgcatttggaaggcaaatgtgagacttgcgtgtataatatgatggggaagcgagagaagaaactcggagaatttggtaaggccaaaggctcacgggcaatctggtacatgtggctgggggctagattcctagagtttgaagcccttggattcctgaacgaggaccactggttttccagggaaaattctctcagcggcgttgagggtgaggggctgcacaagttgggatacattctgcgcgatgtcagtaaaaaggaaggcggcgcaatgtatgccgacgacacagctgggtgggatacccgtataactctcgaggaccttaagaacgaagagatggtgacaaatcatatggaaggagagcacaaaaagctggccgaggcgatcttcaaattaacctaccaaaacaaggtggtccgggttcagagacctacacccaggggtactgtgatggatattatctcccgccgagaccagcggggcagcgggcaagtaggaacctatggcctgaatacgtttaccaacatggaagcacagttgatcagacagatggagggtgaaggggtgttcaaaaatattcagcatctcacagtcactgaggaggtggccgttcaaaactggctggctagggtgggacgcgaaagactatctcggatggccatatcaggcgatgactgtgtcgtgaagccacttgatgacaggttcgcaaacgctctgaccgccctcaatgatatgggcaagatccgtaaagacattcagcagtgggagcccagtaaggggtggaacgattggacacaggtacctttttgctcccaccatttccacgaactgatcatgaaagacggacgagttttggtggtcccatgccgcaatcaagatgagttaattggtagagctcggatcagccagggcgccgggtggtctctgagggaaactgcatgtctcggaaagtcgtacgcgcagatgtggtcacttatgtattttcaccgcagagacctgcggctagccgctaacgccatatgcagcgcagtgccgtcccattgggtgcccaccagtaggacgacatggtctatccacgctaaacatgagtggatgaccactgaggacatgctgacagtctggaatcgagtttggattcgtgaaaacccttggatggaggataagaccccagtggaaagctgggaggaaatcccctacctcggcaagagagaggaccagtggtgtggttccttgattgggctgacttcacgcgccacctgggccaaaaatatccaagccgcgataaaccaggtacggagtcttattggaaatgaggaatatacagattacatgccttctatgaagaggttcagacgcgaggaagaggaagctggcgtgctgtggtga

SEQ ID NO: 14856 - RNA, 9876 nt, synthetic construct
  misc_feature 1..9876: note = derived and/or modified CDS sequence (opt3) from DENV-2__EU482774__SS-prME
  source 1..9876: mol_type = other RNA
agcgcaggaatgatcattatgctgatccccaccgtgatggctttccacctcactactagaaacggggaacctcatatgatcgtcggtattcaagaaaagggaaagtcccttctgtttaagacggaggacggcgttaatatgtgcaccttgatggcaatggatttaggggaactgtgtgaggacacaatcacttacaaatgcccacttctcaggcaaaacgaaccggaggatattgactgttggtgcaattctacctcaacatgggtgacctatggaacttgtacaaccacgggcgagcaccggcgcgaaaagcgaagtgtagcactggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatcttcattggcgttatcataacatggatcgggatgaactctcgcagcacttcacttagtgtgtccttggtcctggtgggaattgtaaccctctacctgggcgtgatggttcaggcagatagcggttgtgtcgtgtcttggaagaataaggagcttaaatgcgggtcaggaatctttattacggacaacgtgcacacatggaccgaacagtataagttccaacccgagagtccaagcaaactggcctccgctatccagaaggcccaggaagagggcatatgtggtattagatctgtcactaggttggagaatctcatgtggaaacagatcacacccgaactgaaccacattttagcagagaatgaagttaagctgaccatcatgactggcgatataaaagggatcatgcaagccggaaagcggtcgctacgccctcagccaaccgagctcaagtacagctggaaaacatggggcaaggctaaaatgctgtccacggaatcacataaccagacctttcttattgacgggccggagactgccgagtgccccaatacaaacagagcatggaatagtttggaagtggaggattatggattcggcgtgtttaccacaaacatctggctgaagctcaaagaaaagcaggacgcgttctgtgactctaagctgatgagcgctgccattaaagataatagggcagtacacgccgacatgggttactggatcgagtccgctttaaacgatacttggaagatagagaaagcctcattcattgaagtcaagaattgccattggcctaaaagccacaccctgtggtctaacggggtgcttgagtccgaaatgatcatcccaaagaacttggcaggacccgttagtcaacacaattatcgtcctggctaccatacgcagattgctggtccatggcacctcggcaagctggagatggactttgatttctgtgacgggacaaccgtgatcgtcactgaagattgcggaaaccggggccccagcctacgaaccacaactgcctctgggaaactgattaccgagtggtgctgtagatcctgcacactcccgcctctgaggtaccgcggagaggacggctgttggtatggtatggaaatacggccacttaaggagaaagaagagaatttggtgaactcactggttacggcggggcatggacaggtggataattttagtttaggcgtactcggtatggccctgttccttgaagagatgctgagaaccagggtcggcactaagcacgctatcttgctcgtggcagtgagctttgtcacactgattaccgggaacatgtcgttcaaagacctaggacgcgttgtggtaatggtgggcgccactatggctgatgacatcgggatgggagtcacatacctggccctcctggcagcgtttaaggtgcgacccaccttcgccgctggccttttgctgcggaagttaacgtccaaagagctcatgatgactaccattggtatcgttctgctttctcaaagcacaatacctgaaaccgtgctggagctaactgatgccctcgcactggggatgatggtcttgaagatcgtgcgtaatatggaaaaatatcagctggctgttacaattatggccatcttatgcgtgcccaacgcagtcgtactccagaatgcctggaaggtgtcatgtaccattctggctgttgtgagtgtctccccacttctgttgacatctagccagcagaagactgactggatccctctcgcgctgaccataaagggactaaaccccacggccatttttctgacaaccctttccagaactaataaaaagaggtcatggccactcaacgaggcaatcatggctgtgggcatggtaagcatcctggccagttctttgctgaagaatgacattccgatgaccggccctttagtggccgggggactcctgacagtctgctacgttcttactggtcgctccgctgatctggaattggagcgggcaaccgacgtgaaatgggaggatcaggccgaaataagcggctcgtcacccatcctctctattacgatcagtgaggacgggtccatgagcattaagaacgaagaggaggaacagacactgaccatcctaataagaactggactgcttgtgatctctggcctcttcccaattagcatccccattacagcggctgcctggtatctgtgggaggtcaaaaagcagagggccggtgtgttgtgggatgttccttccccaccccctatggggaaagccgaattagaggacggagcttaccgaatcaagcaaaagggcatactgggctattcacagattggggcaggagtatacaaagaaggtacctttcatactatgtggcacgtgacacgcggcgccgtcctcatgcacaaggggaaacggatcgagccgagttgggcggatgtgaagaaagacctgatcagctacggaggcggttggaaacttgagggggaatggaaggagggagaagaggttcaggtgctggctttggaaccaggcaaaaatcccagagccgtccagaccaagcctggcctattcaaaacgaacactgggaccattggagcagtgtctctggatttttccccaggtacatcaggcagtcccatcatagacaagaaagggaaggtagtcggactctatggcaacggtgtggttaccaggagcggggcctacgtgtccgctattgcccaaacagagaagtctatcgaggataatcctgaaattgaggacgatatcttccgtaaacgccggctgactataatggaccttcatccgggagcaggcaagaccaaaagatatttacccgctattgtcagggaagccatcaagcgaggcctgcggacgctcatcttggcgccaacacgcgtggttgccgcagagatggaagaggctctgagagggctccctattaggtaccagactcccgccatcaaagctgagcacaccggacgggaaattgtggacctgatgtgtcatgcaacattcaccatgcgacttctgtcgccagtcagagtgcctaactataatttgataatcatggatgaggcccactttactgaccccgccagcattgctgcgcgcggttacatctcaaccagggtagaaatgggcgaggcagccgggatcttcatgacagctacgccaccgggatcccgtgatccttttccccagagtaacgccccaattatagacgaggaacgggagatccccgaaagatcttggaatagcggccatgagtgggtgactgatttcaagggtaagaccgtttggtttgtcccttccattaaagcagggaacgacatcgccgcttgcctaaggaagaatggcaagaaggtgattcaactgtcacgcaaaacattcgattctgaatatgtgaagacccgaactaacgactgggattttgtcgtaacaaccgacatcagcgagatgggcgcgaatttcaaagccgagagagtgatagatccacggaggtgtatgaagcccgttatcctcacggacggcgaagaacgcgtgattttagcagggcctatgccggtcactcacagttccgctgcccagcgtagaggacggatcggtaggaacccaaagaatgaaaacgaccagtacatttacatgggcgagcccctggaaaatgatgaggactgcgcacactggaaagaggccaagatgcttctggataacatcaatacacctgaagggataattcccagcatgtttgagccagaacgcgagaaagtggacgctatcgatggagaatatcgactcagaggcgaggcccggaagaccttcgttgacttgatgaggcgcggtgatctgcctgtgtggctcgcgtacaaagtcgcagccgaggggattaactatgctgacagaaggtggtgttttgatggcatcaagaacaatcagatactggaagagaacgtggaagtagagatctggaccaaggagggagaacggaagaaacttaaaccccgttggctagacgcccgcatttactctgatccactggctttgaaagagttcaaagagttcgcagccggccgaaagtcattaactctgaatctcatcacagagatggggagactgcctacctttatgacacaaaagactagggacgctcttgataacctggccgtgctccatacggcagaagcgggaggtcgggcctataatcacgctttgtccgagctgccggagaccctagaaacactgctccttctgactttattggccaccgttacaggcgggattttcctgtttctcatgagtggacgcggcatcggtaaaatgaccctggggatgtgctgcataattactgcaagcatccttctgtggtacgctcagatccagccccattggattgccgcatcgatcatactcgagttctttttgattgtcctgttaatcccagaacctgagaagcagagaacgccccaagacaaccagctaacctatgtggtgattgccatcctgacagtcgttgctgcgactatggccaatgaaatgggcttcctcgagaaaaccaagaaagaccttggactgggctctatagcaacacagcagccagagtccaacatcttggatattgacctgaggcctgctagcgcctggaccctctacgccgtggcaactacatttgtaacgcccatgctgcggcactcaatcgaaaatagttctgtgaacgtctcccttaccgctattgccaatcaagcgactgtgctcatggggctgggaaagggttggccgttgagcaagatggatatcggcgttccactgttagctattgggtgttactcacaggtgaaccctatcacactaaccgccgcactgctccttctggtcgcccactatgctataattggacccggcttgcaggcaaaagccacccgagaggcgcagaagagagctgccgcaggtatcatgaaaaatccaacagtagacgggatcactgtgattgatctggaccccataccttacgatccgaagttcgaaaaacaactcggccaggttatgctgcttatcttatgcgtgacgcaggtcctgatgatgcgcaccacatgggccctctgtgaggctttgactctggccaccggacccattagtacactatgggaaggcaacccagggaggttttggaataccactatcgcagtgagcatggctaacattttccggggatcctatctggccggcgcgggtctcctattttctatcatgaagaatacgacaaacacccgtagagggactggaaacataggcgagaccctgggtgagaaatggaaaagcaggttgaatgccctgggcaagtccgagttccaaatctacaaaaagtcagggattcaggaggtcgaccgcacactcgcaaaagaaggaatcaagcggggcgagactgatcatcacgctgtgtctcgagggagtgccaaactgagatggtttgttgagaggaacatggtgacccctgaaggaaaggtagtggacttaggctgcggtcgcgggggatggtcgtattactgtggcggtcttaagaatgtccgggaggttaaaggcctgacaaaagggggacccggccatgaagaacctattccaatgagcacgtatgggtggaacctcgtgagactacagtccggagtcgatgtgttcttcataccccctgaaaaatgcgacaccctgttgtgtgatataggcgagtcttcaccaaatcccactgtagaggcaggtcgtacactgagggtgctcaaccttgttgaaaattggctgaacaataacacccagttttgcattaaggtgttgaatccgtacatgcctagcgtcatcgagaaaatggaagctctgcaacggaagtacgggggagccctcgtgcgcaacccattatcccgaaatagtactcacgagatgtattgggtctctaacgccagcggcaatatcgtgtcatccgttaacatgattagtagaatgctgataaacaggttcacaatgcggcataagaaagcgacctacgaacccgacgtagaccttggcagcgggacgcgcaatatcggaattgagtctgagatccctaacctggatattatcggtaagagaatagagaagatcaagcaggagcacgaaacctcctggcactatgaccaggatcatccatacaaaacatgggcttatcacggctcatacgagactaagcagaccgggagcgcatcgtctatggtgaatggagtcgtgaggctactcacaaagccctgggacgttctgccgactgtgacccaaatggccatgacagataccactccttttggccagcagcgagtcttcaaagaaaaggtggacacgcggacacaggagcccaaagagggtaccaagaaattgatgaagattactgctaaatggctgtggaaggaactcgggaagaaaaagaccccacgtatgtgtacaagagaggaatttacgcgcaaagtaaggagtaacgccgcacttggagccatcttcaccgatgagaataagtggaaatccgctcgggaggcggtggaagacagcagattttgggagctggttgataaggaacgcaacttacatctggagggcaagtgcgaaacttgtgtctataatatgatgggcaaaagggagaagaaattgggggagttcggaaaggccaaaggttcacgagcaatttggtacatgtggctcggcgctcggtttctggagttcgaggccctagggtttcttaacgaagaccactggttctccagagaaaattctctgagcggagtggaaggcgagggtctccacaagctggggtacatcttgagggatgtgagtaagaaagagggaggcgcaatgtatgccgacgacacagctggctgggatacccgcattactctggaagacctcaagaacgaggaaatggtcacaaatcatatggagggggaacacaagaaacttgccgaggcgatatttaaactgacctaccaaaacaaagttgtgcgtgtacagcggcctacacccagaggaactgtgatggatatcatttccaggcgcgaccagcgaggtagcggccaagtcgggacctatggattaaatacgttcaccaacatggaggcacagctgatccggcagatggaaggcgagggtgtgttcaagaatatccagcatttgacagttactgaagaggtggccgtccaaaactggctcgctagagtggggagggagcgcctgtctagaatggccatttcaggagatgactgcgtagttaaaccactagatgaccggtttgcaaacgctcttaccgccctgaatgatatgggcaagataaggaaagacatccagcagtgggaacccagtaagggctggaacgattggacacaggtgcctttctgctcccaccattttcacgagctcattatgaaagacgggcgtgtcctggtggtgccatgtcgaaatcaagatgaattgatcggacgcgctagaattagccagggtgccggctggtctttacgggagactgcatgcctggggaagtcgtacgcgcagatgtggtcactcatgtatttccacaggcgcgaccttagactggccgctaacgccatctgtagcgcagtcccgtcccattgggttcccaccagtcggacgacatggtctatacacgctaagcatgaatggatgaccactgaggacatgctaacagtgtggaatagggtatggatccgagagaacccttggatggaagataaaaccccagtggagagctgggaagagattccctacctgggaaagcgtgaagaccagtggtgcggctccctcatcggtttgacttcaagagccacctgggccaagaatattcaagccgcgatcaaccaggtccgcagtctgatagggaatgaggagtatacagattacatgccttctatgaagcggtttaggagagaagaggaagaggctggagtgctttggtga

SEQ ID NO: 14857 - RNA, 9876 nt, synthetic construct
  misc_feature 1..9876: note = derived and/or modified CDS sequence (opt3) from DENV-2__EU482775__SS-prME
  source 1..9876: mol_type = other RNA
agcgcaggaatgataattatgctgataccaaccgtgatggctttccacctcactactagaaacggggagcctcatatgatcgtcggcattcaggaaaagggtaaatcccttctgtttaagacggaggacggcgttaatatgtgcaccttgatggcaatggatttaggggaactgtgtgaggacacgatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagcgatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatatacgggggatcatgcaagccggaaaacgctcgctcagacctcagccaaccgagctgaagtacagctggaagacatggggcaaagctaagatgctttccacggaatcatataaccagaccttcttgattgacgggccggagactgccgagtgccccaatacaaacagggcatggaatagtctggaagtggaggattacggatttggcgtgttcaccacaaacatctggctcaaactgaaggaaaaacaggacgcgttttgtgactctaagttaatgagcgctgccattaaggataatcgtgcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatccccaagaacctcgcaggacccgttagtcaacacaattaccggcctggctaccacacgcagattgctggtccatggcatctgggcaagctagagatggacttcgatttttgtgacgggacaaccgtgatcgtcactgaagattgcggaaaccgaggccccagcctgagaaccacaactgcctctgggaagctcattaccgagtggtgctgtaggtcctgcacactgccgcctcttcgctatcggggagaggacggctgttggtacggtatggaaataagaccattgaaagagaaggaagagaatctggtgaactcattagttacggcggggcacggacaggtggataatttcagtctcggcgtactgggtatggccctttttctggaagagatgttgaggacccgcgtcggcactaaacatgctatcctcctggtggcagtgagcttcgtcacactaattaccgggaacatgtcgtttaaggacctgggacgagttgtggtaatggtgggcgccactatggctgatgacatcgggatgggagtcacatatctcgccctgcttgcagcgttcaaagtgcggcccacctttgccgctggcttgctgttacgtaagctcacgtccaaggagctgatgatgactaccattggtatcgttcttctgtctcaaagcacaatacctgaaaccgtgctagagctcactgatgccctggcattggggatgatggtcctgaaaatcgtgagaaatatggaaaagtaccagttagctgttacaattatggccatcctctgcgtgcccaacgcagtcattctgcagaatgcctggaaagtatcatgtaccatccttgctgtggttagtgtgtccccactgttgctcacatctagccagcaaaagactgactggatacctctggcgctaaccattaaaggactgaaccccacggccatcttccttacaaccctctccaggactaataagaaacgctcatggccactgaacgaggcaatcatggctgtcggcatggtgagcattttggccagttctctgttaaagaatgacataccgatgaccggccctctcgtagccgggggactgcttacagtgtgctatgtcctgactggtcggtccgctgatttggaactcgagagagcaaccgacgttaagtgggaggatcaggccgaaatcagcggctcgtcacccattctgtctatcacgattagtgaggacgggtccatgagcatcaaaaacgaagaggaggaacagacactaaccatactgatcaggactggacttctcgtgatttctggcctgtttccaatcagcattcccatcacagcggctgcctggtacttgtgggaggtgaagaaacagcgagccggtgtcttatgggatgtgccttccccaccccctatggggaaggccgaactggaggacggagcttatcgcataaaacaaaagggcattctcggctactcacagatcggggcaggagtttacaaggaaggtaccttccacactatgtggcatgtaacacggggcgccgtgctgatgcacaaagggaagagaatcgagccgagttgggcggatgtcaggaaagaccttattagctatggaggcggttggaagctggagggggaatggaaagagggagaagaggtgcaggttttggctctagaaccaggcaagaatccccgtgccgtgcagaccaagcctggcctgtttaaaacgaacactgggaccatcggagcagtctctctcgatttctccccaggtacatcaggcagtcccataattgacaagaaagggaaggtggtaggactgtacggcaacggtgtcgtgacccgcagcggggcctatgtttccgctatcgcccaaacagagaaatctattgaggataatcctgaaatcgaggacgatatatttcggaagagaaggcttactattatggacttacacccgggagcaggcaagaccaaacgatacctgcccgctatcgtgcgggaagccatcaagcgcggcctcagaacgttgattctggcgccaacaagggtcgtggccgcagagatggaagaggctctccgggggctgcctatccgatatcagactcccgccattagagctgagcataccggacgcgaaatagttgaccttatgtgtcacgcaacattcaccatgaggctgttgtcgccagtgcgtgtccctaactacaatctaatcattatggatgaggcccatttcactgaccccgccagcatcgctgcgcggggttatatctcaaccagagtggaaatgggcgaggcagccgggatttttatgacagctacgccaccgggatccagggatcctttcccccagagtaacgccccaataatcgacgaggaacgcgagattcccgaacgatcttggaatagcggccacgagtgggtaactgattttaaaggtaagaccgtgtggttcgttccttccatcaaagcagggaacgacattgccgcttgcctgagaaagaatggaaagaaagtcatccaactctcacggaagacatttgattctgaatacgtgaaaaccaggactaacgactgggatttcgtggtcacaaccgacataagcgagatgggcgcgaattttaaggccgagcgcgtaatcgatccacgtagatgtatgaaacccgtgattttaacggacggcgaagaacgggttatcctggcagggcctatgccggtgactcatagttccgctgcccagaggcgcggacgaattggtagaaacccaaagaatgaaaacgaccagtacatctatatgggcgagccccttgaaaatgatgaggactgcgcacactggaaagaggccaagatgctgctcgataacataaatacacctgaagggattatccccagcatgttcgagccagaacgggagaaggtcgacgctattgatggagaatacaggttgcgcggcgaggccagaaaaacctttgtggacctgatgaggcggggtgatctccctgtttggctggcgtataaggtggcagccgaggggatcaactacgctgaccgtcgctggtgtttcgatggcatcaaaaacaatcagatccttgaagagaacgtcgaagtggagatttggaccaaggagggagaaaggaaaaagctaaagcccagatggctggacgccagaatctattctgatccattggctttaaaagagtttaaggagttcgcagccggccggaaatcactgactctcaatctgattacagagatggggcgccttcctaccttcatgacacaaaagactagagacgctctggataacctcgccgtattgcacacggcagaagcgggaggtagggcctacaatcatgctctgtccgagctaccggagaccctggaaacactccttctgttaactttgctggccaccgtgacaggcgggatctttctcttcctgatgagtggacggggcataggtaaaatgacccttgggatgtgctgcattatcactgcaagcatcctgctctggtatgctcagattcagccccactggatcgccgcatcgataattttggagtttttcctgatcgttttactaattccagaacctgagaagcagcgaacgccccaagacaaccagctgacctacgtcgtgatcgccatactcacagtggtcgctgcgactatggccaatgaaatgggctttcttgagaagaccaaaaaggacctgggattgggctctatcgcaacacagcagccagagtccaacattctggatatcgacctcagacctgctagcgcctggaccctgtacgccgttgcaactacattcgtgacgcccatgcttcgccattcaattgaaaatagttctgtaaacgtgtccctcaccgctatcgccaatcaagcgactgtcctgatggggttgggaaaaggttggccgctgagcaagatggatattggcgtgccattactagctatcgggtgttattcacaggttaaccctataacactgaccgccgcactccttctgttggtggcccactacgctattatcggacccggcctgcaggcaaaagccaccagggaggcgcagaagcgggctgccgcaggtatcatgaagaatccaacagtcgacgggattactgtaatagatctcgaccccatcccttatgatccgaaatttgaaaagcaactgggccaggtgatgcttttaattctgtgcgttacacaggtgctcatgatgcgtaccacatgggccttgtgtgaggctctgactctagccaccggacccatcagtacactgtgggaaggcaacccagggagattctggaataccactattgcagtcagcatggctaacatctttaggggatcctacctcgccggcgcgggtcttctgttctctataatgaaaaatacgacaaacacccgccgggggactggaaacatcggcgagaccttgggtgagaagtggaaaagccgactgaatgccctcggcaagtccgaatttcaaatttataaaaagtcagggatccaggaggtggacagaacactggcaaaggaaggaattaaaaggggcgagactgatcaccatgctgtctctcgcgggagtgccaagttacggtggttcgtggagagaaacatggttacccctgaaggaaaagtggtagaccttggctgcggtcgtgggggatggtcgtactattgtggcggtctgaagaatgtgagggaggtcaaaggcctcacaaaagggggacccggccacgaggaacctatcccaatgagcacgtacgggtggaacctagttcggctgcagtccggagtggatgtctttttcataccccctgaaaagtgcgacaccttgctgtgtgatattggcgagtcttcaccaaatcccactgtggaggcaggtcgcacactccgagtacttaacctggtggaaaattggttgaacaataacacccagttctgcatcaaagttctgaatccgtacatgcctagcgtgatcgagaagatggaagctctccaaagaaaatatgggggagccttagtcaggaacccactgtcccggaatagtactcatgagatgtactgggtgtctaacgccagcggcaatattgtctcatccgtgaacatgataagtcgcatgcttatcaacagatttacaatgaggcacaagaaagcgacctatgaacccgacgttgacctgggcagcgggacgcgaaatattggaatcgagtctgagattcctaacctagatatcataggtaagcggatcgaaaagattaaacaggagcatgaaacctcctggcactacgaccaggatcacccatataagacatgggcttaccatggctcatatgagactaaacagaccgggagcgcatcgtctatggtaaatggagtggtccgtctcctgacaaagccctgggacgtgttgccgactgttacccaaatggccatgacagataccactcctttcggccagcagagagtgtttaaagaaaaggtcgacacgcgcacacaggagcccaaggagggtaccaaaaagctgatgaaaatcactgctgaatggctctggaaggagcttgggaaaaagaaaaccccaaggatgtgtacacgggaagagttcacgagaaaggtgcgcagtaacgccgcactgggagccatttttaccgatgagaataagtggaaatccgctagggaagcggtagaggacagccgattctgggaattagtggataaggagcggaacctgcacttggaaggcaaatgcgagacttgtgtttacaatatgatgggcaagagagagaaaaagctcggggaatttggaaaggccaaaggttcaagggcaatctggtacatgtggctgggcgctcgcttcctagagtttgaagcccttgggttcctgaacgaggaccattggttttcccgtgaaaattctctcagcggagtcgagggcgagggtctgcacaagttggggtatattctgcgggatgtgagtaaaaaggaaggaggcgcaatgtacgccgacgacacagctggctgggataccagaataactctcgaggaccttaaaaacgaagagatggtgacaaatcacatggaaggggagcataagaagctggccgaggcgatcttcaaattaacctatcaaaacaaggtcgttagggtgcagcgccctacaccccgaggaactgtaatggatattatctcccggagagaccagaggggtagcggccaagtggggacctacggactgaatacgtttaccaacatggaagcacagttgatccgccagatggagggcgaaggtgtcttcaaaaatattcagcacctcacagtgactgaggaggttgccgtgcataactggctggctagagtcgggcgggaaaggctatctcgtatggccatatcaggagatgactgcgtggtaaagccacttgatgaccgattcgcaaacgctctgaccgccctcaatgatatgggcaaaatccgcaaggacattcaacagtgggagcccagtaagggctggaacgattggacacaggttcctttttgctcccaccatttccacgaactgatcatgaaagacgggagagtgttggtcgtgccatgtcggaatcaggatgagttaattggaagggctcgcatcagccaaggtgccggctggtctctgagagaaactgcatgcctcgggaagtcgtatgcgcagatgtggtcacttatgtactttcaccggagggacctgcgactagccgctaacgccatatgtagcgcagtgccgtcccattgggtccccaccagtcgtacgacatggtctatccacgctaaacatgagtggatgaccactgaggacatgctgacagtttggaatagagtgtggattcgcgaaaacccttggatggaggataagaccccagtagaaagctgggaggaaatcccctatctcggaaaacgggaggaccagtggtgcggctccttgattggtctgacttcaagggccacctgggcaaagaatatccaggccgcgataaaccaagtgagaagtcttattgggaatgaggaatacacagattacatgccttctatgaagcgcttccggagggaggaagaggaagctggagtcctgtggtga

SEQ ID NO: 14858 - RNA, 9876 nt, synthetic construct
  misc_feature 1..9876: note = derived and/or modified CDS sequence (opt3) from DENV-2__EU482776__SS-prME
  source 1..9876: mol_type = other RNA
agcgccggaatgatcattatgctgataccaaccgtgatggctttccacctcactactagaaacggggaacctcatatgatcgtcggtattcaagaaaagggaaaatcccttctgtttaagacggaagacggagttaatatgtgcaccttgatggcaatggatttaggggaactgtgtgaggacactatcacttacaaatgcccactactcaggcaaaacgaaccggaggatattgactgttggtgcaattctacctcaacatgggtgacctatggaacttgtacgaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatatacgggggatcatgcaagccggaaaacgctcgctcagacctcagccaaccgagctgaagtacagctggaagacatggggcaaagctaagatgctttccacggaatcatataaccagaccttcttgattgacgggccggagactgccgagtgccccaatacaaacagggcatggaatagtctggaagtggaggattacggatttggcgtgttcaccacaaacatctggctcaaactgaaggaaaaacaggacgcgttttgtgactctaagttaatgagcgctgccattaaggataatcgtgcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatccccaagaacctcgcaggacccgttagtcaacacaattaccggcctggctaccacacgcagattgctggtccatggcatctgggcaagctagagatggacttcgatttttgtgacgggacaaccgtgatcgtcactgaagattgcggaaaccgaggccccagcctgagaaccacaactgcctctgggaagctcattaccgagtggtgctgtaggtcctgcacactgccgcctcttcgctatcggggagaggacggctgttggtacggtatggaaataagaccattgaaagagaaggaagagaatctggtgaactcattagttacggcggggcacggacaggtggataatttcagtctcggcgtactgggtatggccctttttctggaagagatgttgaggacccgcgtcggcactaaacatgctatcctcctggtggcagtgagcttcgtcacactaattaccgggaacatgtcgtttaaggacctgggacgagttgtggtaatggtgggcgccactatggctgatgacatcgggatgggagtcacatatctcgccctgcttgcagcgtacaaagtgcggcccaccttcgccgctggcttgctgttacgtaagctcacgtccaaggagctgatgatgactaccattggtatcgttcttctgtctcaaagcacaatacctgaaaccgtgctagagctcactgatgccctggcattggggatgatggtcctgaaaatcgtgagaaatatggaaaagtatcagttagctgttacaattatggccatcctctgcgtgcccaacgcagtcattctgcagaatgcctggaaggcttcatgtaccatccttgcggtagtgagtgtttccccactgttgctcacatctagccagcaaaagactgactggatacctctggccctaaccattaaaggactgaaccccacggcaatctttcttacaaccctctccaggactaataagaaacgctcatggccactgaacgaggctatcatggccgtgggcatggtcagcattttggccagttctctgttaaagaatgacataccgatgaccggccctctcgtggctgggggactgcttacagtatgctacgtgctgactggtcggtccgcagatttggaactcgagagagccaccgacgtcaagtgggaggatcaggcggaaatcagcggctcgtcacccattctgtctatcacgattagtgaggacgggtccatgagcatcaaaaacgaagaggaggaacagacactaaccatactgatcaggactggacttctcgttatttctggcctgttcccaatcagcattcccatcacagctgccgcatggtatttgtgggaggtgaagaaacagcgagccggtgtgttatgggatgtcccttccccaccccctatggggaaggctgaactggaggacggagcataccgcataaaacaaaagggcattctcggctactcacagatcggggccggagtgtataaggaaggtacctttcacactatgtggcatgttacacggggcgcggtactgatgcacaaagggaagagaatcgagccgagttgggctgatgtgaaaaaggaccttattagctacggaggcggttggaaactggagggggaatggaaggagggagaagaggtccaggtgttggccctagaaccaggcaagaatcccagggcagttcagaccaaacctggcctgttcaagacgaacactgggaccatcggagccgtgtctctcgatttttccccaggtacatcaggcagtcccataattgacaaaaaggggaaagtcgtgggactgtatggcaacggtgtagtcacccgtagcggggcttacgtgtccgccatcgcacaaacagagaagtctattgaggataatcctgaaatcgaggacgatatattccgcaagcggagacttactattatggacttacacccgggagctggcaaaaccaagaggtatctgcccgccatcgttcgagaagcgatcaaacggggcctccgcacgttgattctggccccaacaagagtggtcgcagctgagatggaagaggccctcagggggctgcctatccggtaccagactcccgctattcgagcagagcataccggaagagaaatagtggaccttatgtgtcacgccacatttaccatgcgcctgttgtcgccagttagggtgcctaactataatctaatcattatggatgaggcccatttcactgaccccgctagcatcgcggcacgtggttacatctcaacccgggtcgaaatgggcgaggccgctgggattttcatgacagccacgccaccgggatccagagatccttttccccagagtaacgcaccaataatcgacgaggaaagggagattcccgaacgctcttggaatagcggccacgagtgggtgactgatttcaagggtaaaaccgtatggtttgtgccttccatcaaggccgggaacgacattgctgcgtgcctgcgaaagaatggcaagaaagttatccaactctcaagaaaaacattcgattctgaatacgtcaagacccggactaacgactgggattttgtggtgacaaccgacataagcgagatgggcgccaatttcaaagcagagagggtcatcgatccacgccgttgtatgaagcccgtaattttaacggacggcgaagagagagtgatcctggctgggcctatgccggttactcatagttccgccgcacagcggaggggacgcattggtcgaaaccccaaaaatgaaaacgaccagtatatctacatgggcgagccccttgaaaatgatgaggactgcgcccactggaaggaggctaagatgctgctcgataacataaatacacctgaagggattatccccagcatgtttgagccagaaagagagaaagtggacgccattgatggagaatatcggttgaggggcgaggcgcgcaagaccttcgtcgacctgatgagaaggggtgatctccctgtgtggctggcatacaaagttgccgctgaggggatcaactatgccgaccggcgttggtgttttgatggcataaagaacaatcagatccttgaagagaacatggaagtggagatttggaccaaagagggagaacgcaagaagctaaaaccccgatggctggacgctagaatctactctgatccattggcattaaaggagttcaaagaatttgccgctggcaggaagtcactgactctcaatctgattacagagatggggcggcttcctaccttcatgacacagaaaactcgcgacgccctggataacctcgcagtcttgcacacggcggaagccggaggtagagcttataatcatgccctgtccgagctaccggagaccctggaaacactccttctgttaactttgctggcaaccgtgacaggcgggatcttcctctttctgatgagtggaaggggcataggtaagatgacccttgggatgtgctgcattatcactgctagcatcctgctctggtacgcccagattcagccccactggatcgcagcctcgataattttggagttctttctgatcgtattactaattccagaacctgagaagcagcggacgccccaagacaaccagctgacctacgtggttatcgctatactcacagtcgtggcggccactatggcaaatgaaatgggcttccttgagaaaaccaagaaagacctgggattgggctctatcgctacacagcagccagagtccaacattctggatatcgacctccgacctgccagcgcctggaccctgtatgcagtggctactacatttgtcacgcccatgcttagacattcaattgaaaatagttctgttaacgtgtccctcaccgccatcgcgaatcaagctactgtactgatggggttgggaaagggttggccgctgagcaaaatggatattggcgtgccattactagccatcgggtgttactcacaggtcaaccctataacactgaccgcagccctccttctgttggtggctcactatgcaattatcggacccggcctgcaggccaaggcgacccgcgaggctcagaagagggccgcagccggtatcatgaaaaatccaacagttgacgggattactgtgatagatctcgaccccatcccttacgatccgaagttcgaaaaacaactgggccaggtcatgcttttaattctgtgcgtaacacaggtgctcatgatgcggaccacatgggctttgtgtgaggccctgactctagcaaccggacccatcagtacactgtgggaaggcaacccagggcgtttttggaataccactattgctgttagcatggccaacatcttcagaggatcctatctcgcgggcgccggtcttctgttttctataatgaagaatacgacaaacaccaggcgcgggactggaaacatcggcgagaccttgggtgagaaatggaaaagccggctgaatgcactcggcaaatccgagttccaaatttacaagaagtcagggatccaggaggtggaccgaacactggctaaagaaggaattaagagaggcgagactgatcaccatgccgtctctagggggagtgcaaaattacgctggtttgtggagcggaacatggtcacccctgaaggaaaggtggttgaccttggctgcggtagagggggatggtcgtattactgtggcggtctgaaaaatgtgcgtgaggtaaagggcctcacaaaagggggacccggccacgaagaacctatcccaatgagcacgtacgggtggaacctagtgaggctgcagtccggagtcgatgttttctttataccccctgaaaaatgcgacaccttgctgtgtgatattggcgagtcttcaccaaatcccactgtggaggctggtcggacactccgcatccttaacctggtcgaaaattggttgaacaataacacccagttctgcatcaaggtgctgaatccgtatatgcctagcgtaattgagaaaatggaagccctccaacgaaagtacgggggagccttagtgagaaacccactgtccaggaatagtactcatgagatgtattgggtttctaacgcgagcggcaatatagtgtcatccgtcaacatgatcagtcggatgcttattaaccgcttcacaatgagacacaaaaaggctacctacgaacccgacgtggacctgggcagcgggacgaggaatatcggaattgagtctgagatccctaacctagatataatcggtaagcgaattgagaaaatcaagcaggagcatgaagcatcctggcactatgaccaggatcacccatacaaaacctgggcctatcatggctcatacgagacaaagcagactgggagcgcttcgtctatggtcaatggagtggttcggctcctgaccaaaccctgggacgtattgccgacagtgactcaaatggccatgaccgatacaaccccttttggccagcagcgtgtcttcaaggaaaaggtggacactagaacgcaggagcccaaagagggtacaaagaaactgatgaagattaccgcagaatggctctggaaagagcttgggaagaaaaagactccacgcatgtgtaccagggaagagtttacacggaaggttagaagtaacgccgctctgggagcgatcttcacggatgagaataaatggaagtccgcccgcgaagcagtggaggacagcaggttttgggaattagtcgataaagagcgaaacctgcacttggaaggcaagtgcgagacctgtgtgtacaatatgatgggcaaacgggagaagaagctcggggagttcggaaaagctaagggttcaagagccatttggtatatgtggctgggcgcaaggtttctagagttcgaagcccttgggtttctgaacgaggaccattggttctcccgcgaaaattctctcagcggagtagagggcgagggtctgcacaaattggggtacatactgcgtgatgtgagtaagaaagaaggaggcgctatgtatgccgacgacactgcgggctgggatacacggatcaccctcgaggaccttaagaacgaagagatggttactaatcacatggaaggggagcataagaaactggcagaggccatttttaagttaacataccaaaacaaagtcgtgagagtgcagaggcctaccccacgcggaacagtcatggatatcatctcccgacgggaccagagaggtagcggccaagttgggacttatggactgaataccttcacgaacatggaagctcagttgattaggcagatggagggcgaaggtgtgtttaagaatatacagcacctcaccgtaacagaggaggtggccgtccataactggctggcacgcgtggggtgcgaaagactatctcggatggctatctcaggagatgactgcgttgtgaaaccacttgatgacaggttcgccaacgctctgactgccctcaatgatatgggcaagattcgtaaggacatccaacagtgggagcccagtaaaggctggaacgattggacccaggtccctttctgttcccaccattttcacgaactgattatgaaggacgggcgagtgttggtagttccatgccgcaatcaggatgagttaatcggcagagcacggataagccaaggtgcgggctggtctctgagggaaacagcctgtctcgggaaatcgtacgctcagatgtggtcacttatgtatttccaccgcagagacctgcggctagccgcaaacgctatctgcagcgccgtgccgtcccattgggtccccacaagtaggaccacgtggtctattcacgcaaagcatgagtggatgacaaccgaggacatgctgactgtgtggaatcgagtgtggatcctcgaaaacccttggatggaggataaaacaccagtcgaaagctgggaggaaattccctacttgggaaagcgtgaggaccagtggtgtggctccctgatcggtcttacctcaagagccacttgggcgaagaatatacaggctgccattaaccaagttcgcagtctgatcgggaatgaggaatacaccgattatatgccttctatgaaacggtttaggagagaggaagaggaagcaggagtgctctggtga

SEQ ID NO: 14859 - RNA, 9876 nt, synthetic construct
  misc_feature 1..9876: note = derived and/or modified CDS sequence (opt3) from DENV-2__EU482777__SS-prME
  source 1..9876: mol_type = other RNA
agcgcaggcatgatcattatgctgatacccaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacacgatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagcactggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactgccgagtgccccaatacaaacagagcatggaatagtctggaagtggaggattacggatttggcgtgttcaccacaaacatctggctcaagctgaaagaaaagcaggacgcgttttgtgactctaagttaatgagcgctgccattaaagataatagggcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaaactcattaccgagtggtgctgtagatcctgcacactgccgcctcttaggtatcgcggagaggacggctgttggtacggtatggaaatacggccattgaaggagaaagaagagaatctggtgaactcattagttacggcggggcacggacaggtggataatttcagtctcggcgtactgggtatggccctttttctggaagagatgttgagaaccagggtcggcactaagcatgctatcctcctggtggcagtgagcttcgtcacactaattaccgggaacatgtcgtttaaagacctgggacgcgttgtggtaatggtgggcgccactatggctgatgacatcgggatgggagtcacatatctcgccctgcttgcagcgttcaaggtgcgacccacctttgccgctggcttgctgttacggaagctcacgtccaaagagctgatgatgactaccattggtatcgttcttctgtctcaaagcacaatacctgaaaccgtgctagagctcactgatgccctggcattggggatgatggtcctgaagatcgtgcgtaatatggaaaaataccagttagctgttacaattatggccatcctctgcgtgcccaacgcagtcattctgcagaatgcctggaaggtatcatgtaccatccttgctgtggttagtgtgtccccactgttgctcacatctagccagcagaaaactgactggatacctctggcgctaaccattaagggactgaaccccacggccatcttccttacaaccctctccagaactaataaaaagaggtcatggccactgaacgaggcaatcatggctgtcggcatggtgagcattttggccagttctctgttaaagaatgacataccgatgaccggccctctcgtagccgggggactgcttacagtgtgctatgtcctgactggtcgctccgctgatttggaactcgagcgggcaaccgacgttaaatgggaggatcaggccgaaatcagcggctcgtcacccattctgtctatcacgattagtgaggacgggtccatgagcatcaagaacgaagaggaggaacagacactaaccatactgatcagaactggacttctcgtgatttctggcctgtttccaatcagcattcccatcacagcggctgcctggtacttgtgggaggtgaaaaagcagagggccggtgtcttatgggatgtgccttccccaccccctatggggaaagccgaactggaggacggagcttatcgaataaagcaaaagggcattctcggctactcacagatcggggcaggagtttacaaagaaggtaccttccacactatgtggcatgtaacacgcggcgccgtgctgatgcacaaggggaaacggatcgagccgagttgggcggatgtcaagaaagaccttattagctatggaggcggttggaagctggagggggaatggaaggagggagaagaggtgcaggttttggctctagaaccaggcaaaaatcccagagccgtgcagaccaagcctggcctgtttaaaacgaacactgggaccatcggagcagtctctctcgatttctccccaggtacatcaggcagtcccataattgacaagaaagggaaggtggtaggactgtacggcaacggtgtcgtgaccaggagcggggcctatgtttccgctatcgcccaaacagagaagtctattgaggataatcctgaaatcgaggacgatatatttcgtaaacgccggcttactattatggacttacacccgggagcaggcaagaccaaaagatacctgcccgctatcgtgagggaagccatcaagcgaggcctccggacgttgattctggcgccaacacgcgtcgtggccgcagagatggaagaggctctcagagggctgcctatcaggtatcagactcccgccattcgggctgagcataccggacgagaaatagttgaccttatgtgtcacgcaacattcaccatgagactgttgtcgccagtgcgcgtccctaactacaatctaatcattatggatgaggcccatttcactgaccccgccagcatcgctgcgaggggttatatctcaacccgtgtggaaatgggcgaggcagccgggatttttatgacagctacgccaccgggatcccgggatcctttcccccagagtaacgccccaataatcgacgaggaaagagagattcccgaaaggtcttggaatagcggccacgagtgggtaactgattttaaaggtaagaccgtgtggttcgttccttccatcaaggcagggaacgacattgccgcttgcctgcgcaaaaatggaaagaaagtcatccaactctcacgaaagacatttgattctgaatacgtgaaaaccagaactaacgactgggatttcgtggtcacaaccgacataagcgagatgggcgcgaattttaaggccgagcgggtaatcgatccaaggcgctgtatgaaacccgtgattttaacggacggcgaagaacgtgttatcctggcagggcctatgccggtgactcatagttccgctgcccagagacggggaaggattggtcgcaacccaaagaatgaaaacgaccagtacatctatatgggcgagccccttgaaaatgatgaggactgcgcacactggaaggaggccaaaatgctgctcgataacataaatacacctgaagggattatccccagcatgttcgagccagaacgagagaaggtcgacgctattgatggagaatacagattgcggggcgaggccaggaaaacctttgtggacctgatgcgcagaggtgatctccctgtttggctggcgtataaggtggcagccgaggggatcaactacgctgacaggcggtggtgtttcgatggcatcaaaaacaatcagatccttgaagagaacgtcgaagtggagatttggaccaaggagggagaacgtaagaaactaaagccccgctggctggacgcccgaatctattctgatccattggctttaaaagagtttaaggagttcgcagccggcagaaaatcactgactctcaatctgattacagagatggggaggcttcctaccttcatgacacaaaagactcgggacgctctggataacctcgccgtattgcacacggcagaagcgggaggtcgcgcctacaatcatgctctgtccgagctaccggagaccctggaaacactccttctgttaactttgctggccaccgtgacaggcgggatctttctcttcctgatgagtggaagaggcataggtaagatgacccttgggatgtgctgcattatcactgcaagcatcctgctctggtatgctcagattcagccccactggatcgccgcatcgataattttggagtttttcctgatcgttttactaattccagaacctgagaaacagaggacgccccaagacaaccagctgacctacgtcgtgatcgccatactcacagtggtcgctgcgactatggccaatgaaatgggctttcttgagaagaccaaaaaggacctgggattgggctctatcgcaacacagcagccagagtccaacattctggatatcgacctccggcctgctagcgcctggaccctgtacgccgttgcaactacattcgtgacgcccatgcttcgacattcaattgaaaatagttctgtaaacgtgtccctcaccgctatcgccaatcaagcgactgtcctgatggggttgggaaaaggttggccgctgagcaagatggatattggcgtgccattactagctatcgggtgttattcacaggttaaccctataacactgaccgccgcactccttctgttggtggcccactacgctattatcggacccggcctgcaggcaaaggccaccagagaggcgcagaaacgcgctgccgcaggtatcatgaagaatccaacagtcgacgggattactgtaatagatctcgaccccatcccttatgatccgaaatttgaaaagcaactgggccaggtgatgcttttaattctgtgcgttacacaggtgctcatgatgaggaccacatgggccttgtgtgaggctctgactctagccaccggacccatcagtacactgtgggaaggcaacccagggcggttctggaataccactattgcagtcagcatggctaacatctttcgtggatcctacctcgccggcgcgggtcttctgttctctataatgaaaaatacgacaaacaccagaagggggactggaaacatgggcgagaccttgggtgagaagtggaaaagccgcctgaatgccctcggcaagtccgaatttcaaatctataagaaatcagggattcaggaggtggaccggacactggcaaaggaaggaatcaaacgaggcgagactgatcaccatgctgtctctagagggagtgccaagttaaggtggttcgtggagcgcaacatggttacccctgaaggaaaagtggtagaccttggctgcggtagagggggatggtcgtactattgtggcggtctgaagaatgtgagagaggtcaagggcctcacaaaagggggacccggccacgaggaacctattccaatgagcacgtacgggtggaacctagttcgtctgcagtccggagtggatgtctttttcataccccctgaaaagtgcgacaccttgctgtgtgatataggcgagtcttcaccaaatcccactgtggaggcaggtaggacactccgggtacttaacctggtggaaaattggttgaacaataacacccagttctgcattaaagttctgaatccgtacatgcctagcgtgatcgagaagatggaagctctccaacgcaaatatgggggagccttagtccgaaacccactgtccagaaatagtactcatgagatgtactgggtgtctaacgccagcggcaatatcgtctcatccgtgaacatgattagtaggatgcttataaaccggtttacaatgcgccacaagaaggcgacctatgaacccgacgttgacctgggcagcgggacgagaaatatcggaattgagtctgagatccctaacctagatattatcggtaaaaggatagaaaagatcaaacaggagcatgaaacctcctggcactacgaccaggatcacccatataagacatgggcttaccatggctcatatgagactaaacagaccgggagcgcatcgtctatggtaaatggagtggtccgactcctgacaaagccctgggacgtgttgccgactgttacccaaatggccatgacagataccactcctttcggccagcagcgggtgtttaaggaaaaagtcgacacgcgtacacaggagcccaaggagggtaccaaaaagctgatgaaaattactgctgaatggctctggaaggagcttgggaaaaagaagaccccaagaatgtgtacacgcgaagagttcacgaggaaagtgcggagtaacgccgcactgggagccatctttaccgatgagaataagtggaaatccgctagagaagcggtagaggacagccgcttctgggaattagtggataaggagaggaacctgcacttggaaggcaaatgcgagacttgtgtttacaatatgatgggcaagcgagagaagaaactcggggaatttggaaaggccaaaggttcacgggcaatttggtacatgtggctgggcgctagattcctagagtttgaagcccttgggttcctgaacgaggaccattggttttccagggaaaattctctcagcggagtcgagggcgagggtctgcacaagttggggtatatcctgcgcgatgtgagtaaaaaggaaggaggcgcaatgtacgccgacgacacagctggctgggatacccgtattactctcgaggaccttaagaacgaagagatggtgacaaatcacatggaaggggagcataaaaagctggccgaggcgatattcaaattaacctatcaaaacaaggtcgttcgggtgcagagacctacacccaggggaactgtaatggatatcatttcccgccgagaccagcggggtagcggccaagtggggacctacggactgaatacgtttaccaacatggaagcacagttgatcagacagatggagggcgaaggtgtcttcaaaaatatccagcacctcacagtgactgaggaggttgccgtgcaaaactggctggctagggtcgggcgcgaaagactatctcggatggccatttcaggagatgactgcgtggtaaagccacttgatgacaggttcgcaaacgctctgaccgccctcaatgatatgggcaagatacgtaaagacatccagcagtgggagcccagtaagggctggaacgattggacacaggttcctttttgctcccatcacttccatgaactgattatgaaagacgggcgagtgttggtcgtgccatgtcgcaatcaagatgagttaatcggacgggctcggattagccagggtgccggctggtctctgagggaaactgcatgcctcgggaagtcgtatgcgcagatgtggtcacttatgtactttcaccgcagagacctgcggctagccgctaacgccatctgtagcgcagtgccgtcccactgggtccccaccagtaggacgacatggtctatacatgctaaacacgagtggatgaccactgaggacatgctgacagtttggaatcgagtgtggatccgtgaaaacccttggatggaggataagaccccagtagaaagctgggaggaaattccctatctcggaaagagagaggaccagtggtgcggctccttgatcggtctgacttcacgcgccacctgggccaaaaatattcaagccgcgatcaaccaggtgcggagtcttatagggaatgaggaatacacagattacatgccttctatgaagaggttcagacgcgaggaagaggaagctggagtcctgtggtga

SEQ ID NO: 14860 - RNA, 9876 nt, synthetic construct
  misc_feature 1..9876: note = derived and/or modified CDS sequence (opt3) from DENV-2__EU482778__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgcccagaggatcgagacctggatactgcggcatcctggcttcacaatcatggcagccattttggcttacaccgtgggcacgactcactttcagcgcgcactcatcttcattctgctggccgctgttgccccatccatgacaatgagatgcatcgggatatctaacagggattttgtggaaggagtctcgggtggctcatgggtggacattgtactcgagcacgggagctgtgttaccactatggcgaagaataagcccacattagatttcgaactgatcaaaaccgaggcaaagcagcctgccacgcttcggaaatattgcattgaagctaagttgaccaacacaactaccgagagtcgctgtccaacacaaggagagccctccctgaatgaagagcaggacaaacgatttgtgtgcaagcattctatggtcgatagaggctggggtaacgggtgtggactattcggcaagggcgggatcgtgacttgcgccatgtttacctgcaaaaagaatatggaaggaaaaatcgtgcagcctgagaacctcgaatacacaattgtcataaccccacacagcggtgaggagcatgcagttggcaatgacactgggaagcacggaaaagaaatcaagattacgccgcagtcccccatcacagaggctgaactgaccggctatggtactgtgaccatggagtgttcacctaggacagggcttgatttcaacgaaatggtactgttgcaaatggaggacaaagcctggctcgtgcaccggcagtggtttctggatttaccactgccctggctccctggcgcggacacccagggaagtaattggatacagaaggagactcttgtcacattcaagaacccacatgccaaaaagcaagacgtggttgtgctgggcagccaggaaggggcaatgcacacggctttgaccggagccactgagattcagatgtcttccggtaatctactgtttacaggccatctcaaatgccgtctgcgcatggataagcttcaactgaaagggatgtcatacagcatgtgtaccggaaagttcaagatcgtcaaagaaatcgctgagacacagcacggcactattgtgatcagagtacagtatgagggtgacgggagtccctgcaagattccgttcgaaataatggatttggagaaaaggcatgttctcggccggctgatcaccgtgaaccctattgtcacggaaaaggactctcccgtgaacatcgaggccgaaccaccttttggagattcctacatcattataggcgtcgagcccgggcagttaaaactgaattggttcaagaagggaagctcgatcggtcaaatgtttgagaccacaatgcgaggcgcaaaacgcatggccattctaggggacactgcttgggatttcggatctctcggcggtgtgtttacctccatcgggaaggcgctgcaccaggttttcggcgcaatttacggagccgctttttcaggcgtgagttggacaatgaaaatccttataggggtaatcattacttggatcggaatgaacagcagatccacctctttgagcgtctcactggtgctcgttggcgtgattacgctgtatcttggtgccatggtccaggcagacagtgggtgtgtggtatcctggaagaataaagaactgaagtgcggaagcggcatcttcataacagataacgtgcacacctggactgagcagtacaagtttcaaccagaatctccctcaaaattggccagtgctattcagaaggcccatgaggaaggtatctgtggcattaggagcgttacacggctcgagaatctgatgtggaaacagatcacccctgagttaaaccacatactgtccgaaaatgaggtcaagctaactatcatgaccggggacattaaaggaatcatgcaggcaggcaagcgctctctcagaccacaaccgacagaactgaaatattcgtggaagacgtgggggaaggcgaaaatgcttagcaccgagtcccataaccagactttcttgattgatggacccgaaacagctgagtgccctaataccaacagggcctggaattcactggaggtggaagactacggctttggtgtgttcacaactaacatctggctcaagctgcgtgagaaacaggacgtcttttgtgatagtaagttaatgtctgcagccataaaagacaatcgggctgttcacgccgatatggggtattggattgaaagcgcactgaacgacacctggaagatggagaaggcttccttcatcgaggtgaaaaattgccactggccaaagtcacatacgctttggagcaacggagtgttggaatctgagatgatcattcccaaatccttcgccggccctgtaagtcagcacaactaccgaccaggttattacacacaaaccgcgggcccctggcatctcgggaagctggaaatggattttgacttctgtgagggaactaccgtcgtggttacagaagattgcggcaatagagggccgagcctaaggactaccacagcctctggaaaactgatcacggagtggtgctgtcgctcctgcaccctccctccactgcggtacagaggcgaggacggttgttggtatgggatggaaattaggccccttaaggagaaggaagagaacttggtgaattcactggtcactgctggacacggccagatagataactttagtttaggtgtgctcggcatggcactgttccttgaagagatgctgcgcacacgagttgggaccaaacatgccatcttgctcgtggctgtaagctttgtcactctgattacaggaaatatgtcgttccgggacctaggccgtgtgatggtgatggtcggggccgcaatgaccgatgacatcggaattggcgttacgtacctggcgctcctggccgcttttaaggtgagacctactttcgccgcaggtcttttgctgaggaaattaacctccaaggagctcatgatggctacaatcgggatagccctgctttctcagagcaccatccccgaaactattctggagctaacagatgcactcgccctgggaatgatggtattgaaaatcgtgcgcaacatggaaaagtatcaactggctgtcaccattatggcgatctcatgcgtgccaaatgccgttatattacagaacgcatggaaggtgagttgtacaattctcgctactgtctccgtgtctcctctgcttctgaccagctcccagcagaaagccgactggatccccttggccctcacgatcaagggcctgaatccaacagctatttttctaaccactctgtcacggaccagcaaaaagagaagttggccgcttaacgaggcaataatggccgttggcatggtgtctatcctcgcgtccagcctgttgaaaaatgacattcctatgacagggcccctggtcgctggaggtttactcactgtatgctacgtgctgaccggcaggtcggccgatcttgaactggagcgagcaacggacgttaagtgggaggatcaagccgaaatctcagggtctagtccaattttgtccatcacaatagctgaggacggaagcatgtctatcaaaaacgaagaggaggaacagaccctcactattctgatccgcacaggcctactggtgattagcggtcttttccccgtctccatccctataaccgcagccgcgtggtatctctgggaggtgaagaagcagcgggctggggtactgtgggatgtgccatcaccccctccggtcggaaaagccgaattggaggacggcgcatacagaattaagcagaaaggcatcttagggtatagtcaaatcggagccggtgtttacaaggaaggcacttttcacacaatgtggcacgtgaccaggggggctgtgctgatgcatcgtggaaaacgcattgagccaagctgggccgatgtcaagaaggacctcatctcttacggcggtgggtggaaactggagggagaatggaaggagggcgaagaggtgcaggttcttgcactggaacccggcaaaaatcctcgggctgtacagacgaagccagggttgttcaaaactaacaccggaacaataggtgccgtgtccctagatttttcacccggcaccagtgggagccctattgtcgacaagaagggaaaagtggttggcctgtatggtaatggggtggtcacaagatccggagcgtacgtgtctgccatcgcacagactgagaagtcgattgaggataacccggaaatcgaggacgatatattcaggaaaaagcgactcaccattatggacctgcaccccggcgctggcaaaacgaagcggtatcttccagccatcgtacgcgaagctatcaagagagggttaaggacactgattctcgcacctactcgggtcgtggccgccgagatggaagaggctttgcgaggactgcccatcagataccaaaccccagcgattcgcgcagagcatacaggtagggaaatagttgacctcatgtgtcacgccaccttcactatgcgtctgcttagccctgtgcgggtccccaactataatctgatcattatggatgaggctcattttaccgacccagcctcaatcgcagccagaggctacatctccacaagggtggaaatgggggaggctgcgggaattttcatgacggccactccgcctggcagtcgcgatccctttccacagtctaacgcacccataatggacgaggaacgagagatccctgaaagaagctggaattccggtcacgagtgggttaccgatttcaaagggaagacagtgtggtttgtcccatcaattaaagctggaaacgacatcgccgcatgcttgcggaagaatggcaaaaaggtgattcagctatctaggaagaccttcgatagcgaatatgtaaaaactcgcacaaacgactgggattttgtggttaccacggacatcagtgagatgggcgccaatttcaaggctgagcgtgtcatagatcccagacggtgtatgaaacctgtgatcctgactgacggggaagagagggtgattctcgccggaccgatgccagtcacacactccagcgcggcacaacgccgaggtagaatcggccggaaccccaagaatgaaaacgaccagtacatttacatgggggagcctttagaaaatgatgaggactgcgcccattggaaagaggctaagatgctgcttgataacatcaatacccccgaaggaataattccatctatgtttgagcctgaaagggagaaagtagacgccatcgatggcgaatatcgcctgagaggtgaggctaggaagaccttcgtggacctcatgcggcgtggggatttgcccgtttggctggcataccgcgtggccgctgagggcattaactatgccgaccgaagatggtgttttgatggagtcaagaataaccagatcctcgaagagaacgtggaagttgagatatggactaaagagggcgaaaggaagaaactgaagccacggtggcttgacgcacgcatctactcagatcctctagcgctgaaagagttcaaggaattcgccgctgggagaaagtccttgacattaaatctgattaccgagatgggaaggctcccgacatttatgactcagaaagcccgggacgcactggataaccttgctgtgctgcacacggccgaagcaggtggccgagcctataatcatgctctcagtgagttgcccgagaccctggaaacactactgctccttactctgttagcgaccgtcacagggggaatcttcttgtttctgatgagcggcaagggtgtggggaaaatgaccctcggcatgtgctgcattatcactgcctcgatactgctttggcacgcacaaattcagccacactggatcgctgcctctatcattctggagttctttctcatcgtattgctgatacctgaacccgagaagcagagaacgccacaggacaaccaattaacctacgtggttattgccatcctaacagtcgtggcagctactatggccaatgaaatgggattcctggagaaaaccaagaaggacctcggccttgggtccattgcgacacaggagcctgaaagcaacatcctggatatagacttgcgccccgcttcagcctggaccctgtatgcagtggccactacatttgtcacgccgatgctcaggcatagtatcgagaattcttccgttaacgtgagcctgaccgctattgcaaatcaggccactgtacttatgggactcggtaaaggctggccactgtcaaagatggatatcggggtgcctttgctggcgattggatgttacagtcaggtcaaccccatcacattaaccgctgccctactgctccttgtggcacactacgccattatcggcccaggtctgcaagctaaagccacccgggaagcacagaagcgtgctgccgcggggataatgaaaaatcccacagttgacggcattactgtgatcgatttggaccctatcccgtatgatcccaagttcgagaagcagctgggacaggtcatgctcctgattctttgcgtaacgcaagtgttaatgatgagaaccacatgggccctgtgtgaagcactcactttggctaccggcccaataagcacactgtgggaggggaaccctggaaggttttggaataccactatcgccgtttccatggcaaacattttccgcggctcttacctagctggtgccgggctgctctttagcatcatgaaaaatacgacaaacacccggcgaggaactggcaatattggtgagacccttggcgaaaagtggaaatccagactgaacgccttggggaagtcagagttccagatctataaaaagtctggaatacaggaagtggacaggacactggcgaaagagggcatcaagcgcggggagactgatcatcacgctgtcagtcggggatcggcaaagctcagatggtttgtggaacgtaacatggtcacccccgagggcaaagtggttgacctgggttgcgggaggggaggctggagctactattgtggtggcttaaagaatgtgcgggaagtaaaagggcttacaaagggaggccctgggcatgaggaaccagtgcccatgtccacgtacggatggaacctggtccgcctccaatctggcgttgatgtgttcttcacccctccagagaaatgcgacactctactgtgtgatattggtgagtcaagccccaatccgacaatcgaagccgggcgaaccttgagagtcctgtccctcgtggagaactggcttaataacgacactcagttttgcattaaggtactgaatccttatatgccaagtgtgatcgaaaagatggagacattgcagaggaaatacggaggcgctctggttcggaaccccctctctcgcaatagcacccacgaaatgtactgggtgtcaaacgccacgggcaatatagtctccagtgtgaacatgattagcagaatgttaatcaataggttcaccatgaagcacaaaaaggcaacatatgagcctgacgtcgatctggggtctggaactcgaaacatcggtattgagtccgaaataccaaatcttgacatcattggcaaacggatcgagaagattaagcaggaacatgagacctcatggcactacgatcaagaccatccctataaaacatgggcctaccacgggagctatgaaactaagcagaccggatcggcttctagtatggtgaacggcgttgtacgtctgctaacaaaaccgtgggatgtggtccctatggtgacccagatggcgatgactgacacgacaccctttggtcagcaaagagttttcaaggagaaagtggatacccgcactcaggagccaaaggaagggaccaagaaactcatgaagatcacagccgagtggctgtggaaagaattgggaaagaaaaagacgcctaggatgtgtacccgggaggagtttactagaaaagtccgctccaacgcagctctgggcgccatattcacagacgaaaataagtggaagagcgcaagggaggccgtggaagattcacgattttgggagctcgtagacaaagaacggaaccttcacctggagggcaagtgcgagacctgtgtgtacaatatgatggggaaaagagaaaagaaattaggagagttcggtaaggctaagggctccagggccatctggtatatgtggctgggggcgcgctttttggaattcgaggcactcggatttctgaacgaagatcattggttctctcgtgagaatagcctaagtggcgttgagggtgaagggcttcacaaactgggatacattctccgggacgtctccaagaaagagggcggcgccatgtacgctgacgatactgccgggtgggacacaagaatcaccctggaagatttgaagaacgaggaaatggtgacaaatcatatggagggagagcacaaaaagctggcagaagctatttttaagctcacttatcagaacaaagtggtcagggttcagcgccccaccccacgaggtacggtgatggacatcattagccggagagatcaaaggggctctgggcaggtaggaacctacggccttaatacattcactaacatggaggcccagctgatacgccaaatggaaggtgaggggatcttcaagtcaattcagcatttaaccgtgacagaggaaatcgctgtccagaattggctggccagagtgggacgggagaggttgagtcgtatggcaatctccggcgacgattgcgttgtgaaacccctcgacgatcgatttgcgagcgccctgactgctctaaacgacatgggcaaggtccgcaaagatattcagcaatgggaaccttctagagggtggaatgactggacccaggtgccattctgctcgcaccactttcatgagcttataatgaaggatggacgggtactggttgtgccgtgtaggaaccaggacgaactcatcggtcgcgccagaatttcacagggcgcagggtggagcctgaaggagacggcttgcttgggaaaatcctatgcccaaatgtggagtttaatgtacttccaccggagggacctgcgactcgcagccaatgcgatctgttctgctgtccccagccattgggtgcctacatcccgtaccacttggtcaattcacgccaagcacgagtggatgacaaccgaagatatgcttactgtgtggaacagagtctggatccaggagaacccatggatggaagacaaaacccccgttgagagttgggaagaggtgccttatctgggcaagcgcgaggatcagtggtgcggttctctaatagggctgacaagccgggcaacgtgggccaaaaatatccagaccgctattaaccaagtaaggtccctcatcggaaatgaagagtacactgactatatgccatcaatgaagagatttcgccgggaagaggaagaggccggcgtgttgtggtga

SEQ ID NO: 14861 - RNA, 9876 nt, synthetic construct
  misc_feature 1..9876: note = derived and/or modified CDS sequence (opt3) from DENV-2__EU482779__SS-prME
  source 1..9876: mol_type = other RNA
accgccggagtgataattatgctgatacccacagctatggcattccacctcactacgaggaatggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagacccggacagaaacttggatgagtagcgagggagcttggaaacacgcccagaggatcgagacctggatactgcggcatcctggcttcacaatcatggcagccattttggcttacaccgtgggcacgactcactttcagcgcgcactcatcttcattctgctggccgctgttgccccatccatgacaatgcgttgcatcgggatatctaacagggattttgtggaaggagtctcgggtggctcatgggtggacattgtactcgagcacgggagctgtgttaccactatggcgaagaataagcccacattagatttcgaactgatcaaaaccgaggcaaagcagcctgccacgcttcggaaatattgcattgaagctaagttgaccaacacaactaccgagagtcgctgtccaacacaaggagagccctccctgaatgaagaacaggacaaacgatttgtgtgcaagcattctatggtcgatagaggctggggtaacgggtgtggactattcggcaagggcgggatcgtgacttgcgccatgtttacctgcaaaaagaatatggaaggaaaaatcgtgcagcctgagaacctcgaatacacaattgtcataaccccacacagcggtgaggagcatgcagttggcaatgacactgggaagcacggaaaagaaatcaagattacgccgcagtcccccatcacagaggctgaactgaccggctatggtactgtgaccatggagtgttcacctaggacagggcttgatttcaacgaaatggtactgttgcaaatggaggacaaagcctggctcgtgcaccggcagtggtttctggatttaccactgccctggctccctggcgcggacacccagggaagtaattggatacagaaggagactcttgtcacattcaagaacccacatgccaaaaagcaagacgtggttgtgctgggcagccaggaaggggcaatgcacacggctttgaccggagccactgagattcagatgtcttccggtaatctactgtttacaggccatctcaaatgccgtctgcgcatggataaacttcaactgaaagggatgtcatacagcatgtgtaccggaaagttcaagatcgtcaaagaaatcgctgagacacagcacggcactattgtgatcagagtacagtatgagggtgacgggagtccctgcaagattccgttcgaaataatggatttggagaaaaggcatgttctcggccggctgatcaccgtgaaccctattgtcacggaaaaggactctcccgtgaacatcgaggccgaaccaccttttggagattcctacatcattataggcgtcgagcccgggcagttaaaactgaattggttcaagaagggaagctcgatcggtcaaatgtttgagaccacaatgcgaggcgcaaaacgcatggccattctaggggacactgcttgggatttcggatctctcggcggtgtgtttacctccatcgggaaggcgctgcaccaggttttcggcgcaatttacggagccgctttttcaggcgtgagttggacaatgaaaatccttataggggtaatcattacttggatcggaatgaacagcagatccacctctttgagcgtctcactggtgctcgttggcgtgattacgctgtatcttggtgccatggtccaggcagacagtgggtgtgtggtatcctggaagaataaagaactgaagtgcggaagcggcatcttcataacagataacgtgcacacctggactgagcagtacaagtttcaaccagaatctccctcaaaattggccagtgctattcagaaggcccatgaggaaggtatctgtggcattaggagcgttacacggctcgagaatctgatgtggaaacagatcacccctgagttaaaccacatactgtccgaaaatgaggtcaagctaactatcatgaccggggacattaaaggaatcatgcaggcaggcaagcgctctctcagaccacaaccgacagaactgaaatattcgtggaagacgtgggggaaggcgaaaatgcttagcaccgagtcccataaccagactttcttgattgatggacccgaaacagctgagtgccctaataccaacagggcctggaactcactggaggtggaagactacggctttggtgtgttcacaactaacatctggctcaagctgcgtgagaaacaggacgtcttttgtgatagtaagttaatgtctgcagccataaaagacaatcgggctgttcacgccgatatggggtattggattgaaagcgcactgaacgacacctggaagatggagaaggcttccttcatcgaggtgaaatcatgccactggccaaagagccatacgctttggtctaatggagtgttggaatccgagatgatcattcccaaaagtttcgccggccctgtaagccagcacaactaccgaccaggttattacacacaaaccgcgggcccctggcatctcgggaagctggaaatggattttgacttctgtgagggaactaccgtcgtggttacagaagattgcggcaacagagggccgtctctaaggactaccacagcctccggaaaactgatcacggagtggtgctgtcgctcatgcaccctccctccactgcggtacagaggcgaggacggttgttggtatgggatggaaattaggccccttaaggagaaggaagagaatttggtgaacagtctggtcactgctggacacggccagatagataattttagcttaggtgtgctcggcatggcactgttccttgaagagatgctgcgcacacgagttgggaccaaacatgccatcttgctcgtgactgtatcgtttgtcacactgattaccggaaacatgtccttccgggacctaggccgtgtgatggtgatggtcggggctgccatgacggatgacatcggaatgggcgttacttacctggcactcctggcggcctttaaggtgagacctaccttcgctgccggtcttttgctgaggaaattaacatctaaggagctcatgatggcaaccattgggatcgctctgcttagccagtcaactatacccgaaacaatcctggagctaaccgatgccctcgcactgggaatgatggtattgaaaattgtgcgcaatatggaaaagtatcaactggccgtcacaatcatggctattagttgcgtgccaaacgcggttatcttacagaatgcctggaaggtgtcctgtactatactcgcagctgtctctgtgagccctctgcttctgacctcctcacagcagaaagccgactggattcccttggccctcacgatcaagggcctgaacccaacagctatctttctaaccactctgagccggaccagtaaaaagagatcttggccgcttaatgaggcaattatggccgttggcatggtgtccatactcgcgagctcgctgttgaaaaacgacatccctatgacagggcccctggtcgctggaggtttactcactgtatgctacgtgctgaccggcaggtcagccgatcttgaactggagcgagcaacggacgttaagtgggaggatcaagccgaaatttctgggagttccccaatcttgagcattacaatcgctgaggacggatctatgagcatcaagaatgaagaggaggaacagaccctcactatcctgattcgcacaggcctactggtgatctccggtcttttccccgtctcaattcctatcaccgcagccgcgtggtatctctgggaggtgaagaagcagcgggctggggtactgtgggatgtgccaagtccccctccggtcggaaaagccgaattggaggacggcgcatacagaataaagcagaaaggcattttagggtatagccaaatcggagccggtgtttacaaggaaggcacttttcacacaatgtggcacgtgaccagaggggctgtgctgatgcatcgtggaaaacgcatcgagccatcttgggccgatgtcaagaaggacctcatttcctacggcggtgggtggaaactggagggagaatggaaggagggcgaagaggtgcaggttcttgcactggaacccggcaaaaaccctcgggctgtacagacgaagccagggttgttcaaaactaataccggaacaatcggtgccgtgtcactagattttagtcccggcaccagcgggtcccctatagtcgacagaaagggaaaggtggttggcctgtatggtaacggggtggtcacaaggtctggagcgtacgtgtcggccattgcacagactgagaaaagcatcgaggataatccggaaattgaggacgatatcttccgaaagaaacggctcaccataatggacctgcaccccggcgctggcaagacgaaacgctatcttccagccattgtaagagaagctatcaagagggggttacggacactgatcctcgcacctactcgagtcgtggccgccgagatggaagaggctttgagaggactgcccattcgctaccaaaccccagcgatcagggcagagcatacaggtcgtgaaattgttgacctcatgtgtcacgccaccttcactatgcggctgctttcacctgtgagagtccccaactataacctgataatcatggatgaggctcattttaccgacccagcctccattgcagccaggggctacatcagtacacgcgtggaaatgggggaggctgcgggaatcttcatgacggccactccgcctggctctcgagatccctttccacagagcaatgcacccattatggacgaggaaagagagatacctgaacggtcctggaactcaggtcacgagtgggttaccgatttcaaggggaaaacagtgtggtttgtcccatctatcaaggctggaaatgacattgccgcatgcttgaggaaaaacggcaagaaagtgatccagctaagccgcaagaccttcgatagtgaatatgtaaagactcgtacaaatgactgggattttgtggttaccacggacatttccgagatgggcgccaacttcaaagctgagagagtcatcgatccccggaggtgtatgaagcctgtgatactgactgacggggaagaacgcgtgatcctcgccggaccgatgccagtcacacacagctctgcggcacaacgaagaggtcggattggcaggaatcccaaaaacgaaaatgaccagtacatctacatgggggagcctttagaaaacgatgaggactgcgcccattggaaggaggctaaaatgctgcttgataatattaacacccccgaaggaatcataccatcaatgtttgagcctgaacgcgagaaggtagacgccattgatggcgaatatagactgaggggtgaggctcggaaaaccttcgtggacctcatgcgtcgcggggatttgcccgtttggctggcataccgagtggccgctgagggcatcaattatgccgacagaaggtggtgttttgatggagtcaagaacaatcagattctcgaagagaacgtggaagttgagatctggactaaggagggcgaacggaaaaagctgaaaccacgctggcttgacgcaagaatatactccgatcctctagcgctgaaggagttcaaagagttcgccgctgggaggaagagtttgacattaaacctgatcaccgagatgggacggctcccgacatttatgactcagaaggcccgagacgcactggataatcttgctgtgctgcacacggccgaagcaggaggtagagcctataaccatgctctcagcgagttgcccgagaccctggaaacactactgctccttactctgttagcgaccgtcacagggggaattttcttgtttctgatgtcgggcaaaggtgtggggaagatgaccctcggcatgtgctgcatcattactgcctctatcctgctttggtacgcacaaatacagccacactggattgctgcctccatcatcctggagttctttctcattgtattgctgatccctgaacccgagaaacagcgcacgccacaggacaatcaattaacctatgtggttatagccattctaacagtcgtggcagctactatggccaacgaaatgggattcctggagaagaccaaaaaggacctcggccttgggagcatcgcgacacaggagcctgaatcaaatattctggatatcgacttgaggcccgctagtgcctggaccctgtacgcagtggccactacatttgtcacgccgatgctccggcactctatagagaactccagcgttaatgtgtcactgaccgctatcgcaaaccaggccactgtacttatgggactcggtaagggctggccactgagtaaaatggatattggggtgcctttgctggcgatcggatgttacagccaggtcaatcccattacattaaccgctgccctactgctccttgtggcacattatgccatcattggcccaggtctgcaagctaaggccacccgtgaagcacagaaaagagctgccgcggggatcatgaagaaccccacagttgacggcgtgactgtcatagatttggaccctattccgtacgatcccaaattcgagaagcagctgggacaggtaatgctcctgatcctttgcgtgacgcaagttttaatgatgaggaccacatgggccctgtgtgaagcactcactttggctaccggcccaatctccacactgtgggaggggaatcctggacgcttttggaacaccactattgccgtgtctatggcaaatatattccggggcagctatctagctggtgccgggctgctcttttccatcatgaagaacacgacaaatacccgaagaggaactggcaacattggtgagacccttggcgaaaaatggaagtcaaggctgaatgccttggggaaatctgagttccagatctacaagaaaagtggcattcaggaagtcgaccgcacactggcgaaggagggcatcaaaagaggggaaactgatcaccatgctgtgtcgagaggaagcgcaaagctccgttggtttgtcgaaaggaacatggtgacccccgagggcaaggttgtggacctgggttgcgggcggggaggctggtcctattactgtggtggcttaaaagatgtacgcgaagtgaaggggcttacaaaaggaggccctgggcacgaggaaccaatacccatgtctacgtatggatggaacctggtccgactccaatcaggcgttgacgtgttcttcacccctccagagaagtgcgatactctactgtgtgacatcggtgagagctcccccaatccgacaattgaagccgggagaaccttgagggtcctgagtctcgtggagaactggcttaataacgacactcagttttgcatcaaagtactgaatccttacatgccatctgtgattgaaaagatggagacattgcagcggaagtacggaggcgctctggttcgcaaccccctcagcagaaattcaacccatgaaatgtattgggtgtccaacgccacgggcaatatcgtcagtagcgtgaacatgatatctaggatgttaattaatcgattcaccatgaaacacaagaaagcaacatacgagcctgatgtcgacctggggtccggaactcggaacatcggtatcgagtcagaaattccaaatcttgatataatcggcaagcgtattgagaaaatcaagcaggaacacgagaccagctggcattatgaccaagatcacccctacaagacatgggcctatcatgggtcgtacgaaactaaacagaccggatctgctagttccatggtgaacggcgttgtaagactgctaacaaagccgtgggacgtggtccctatggtgacccagatggcgatgactgatacgacaccctttggtcagcaacgcgttttcaaagagaaggtggacaccaggactcaggagccaaaagaagggaccaagaagctcatgaaaattacagccgagtggctgtggaaggaattgggcaaaaagaaaacgcctcggatgtgtaccagagaggagtttactcgcaaggtcaggagcaatgcagctctgggcgccatcttcacagatgaaaacaaatggaagtcagcacgagaggccgtggaagactcccggttttgggagctcgtagataaggaaagaaaccttcacctggagggcaaatgcgagacctgtgtgtataatatgatggggaagagggagaaaaagttaggagagttcggtaaagctaagggctctcgcgccatatggtacatgtggctgggggcgagatttttggagttcgaggcactcggatttctgaacgaagaccactggttcagccgggagaatagtctatccggcgttgagggtgaagggcttcataagctgggatacatcctcagagacgtcagcaaaaaggagggcggcgccatgtatgctgatgacactgccgggtgggatacaaggattaccctggaagacttgaaaaacgaggaaatggtgacaaatcacatggagggagagcataagaaactggcagaagctatctttaagctcacttaccagaacaaggtggtccgcgttcagcgacccaccccacggggtacggtgatggatattatctctagaagggaccaacgcggctcagggcaggtaggaacctatggccttaatacattcactaacatggaggcccagctgattagacaaatggaaggtgagggggtgttcaaaagtatacagcggttaaccgtcacagaggaaatcgctgtgcagaattggctggccagggttggacgtgagcgattgtcccgcatggcaattagcggcgatgactgcgtggtcaagcccctcgatgacagatttgcgtctgccctgactgctctaaacgatatgggcaaagtgcggaaggacatccagcaatgggaaccttcgagggggtggaatgattggacccaggtaccattctgctcacaccattttcacgagcttatcatgaaagacggacgcgttctggtggtcccgtgtagaaaccaggacgaactcattggtcgggccaggataagccagggcgcagggtggtccctgaaggagacggcttgcttgggaaagagttacgcccaaatgtggtctttaatgtatttccaccgacgtgatctgagactcgcagccaatgcgatctgtagcgctgtgccctcccattgggtgcctacatcacgcaccacttggagtattcacgccaaacatgagtggatgacaaccgaagacatgcttactgtctggaaccgggtttggatccaggagaatccatggatggaagataagacccccgtggagtcttgggaagaggtaccttacctgggcaaaagggaggaccagtggtgcggtagcctaattgggctgacatccagagcaacgtgggccaagaacatccagaccgctataaaccaagtgcgctcactcatcggaaatgaagagtatactgattacatgccaagcatgaaacggtttaggcgagaagaggaagaggccggcgtcttgtggtga

SEQ ID NO: 14862 - RNA, 9876 nt, synthetic construct
  misc_feature 1..9876: note = derived and/or modified CDS sequence (opt3) from DENV-2__EU482780__SS-prME
  source 1..9876: mol_type = other RNA
accgccggagtgataattatgctgatacccacagctatggcattccacctcactacgaggaatggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagacccggacagaaacttggatgagtagcgagggagcttggaaacacgcccagaggatcgagacctggatactgcggcatcctggcttcacaatcatggcagccattttggcttacaccgtgggcacgactcactttcagcgcgcactcatcttcattctgctggccgctgttgccccatccatgacaatgcgttgcatcgggatatctaacagggattttgtggaaggagtctcgggtggctcatgggtggacattgtactcgagcacgggagctgtgttaccactatggcgaagaataagcccacattagatttcgaactgatcaaaaccgaggcaaagcagcctgccacgcttcggaaatattgcattgaagctaagttgaccaacacaactaccgagagtcgctgtccaacacaaggagagccctccctgaatgaagaacaggacaaacgatttgtgtgcaagcattctatggtcgatagaggctggggtaacgggtgtggactattcggcaagggcgggatcgtgacttgcgccatgtttacctgcaaaaagaatatggaaggaaaaatcgtgcagcctgagaacctcgaatacacaattgtcataaccccacacagcggtgaggagcatgcagttggcaatgacactgggaagcacggaaaagaaatcaagattacgccgcagtcccccatcacagaggctgaactgaccggctatggtactgtgaccatggagtgttcacctaggacagggcttgatttcaacgaaatggtactgttgcaaatggaggacaaagcctggctcgtgcaccggcagtggtttctggatttaccactgccctggctccctggcgcggacacccagggaagtaattggatacagaaggagactcttgtcacattcaagaacccacatgccaaaaagcaagacgtggttgtgctgggcagccaggaaggggcaatgcacacggctttgaccggagccactgagattcagatgtcttccggtaatctactgtttacaggccatctcaaatgccgtctgcgcatggataaacttcaactgaaagggatgtcatacagcatgtgtaccggaaagttcaagatcgtcaaagaaatcgctgagacacagcacggcactattgtgatcagagtacagtatgagggtgacgggagtccctgcaagattccgttcgaaataatggatttggagaaaaggcatgttctcggccggctgatcaccgtgaaccctattgtcacggaaaaggactctcccgtgaacatcgaggccgaaccaccttttggagattcctacatcattataggcgtcgagcccgggcagttaaaactgaattggttcaagaagggaagctcgatcggtcaaatgtttgagaccacaatgcgaggcgcaaaacgcatggccattctaggggacactgcttgggatttcggatctctcggcggtgtgtttacctccatcgggaaggcgctgcaccaggttttcggcgcaatttacggagccgctttttcaggcgtgagttggacaatgaaaatccttataggggtaatcattacttggatcggaatgaacagcagatccacctctttgagcgtctcactggtgctcgttggcgtgattacgctgtatcttggtgccatggtccaggcagacagtgggtgtgtggtatcctggaagaataaagaactgaagtgcggaagcggcatcttcataacagataacgtgcacacctggactgagcagtacaagtttcaaccagaatctccctcaaaattggccagtgctattcagaaggcccatgaggaaggtatctgtggcattaggagcgttacacggctcgagaatctgatgtggaaacagatcacccctgagttaaaccacatactgtccgaaaatgaggtcaagctaactatcatgaccggggacattaaaggaatcatgcaggcaggcaagcgctctctcagaccacaaccgacagaactgaaatattcgtggaagacgtgggggaaggcgaaaatgcttagcaccgagtcccataaccagactttcttgattgatggacccgaaacagctgagtgccctaataccaacagggcctggaactcactggaggtggaagactacggctttggtgtgttcacaactaacatctggctcaagctgcgtgagaaacaggacgtcttttgtgatagtaagttaatgtctgcagccataaaagacaatcgggctgttcacgccgatatggggtattggattgaaagcgcactgaacgacacctggaagatggagaaggcttccttcatcgaggtgaaatcatgccactggccaaagagccatacgctttggtctaatggagtgttggaatccgagatgatcattcccaaaagtttcgccggccctgtaagccagcacaactaccgaccaggttattacacacaaaccgcgggcccctggcatctcgggaagctggaaatggattttgacttctgtgagggaactaccgtcgtggttacagaagattgcggcaacagagggccgtctctaaggactaccacagcctccggaaaactgatcacggagtggtgctgtcgctcatgcaccctccctccactgcggtacagaggcgaggacggttgttggtatgggatggaaattaggccccttaaggagaaggaagagaatttggtgaacagtctggtcactgctggacacggccagatagataattttagcttaggtgtgctcggcatggcactgttccttgaagagatgctgcgcacacgagttgggaccaaacatgccatcttgctcgtgactgtatcgtttgtcacactgattaccggaaacatgtccttccgggacctaggccgtgtgatggtgatggtcggggctgccatgacggatgacatcggaatgggcgttacttacctggcactcctggcggcctttaaggtgagacctaccttcgctgccggtcttttgctgaggaaattaacatctaaggagctcatgatggcaaccattgggatcgctctgcttagccagtcaactatacccgaaacaatcctggagctaaccgatgccctcgcactgggaatgatggtattgaaaattgtgcgcaatatggaaaagtatcaactggccgtcacaatcatggctattagttgcgtgccaaacgcggttatcttacagaatgcctggaaggtgtcctgtactatactcgcagctgtctctgtgagccctctgcttctgacctcctcacagcagaaagccgactggattcccttggccctcacgatcaagggcctgaacccaacagctatctttctaaccactctgagccggaccagtaaaaagagatcttggccgcttaatgaggcaattatggccgttggcatggtgtccatactcgcgagctcgctgttgaaaaacgacatccctatgacagggcccctggtcgctggaggtttactcactgtatgctacgtgctgaccggcaggtcagccgatcttgaactggagcgagcaacggacgttaagtgggaggatcaagccgaaatttctgggagttccccaatcttgagcattacaatcgctgaggacggatctatgagcatcaagaatgaagaggaggaacagaccctcactatcctgattcgcacaggcctactggtgatctccggtcttttccccgtctcaattcctatcaccgcagccgcgtggtatctctgggaggtgaagaagcagcgggctggggtactgtgggatgtgccaagtccccctccggtcggaaaagccgaattggaggacggcgcatacagaataaagcagaaaggcattttagggtatagccaaatcggagccggtgtttacaaggaaggcacttttcacacaatgtggcacgtgaccagaggggctgtgctgatgcatcgtggaaaacgcatcgagccatcttgggccgatgtcaagaaggacctcatttcctacggcggtgggtggaaactggagggagaatggaaggagggcgaagaggtgcaggttcttgcactggaacccggcaaaaaccctcgggctgtacagacgaagccagggttgttcaaaactaataccggaacaatcggtgccgtgtcactagattttagtcccggcaccagcgggtcccctatagtcgacagaaagggaaaggtggttggcctgtatggtaacggggtggtcacaaggtctggagcgtacgtgtcggccattgcacagactgagaaaagcatcgaggataatccggaaattgaggacgatatcttccgaaagaaacggctcaccataatggacctgcaccccggcgctggcaagacgaaacgctatcttccagccattgtaagagaagctatcaagagggggttacggacactgatcctcgcacctactcgagtcgtggccgccgagatggaagaggctttgagaggactgcccattcgctaccaaaccccagcgatcagggcagagcatacaggtcgtgaaattgttgacctcatgtgtcacgccaccttcactatgcggctgctttcacctgtgagagtccccaactataacctgataatcatggatgaggctcattttaccgacccagcctccattgcagccaggggctacatcagtacacgcgtggaaatgggggaggctgcgggaatcttcatgacggccactccgcctggctctcgagatccctttccacagagcaatgcacccattatggacgaggaaagagagatacctgaacggtcctggaactcaggtcacgagtgggttaccgatttcaaggggaaaacagtgtggtttgtcccatctatcaaggctggaaatgacattgccgcatgcttgaggaaaaacggcaagaaagtgatccagctaagccgcaagaccttcgatagtgaatatgtaaagactcgtacaaatgactgggattttgtggttaccacggacatttccgagatgggcgccaacttcaaagctgagagagtcatcgatccccggaggtgtatgaagcctgtgatactgactgacggggaagaacgcgtgatcctcgccggaccgatgccagtcacacacagctctgcggcacaacgaagaggtcggattggcaggaatcccaaaaacgaaaatgaccagtacatctacatgggggagcctttagaaaacgatgaggactgcgcccattggaaggaggctaaaatgctgcttgataatattaacacccccgaaggaatcataccatcaatgtttgagcctgaacgcgagaaggtagacgccattgatggcgaatatagactgaggggtgaggctcggaaaaccttcgtggacctcatgcgtcgcggggatttgcccgtttggctggcataccgagtggccgctgagggcatcaattatgccgacagaaggtggtgttttgatggagtcaagaacaatcagattctcgaagagaacgtggaagttgagatctggactaaggagggcgaacggaaaaagctgaaaccacgctggcttgacgcaagaatatactccgatcctctagcgctgaaggagttcaaagagttcgccgctgggaggaagagtttgacattaaacctgatcaccgagatgggacggctcccgacatttatgactcagaaggcccgagacgcactggataatcttgctgtgctgcacacggccgaagcaggaggtagagcctataaccatgctctcagcgagttgcccgagaccctggaaacactactgctccttactctgttagcgaccgtcacagggggaattttcttgtttctgatgtcgggcaaaggtgtggggaagatgaccctcggcatgtgctgcatcattactgcctctatcctgctttggtacgcacaaatacagccacactggattgctgcctccatcatcctggagttctttctcattgtattgctgatccctgaacccgagaaacagcgcacgccacaggacaatcaattaacctatgtggttatagccattctaacagtcgtggcagctactatggccaacgaaatgggattcctggagaagaccaaaaaggacctcggccttgggagcatcgcgacacaggagcctgaatcaaatattctggatatcgacttgaggcccgctagtgcctggaccctgtacgcagtggccactacatttgtcacgccgatgctccggcactctatagagaactccagcgttaatgtgtcactgaccgctatcgcaaaccaggccactgtacttatgggactcggtaagggctggccactgagtaaaatggatattggggtgcctttgctggcgatcggatgttacagccaggtcaatcccattacattaaccgctgccctactgctccttgtggcacattatgccatcattggcccaggtctgcaagctaaggccacccgtgaagcacagaaaagagctgccgcggggatcatgaagaaccccacagttgacggcgtgactgtcatagatttggaccctattccgtacgatcccaaattcgagaagcagctgggacaggtaatgctcctgatcctttgcgtgacgcaagttttaatgatgaggaccacatgggccctgtgtgaagcactcactttggctaccggcccaatctccacactgtgggaggggaatcctggacgcttttggaacaccactattgccgtgtctatggcaaatatattccggggcagctatctagctggtgccgggctgctcttttccatcatgaagaacacgacaaatacccgaagaggaactggcaacattggtgagacccttggcgaaaaatggaagtcaaggctgaatgccttggggaaatctgagttccagatctacaagaaaagtggcattcaggaagtcgaccgcacactggcgaaggagggcatcaaaagaggggaaactgatcaccatgctgtgtcgagaggaagcgcaaagctccgttggtttgtcgaaaggaacatggtgacccccgagggcaaggttgtggacctgggttgcgggcggggaggctggtcctattactgtggtggcttaaaagatgtacgcgaagtgaaggggcttacaaaaggaggccctgggcacgaggaaccaatacccatgtctacgtatggatggaacctggtccgactccaatcaggcgttgacgtgttcttcacccctccagagaagtgcgatactctactgtgtgacatcggtgagagctcccccaatccgacaattgaagccgggagaaccttgagggtcctgagtctcgtggagaactggcttaataacgacactcagttttgcatcaaagtactgaatccttacatgccatctgtgattgaaaagatggagacattgcagcggaagtacggaggcgctctggttcgcaaccccctcagcagaaattcaacccatgaaatgtattgggtgtccaacgccacgggcaatatcgtcagtagcgtgaacatgatatctaggatgttaattaatcgattcaccatgaaacacaagaaagcaacatacgagcctgatgtcgacctggggtccggaactcggaacatcggtatcgagtcagaaattccaaatcttgatataatcggcaagcgtattgagaaaatcaagcaggaacacgagaccagctggcattatgaccaagatcacccctacaagacatgggcctatcatgggtcgtacgaaactaaacagaccggatctgctagttccatggtgaacggcgttgtaagactgctaacaaagccgtgggacgtggtccctatggtgacccagatggcgatgactgatacgacaccctttggtcagcaacgcgttttcaaagagaaggtggacaccaggactcaggagccaaaagaagggaccaagaagctcatgaaaattacagccgagtggctgtggaaggaattgggcaaaaagaaaacgcctcggatgtgtaccagagaggagtttactcgcaaggtcaggagcaatgcagctctgggcgccatcttcacagatgaaaacaaatggaagtcagcacgagaggccgtggaagactcccggttttgggagctcgtagataaggaaagaaaccttcacctggagggcaaatgcgagacctgtgtgtataatatgatggggaagagggagaaaaagttaggagagttcggtaaagctaagggctctcgcgccatatggtacatgtggctgggggcgagatttttggagttcgaggcactcggatttctgaacgaagaccactggttcagccgggagaatagtctatccggcgttgagggtgaagggcttcataagctgggatacatcctcagagacgtcagcaaaaaggagggcggcgccatgtatgctgatgacactgccgggtgggatacaaggattaccctggaagacttgaaaaacgaggaaatggtgacaaatcacatggagggagagcataagaaactggcagaagctatctttaagctcacttaccagaacaaggtggtccgcgttcagcgacccaccccacggggtacggtgatggatattatctctagaagggaccaacgcggctcagggcaggtaggaacctatggccttaatacattcactaacatggaggcccagctgattagacaaatggaaggtgagggggtgttcaaaagtatacagcggttaaccgtcacagaggaaatcgctgtgcagaattggctggccagggttggacgtgagcgattgtcccgcatggcaattagcggcgatgactgcgtggtcaagcccctcgatgacagatttgcgtctgccctgactgctctaaacgatatgggcaaagtgcggaaggacatccagcaatgggaaccttcgagggggtggaatgattggacccaggtaccattctgctcacaccattttcacgagcttatcatgaaagacggacgcatgctggttgtgccgtgtagaaaccaggacgaactcattggtcgggccaggataagccagggcgcagggtggtccctgaaggagacggcttgcttgggaaagagttacgcccaaatgtggtctttaatgtatttccaccgacgtgatctgagactcgcagccaatgcgatctgtagcgctgtcccctcccattgggtgcctacatcacgcaccacttggagtattcacgccaaacatgagtggatgacaaccgaagacatgcttactgtgtggaaccgggtctggatccaggagaatccatggatggaagataagacccccgttgagtcttgggaagaggtgccttacctgggcaaaagggaggaccagtggtgcggtagcctaattgggctgacatccagagcaacgtgggccaagaacatccagaccgctataaaccaagtacgctcactcatcggaaatgaagagtatactgattacatgccaagcatgaaacggtttaggcgagaagaggaagaggccggcgtgttgtggtga

SEQ ID NO: 14863 - RNA, 9876 nt, synthetic construct
  misc_feature 1..9876: note = derived and/or modified CDS sequence (opt3) from DENV-2__EU482781__SS-prME
  source 1..9876: mol_type = other RNA
accgcaggagtgataattatgctgatacccaccgctatggcattccacctcactacgcggaacggggagcctcatatgatcgtcggaaggcaggaaaagggtaaaagccttctgtttaagaccgaggacggagttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagacccgtacagaaacttggatgagtagcgagggagcttggaaacacgcccagaggatcgagacctggatactgcggcatcctggcttcacaatcatggcagccattttggcttacaccgtgggcacgactcactttcagcgcgcactcatcttcattctgctggccgctgttgccccatccatgacaatgagatgcatcgggatatctaacagggattttgtggaaggagtctcgggtggctcatgggtggacattgtactcgagcacgggagctgtgttaccactatggcgaagaataagcccacattagatttcgaactgatcaaaaccgaggcaaagcagcctgccacgcttcggaaatattgcattgaagctaagttgaccaacacaactaccgagagtcgctgtccaacacaaggagagccctccctgaatgaagaacaggacaaacgatttgtgtgcaagcattctatggtcgatagaggctggggtaacgggtgtggactattcggcaagggcgggatcgtgacttgcgccatgtttacctgcaaaaagaatatggaaggaaaaatcgtgcagcctgagaacctcgaatacacaattgtcataaccccacacagcggtgaggagcatgcagttggcaatgacactgggaagcacggaaaagaaatcaagattacgccgcagtcccccatcacagaggctgaactgaccggctatggtactgtgaccatggagtgttcacctaggacagggcttgatttcaacgaaatggtactgttgcaaatggaggacaaagcctggctcgtgcaccggcagtggtttctggatttaccactgccctggctccctggcgcggacacccagggaagtaattggatacagaaggagactcttgtcacattcaagaacccacatgccaaaaagcaagacgtggttgtgctgggcagccaggaaggggcaatgcacacggctttgaccggagccactgagattcagatgtcttccggtaatctactgtttacaggccatctcaaatgccgtctgcgcatggataaacttcaactgaaagggatgtcatacagcatgtgtaccggaaagttcaagatcgtcaaagaaatcgctgagacacagcacggcactattgtgatcagagtacagtatgagggtgacgggagtccctgcaagattccgttcgaaataatggatttggagaaaaggcatgttctcggccggctgatcaccgtgaaccctattgtcacggaaaaggactctcccgtgaacatcgaggccgaaccaccttttggagattcctacatcattataggcgtcgagcccgggcagttaaaactgaattggttcaagaagggaagctcgatcggtcaaatgtttgagaccacaatgcgaggcgcaaaacgcatggccattctaggggacactgcttgggatttcggatctctcggcggtgtgtttacctccatcgggaaggcgctgcaccaggttttcggcgcaatttacggagccgctttttcaggcgtgagttggacaatgaaaatccttataggggtaatcattacttggatcggaatgaacagcagatccacctctttgagcgtctcactggtgctcgttggcgtgattacgctgtatcttggtgccatggtccaggcagacagtgggtgtgtggtatcctggaagaataaagaactgaagtgcggaagcggcatcttcataacagataacgtgcacacctggactgagcagtacaagtttcaaccagaatctccctcaaaattggccagtgctattcagaaggcccatgaggaaggtatctgtggcattaggagcgttacacggctcgagaatctgatgtggaaacagatcacccctgagttaaaccacatactgtccgaaaatgaggtcaagctaactatcatgaccggggacattaaaggaatcatgcagccaggcaagcgctctctcagaccgcaacccacagaactgaaatattcgtggaagacgtgggggaaggcaaaaatgcttagcaccgagtcccataaccagactttcttgattgatggacctgaaacagcggagtgcccaaataccaacagggcttggaactcactggaggtggaagactacggctttggtgtgttcacaactaacatctggctcaagctgcgtgagaaacaggacgtcttttgtgatagtaagttaatgtctgccgcaataaaagacaatcgggccgttcacgctgatatggggtattggattgaaagcgccctgaacgacacctggaagatggagaaggcatccttcatcgaggtgaaatcatgccactggcccaagagccatacgctttggtctaatggagtgttggaatccgagatgatcattcctaaaagtttcgctggcccagtaagccagcacaactaccgacccggttattacacacaaaccgccggcccgtggcatctcgggaagctggaaatggattttgacttctgtgagggaactaccgtcgtggttacagaagattgcggcaacagagggccttctctaaggactaccacagcgtccggaaaactgatcacggagtggtgctgtcgctcatgcaccctcccacccctgcggtacagaggcgaggacggttgttggtatgggatggaaattaggcctcttaaggagaaggaagagaatttggtgaacagtctggtcactgccggacacggccagatagataattttagcttaggtgtgctcggcatggctctgttccttgaagagatgctgcgcacacgagttgggaccaaacatgcaatcttgctcgtgactgtatcgtttgtcacactgattaccggaaacatgtccttccgggacctaggccgtgtgatggtgatggtcggggccgctatgacggatgacatcggaatgggcgttacttacctggccctcctggcagcgtttaaggtgagacccaccttcgccgctggtcttttgctgaggaaattaacatctaaggagctcatgatggccaccattgggatcgcactgcttagccagtcaactataccagaaacaatcctggagctaaccgatgctctcgccctgggaatgatggtattgaaaattgtgcgcaatatggaaaagtatcaactggcagtcacaatcatggccattagttgcgtgcctaacgctgttatcttacagaatgcgtggaaggtgtcctgtactatactcgccgcagtctctgtgagccccctgcttctgacctcctcacagcagaaagctgactggattccattggccctcacgatcaagggcctgaacccgacagccatctttctaaccactctgagccggaccagtaaaaagagatcttggcctcttaatgaggctattatggcagttggcatggtgtccatactcgccagctcgctgttgaaaaacgacatccccatgacagggccactggtcgcgggaggtttactcactgtatgctacgtgctgaccggcaggtcagctgatcttgaactggagcgagccacggacgttaagtgggaggatcaagcagaaatttctgggagttcccccatcttgagcattacaatcgccgaggacggatctatgagcatcaagaatgaagaggaggaacagaccctcactatcctgattcgcacaggcctactggtgatctccggtcttttccctgtctcaattccaatcaccgctgcagcctggtatctctgggaggtgaagaagcagcgggcgggggtactgtgggatgtgcccagtcctccgccagtcggaaaagctgaattggaggacggcgcctacagaataaagcagaaaggcattttagggtatagccaaatcggagcaggggtttacaaggaaggcacttttcacacaatgtggcacgtgaccaggggtgcagtgctgatgcatcgtggaaaacgcatcgagccctcttgggctgatgtcaagaaggacctcatttcctacggcggtgggtggaaactggagggagaatggaaggagggcgaagaggtgcaggttcttgccctggaacctggcaaaaacccacgggcagtacagacgaagcccgggttgttcaaaactaataccggaacaatcggtgctgtgtcactagattttagtcctggcaccagcgggtccccgatagtcgacagaaagggaaaggtggttggcctgtatggtaacggggtggtcacaaggtctggagcctacgtgtcggcgattgcccagactgagaaaagcatcgaggataatcccgaaattgaggacgatatcttccgaaagaaacggctcaccataatggacctgcacccaggcgcaggcaagacgaaacgctatcttcctgctattgtaagagaagccatcaagagggggttacggacactgatcctcgctcccactcgagtcgtggcagccgagatggaagaggccttgagaggactgccaattcgctaccaaacccctgctatcagggcggagcatacaggtcgtgaaattgttgacctcatgtgtcacgcaaccttcactatgcggctgctttcacccgtgagagtcccaaactataacctgataatcatggatgaggcccattttaccgacccggcttccattgccgcaaggggctacatcagtacacgcgtggaaatgggggaggccgctggaatcttcatgacggcgactcctcccggctctcgagatccatttccccagagcaatgcccctattatggacgaggaaagagagataccagaacggtcctggaactcaggtcacgagtgggttaccgatttcaaggggaaaacagtgtggtttgtcccctctatcaaggcaggaaatgacattgctgcctgcttgaggaaaaacggcaagaaagtgatccagctaagccgcaagaccttcgatagtgaatatgtaaagactcgtacaaatgactgggattttgtggttaccacggacatttccgagatgggcgcaaacttcaaagccgagagagtcatcgatcctcggaggtgtatgaagccggtgatactgactgacggggaagaacgcgtgatcctcgctggaccaatgcccgtcacacacagctctgccgcgcaacgaagaggtcggattggcaggaatcctaaaaacgaaaatgaccagtacatctacatgggggagcccttagaaaacgatgaggactgcgcacattggaaggaggccaaaatgctgcttgataatattaacaccccagaaggaatcataccttcaatgtttgagcccgaacgcgagaaggtagacgctattgatggcgaatatagactgaggggtgaggcccggaaaaccttcgtggacctcatgcgtcgcggggatttgccagtttggctggcttaccgagtggcagccgagggcatcaattatgctgacagaaggtggtgttttgatggagtcaagaacaatcagattctcgaagagaacgtggaagttgagatctggactaaggagggcgaacggaaaaagctgaaacctcgctggcttgacgccagaatatactccgatccgctagcactgaaggagttcaaagagttcgcggccgggaggaagagtttgacattaaacctgatcaccgagatgggacggctccccacatttatgactcagaaggctcgagacgccctggataatcttgcagtgctgcacacggctgaagccggtggcagagcatataaccatgccctcagcgagttgccagagaccctggaaacactactgctccttactctgttagctaccgtcacagggggaattttcttgtttctgatgtcgggcaaaggtgtggggaagatgaccctcggcatgtgctgcatcattactgcgtctatcctgctttggtacgcccaaatacagcctcactggattgcagcttccatcatcctggagttctttctcattgtattgctgatccccgaaccagagaaacagcgcacgcctcaggacaatcaattaacctatgtggttatagccattctaacagtcgtggccgcaactatggctaacgaaatgggattcctggagaagaccaaaaaggacctcggccttgggagcatcgccacacaggagcccgaatcaaatattctggatatcgacttgaggccggcgagtgcttggaccctgtacgccgtggcaactacatttgtcacgccaatgctccggcactctatagagaactccagcgttaatgtgtcactgaccgccatcgctaaccaggcaactgtacttatgggactcggtaagggctggcctctgagtaaaatggatattggggtgcccttgctggccatcggatgttacagccaggtcaatccaattacattaaccgcggctctactgctccttgtggcccattatgcaatcattggccccggtctgcaagccaaggctacccgtgaagcccagaaaagagcagctgccgggatcatgaagaaccctacagttgacggcgtgactgtcatagatttggacccgattccctacgatccaaaattcgagaagcagctgggacaggtaatgctcctgatcctttgcgtgacgcaagttttaatgatgaggaccacatgggcgctgtgtgaagccctcactttggcaaccggccctatctccacactgtgggaggggaatcccggacgcttttggaacaccactattgctgtgtctatggccaatatattccggggcagctatctagccggtgctgggctgctcttttccatcatgaagaacacgacaaatacccgaagaggaactggcaacattggtgagacccttggcgaaaaatggaagtcaaggctgaatgccttggggaaatctgagttccagatctacaagaaaagtggcattcaggaagtcgaccgcacactggccaaggagggcatcaaaagaggggagactgatcaccatgcggtgtcgagaggaagcgctaagctccgttggtttgtcgaaaggaacatggtgacccctgagggcaaggttgtggacctgggttgcgggcggggaggctggtcctattactgtggtggcttaaaagatgtacgcgaagtgaaggggcttacaaaaggaggcccagggcacgaggaacccatacctatgtctacgtatggatggaacctggtccgactccaatcaggcgttgacgtgttcttcaccccacccgagaagtgcgatactctactgtgtgacatcggtgagagctccccgaatcctacaattgaagcagggagaaccttgagggtcctgagtctcgtggagaactggcttaataacgacactcagttttgcatcaaagtactgaatccatacatgccctctgtgattgaaaagatggagacattgcagcggaagtacggaggcgccctggttcgcaaccctctcagcagaaattcaacccatgaaatgtattgggtgtccaacgctacgggcaatatcgtcagtagcgtgaacatgatatctaggatgttaattaatcgattcaccatgaaacacaagaaagccacatacgagccagatgtcgacctggggtccggaactcggaacatcggtatcgagtcagaaattcccaatcttgatataatcggcaagcgtattgagaaaatcaagcaggaacacgagaccagctggcattatgaccaagatcacccgtacaagacatgggcatatcatgggtcgtacgaaactaaacagaccggatctgccagttccatggtgaacggcgttgtaagactgctaacaaagccttgggacgtggtccccatggtgacccagatggctatgactgatacgacaccatttggtcagcaacgcgttttcaaagagaaggtggacaccaggactcaggagcctaaagaagggaccaagaagctcatgaaaattacagcggagtggctgtggaaggaattgggcaaaaagaaaacgccccggatgtgtaccagagaggagtttactcgcaaggtcaggagcaatgccgcactgggcgctatcttcacagatgaaaacaaatggaagtcagcccgagaggcagtggaagactcccggttttggaagctcgtagataaagagagaaaccttcacctggaaggcaagtgcgagacctgtgtgtataatatgatggggaaaagggagaagaaattaggagagttcggtaaggccaagggctctcgcgctatatggtacatgtggctgggggccagatttttggagttcgaagcgctcggatttctgaacgaggaccactggttcagccgggaaaatagtctatccggcgttgagggtgaggggcttcataaactgggatacatcctcagagacgtcagcaagaaagaaggcggcgcaatgtatgccgatgacactgctgggtgggatacaaggattaccctggaggacttgaagaacgaagagatggtgacaaatcacatggaaggagagcataaaaagctggccgaggcaatctttaagctcacttaccagaacaaagtggtccgcgttcagcgaccaacaccccggggtacggtgatggatattatctctagaagggaccaacgcggctcagggcaggtaggaacctatggccttaatacattcactaacatggaagctcagctgattagacaaatggagggtgaaggggtgttcaagagtatacagcggttaaccgtcacagaggagatcgccgtgcagaattggctggctagggttggacgtgaacgattgtcccgcatggccattagcggcgatgactgcgtggtcaaacctctcgatgacagatttgcatctgcgctgactgccctaaacgatatgggcaaggtgcggaaagacatccagcaatgggagccatcgagggggtggaatgattggacccaggtaccgttctgctcacaccattttcacgaacttatcatgaaggacggacgcgttctggtggtcccctgtagaaaccaggacgagctcattggtcgggctaggataagccagggcgccgggtggtccctgaaggaaacggcatgcttgggaaaaagttacgctcaaatgtggtctttaatgtatttccaccgacgtgatctgagactcgccgcaaatgccatctgtagcgcggtgccttcccattgggtgccaacatcacgcaccacttggagtattcacgctaagcatgagtggatgacaaccgaggacatgcttactgtctggaaccgggtttggatccaggaaaatccctggatggaggataaaacccctgtggaatcttgggaggaagtaccatacctgggcaagagggaggaccagtggtgcggtagcctaattgggctgacatccagagccacgtgggccaaaaatatccagaccgccataaaccaagtgcgctcactcatcggaaatgaggaatatactgattacatgcccagcatgaagcggtttaggcgagaggaagaggaagctggcgtcttgtggtga

SEQ ID NO: 14864 - RNA, 9876 nt, synthetic construct
  misc_feature 1..9876: note = derived and/or modified CDS sequence (opt3) from DENV-2__EU482782__SS-prME
  source 1..9876: mol_type = other RNA
agcgccggaatgatcattatgctgataccaaccgtgatggctttccacctcactactagaaacggggaacctcatatgatcgtcggtattcaagaaaagggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccacatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatatacgggggatcatgcaagccggaaaacgctcgctcagacctcagccaaccgagctgaagtacagctggaagacatggggcaaagctaagatgctttccacggaatcatataaccagaccttcttgattgacgggccggagactgccgagtgccccaatacaaacagggcatggaatagtctggaagtggaggattacggatttggcgtgttcaccacaaacatctggctcaaactgaaggaaaaacaggacgcgttttgtgactctaagttaatgagcgctgccattaaggataatcgtgcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatccccaagaacctcgcaggacccgttagtcaacacaattaccggcctggctaccacacgcagattgctggtccatggcatctgggcaagctagagatggacttcgatttttgtgacgggacaaccgtgatcgtcactgaagattgcggaaaccgaggccccagcctgagaaccacaactgcctctgggaagctcattaccgagtggtgctgtaggtcctgcacactgccgcctcttcgctatcggggagaggacggctgttggtacggtatggaaataagaccattgaaagagaaggaagagaatctggtgaactcattagttacggcggggcacggacaggtggataatttcagtctcggcgtactgggtatggccctttttctggaagagatgttgaggacccgcgtcggcactaaacatgctatcctcctggtggcagtgagcttcgtcacactaattaccgggaacatgtcgtttaaggacctgggacgagttgtggtaatggtgggcgccactatggctgatgacatcgggatgggagtcacatatctcgccctgcttgcagcgttcaaagtgcggcccacctttgttgccggcttgctgttacgtaagctcacgtccaaggagctgatgatgactaccattggtatcgtgcttctgtctcaaagcacaatacctgaaaccgtcctagagctcactgatgctctggccttggggatgatggtgctgaaaatcgttagaaatatggaaaagtaccagttagcagtgacaattatggctatcctctgcgtccccaacgccgtaattctgcagaatgcatggaaagtgtcatgtaccatccttgccgttgtgagtgtctccccactgttgctcacatctagccagcaaaagactgactggatacctctggctctaaccattaaaggactgaaccccacggcgatcttccttacaaccctctccaggactaataagaaacgctcatggccactgaacgaggccatcatggcagtgggcatggtaagcattttggctagttctctgttaaagaatgacataccgatgaccggccctctcgtggccgggggactgcttacagtctgctatgttctgactggtcggtccgccgatttggaactcgagagagctaccgacgtgaagtgggaggatcaggcagaaatcagcggctcgtcacccattctgtctatcacgattagtgaggacgggtccatgagcatcaaaaacgaagaggaggaacagacactaaccatactgatcaggactggacttctcgtgatttctggcctgtttccaatcagcattcccatcacagccgcggcttggtacttgtgggaggtcaagaaacagcgagccggtgtgttatgggatgttccttccccaccccctatggggaaggcagaactggaggacggagcctatcgcataaaacaaaagggcattctcggctactcacagatcggggctggagtatacaaggaaggtaccttccacactatgtggcatgtgacacggggcgcagtcctgatgcacaaagggaagagaatcgagccgagttgggccgatgtgaaaaaggaccttattagctatggaggcggttggaaactggagggggaatggaaggagggagaagaggttcaggtgttggcgctagaaccaggcaagaatcccagggctgtccagaccaaacctggcctgtttaagacgaacactgggaccatcggagccgtgtctctcgatttctccccaggtacatcaggcagtcccataattgacaaaaaggggaaagtagtcggactgtacggcaacggtgtggttacccgtagcggggcatatgtgtccgccatcgctcaaacagagaagtctattgaggataatcctgaaatcgaggacgatatatttcgcaagcggagacttactattatggacttacacccgggagccggcaaaaccaagaggtacctgcccgcaatcgtccgagaagctatcaaacggggcctccgcacgttgattctggccccaacaagagtggttgcggccgagatggaagaggcactcagggggctgcctatccggtatcagactcccgctattcgagccgagcataccggaagagaaatagtggaccttatgtgtcacgctacattcaccatgcgcctgttgtcgccagtcagggtgcctaactacaatctaatcattatggatgaggcacatttcactgaccccgccagcatcgccgctcgtggttatatctcaacccgggtagaaatgggcgaggcggcagggatttttatgacagccacgccaccgggatccagagatcctttcccccagagtaacgctccaataatcgacgaggaaagggagattcccgaacgctcttggaatagcggccacgagtgggtgactgattttaagggtaaaaccgtttggttcgtcccttccatcaaggccgggaacgacattgcagcctgcctgcgaaagaatggcaagaaggtgatccaactctcaagaaaaacatttgattctgaatacgtgaagacccggactaacgactgggatttcgtcgtaacaaccgacataagcgagatgggcgctaattttaaagcggagagggtgatcgatccacgccgttgtatgaagcccgttattttaacggacggcgaagagagagtgatcctggccgggcctatgccggtcactcatagttccgcagctcagcggaggggacgcattggtcgaaaccccaaaaatgaaaacgaccagtacatctatatgggcgagccccttgaaaatgatgaggactgcgcccactggaaggaggcaaagatgctgctcgataacataaatacacctgaagggattatccccagcatgttcgagccagaaagagagaaagtggacgccattgatggagaataccggttgaggggcgaggctcgcaagacctttgttgacctgatgagaaggggtgatctccctgtgtggctggcctataaagtcgcggcagaggggatcaactacgccgaccggcgttggtgtttcgatggcataaagaacaatcagatccttgaagagaacgtggaagtagagatttggaccaaagagggagaacgcaagaagctaaaaccccgatggctggacgctagaatctattctgatccattggccttaaaggagtttaaagagttcgctgcaggcaggaagtcactgactctcaatctgattacagagatggggcggcttcctaccttcatgacacagaaaactcgcgacgccctggataacctcgctgtgttgcacacggccgaagcaggaggtagagcgtacaatcatgccctgtccgagctaccggagaccctggaaacactccttctgttaactttgctggctaccgttacaggcgggatctttctcttcctgatgagtggaaggggcataggtaagatgacccttgggatgtgctgcattatcactgccagcatcctgctctggtatgcacagattcagccccactggatcgctgcctcgataattttggagtttttcctgatcgtcttactaattccagaacctgagaagcagcggacgccccaagacaaccagctgacctacgtggtgatcgcaatactcacagtcgttgccgctactatggcgaatgaaatgggctttcttgagaaaaccaagaaagacctgggattgggctctatcgccacacagcagccagagtccaacattctggatatcgacctccgacctgcaagcgcttggaccctgtacgccgtggccactacattcgtaacgcccatgcttagacattcaattgaaaatagttctgtgaacgtctccctcaccgcaatcgctaatcaagccactgtgctgatggggttgggaaagggttggccgctgagcaaaatggatattggcgttccattactagcgatcgggtgttattcacaggtgaaccctataacactgaccgctgccctccttctgttggtcgcacactacgccattatcggacccggcctgcaggctaaggcaacccgcgaggcccagaagagggcggctgccggtatcatgaaaaatccaacagtagacgggattactgtgatagatctcgaccccatcccttatgatccgaagtttgaaaaacaactgggccaggttatgcttttaattctgtgcgtgacgcaggtcctcatgatgcggaccacatgggcattgtgtgaggccctgactctagctaccggacccatcagtacactgtgggaaggcaacccagggcgtttctggaataccactattgccgtgagcatggcaaacatctttagaggatcctacctcgctggcgccggtcttctgttctctataatgaagaatacgacaaacaccaggcgcgggactggaaacatcggcgagaccttgggtgagaaatggaaaagccggctgaatgcgctcggcaaatccgaatttcaaatttataagaagtcagggatccaggaggtcgaccgaacactggccaaagaaggaattaagagaggcgagactgatcaccatgcagtgtctagggggagtgctaaattacgctggttcgttgagcggaacatggtgacccctgaaggaaaggtagtggaccttggctgcggtagagggggatggtcgtactattgtggcggtctgaaaaatgtccgtgaggttaagggcctcacaaaagggggacccggccacgaagaacctatcccaatgagcacgtacgggtggaacctagtgaggctgcagtccggagtcgatgtgtttttcataccccctgaaaaatgcgacaccttgctgtgtgatattggcgagtcttcaccaaatcccactgtagaggccggtcggacactccgcgtgcttaacctggttgaaaattggttgaacaataacacccagttctgcatcaaggtgctgaatccgtacatgcctagcgtcatcgagaaaatggaagcactccaacgaaagtatgggggagctttagtgagaaacccactgtccaggaatagtactcatgagatgtactgggtctctaacgccagcggcaatattgtgtcatccgttaacatgataagtcggatgcttatcaaccgctttacaatgagacacaaaaaggccacctatgaacccgacgtagacctgggcagcgggacgaggaatattggaatcgagtctgagattcctaacctagatatcataggtaagcgaatcgagaaaattaagcaggagcatgaaacctcctggcactacgaccaggatcacccatataaaacatgggcgtaccatggctcatatgagactaagcagaccgggagcgcttcgtctatggtgaatggagtcgtgcggctcctgacaaaaccctgggacgttttgccgactgtgacccaaatggcaatgacagataccactcctttcggccagcagcgtgtctttaaggaaaaggtggacacgagaacacaggagcccaaagagggtaccaagaaactgatgaagatcactgccgaatggctctggaaagagcttgggaagaaaaagaccccacgcatgtgtacaagggaagagttcacgcggaaggtaagaagtaacgctgccctgggagcaatttttaccgatgagaataaatggaagtccgcccgcgaagctgtggaggacagcaggttctgggaattagttgataaagagcgaaacctgcacttggaaggcaagtgcgagacttgtgtctacaatatgatgggcaaacgggagaagaagctcggggaatttggaaaagcgaagggttcaagagccatctggtacatgtggctgggcgcaaggttcctagagtttgaagctcttgggttcctgaacgaggaccattggttttcccgcgaaaattctctcagcggagtggagggcgagggtctgcacaaattggggtatattctgcgtgatgtgagtaagaaagaaggaggcgccatgtacgcagacgacacagccggctgggatacccggataactctcgaggaccttaagaacgaagagatggtcacaaatcacatggaaggggagcataagaaactggctgaggccatcttcaagttaacctatcaaaacaaagttgtgagagtacagaggcctacaccccgcggaactgtgatggatattatctcccgacgggaccagagaggtagcggccaagtcgggacctacggactgaatacgtttaccaacatggaagcgcagttgatcaggcagatggagggcgaaggtgtgttcaagaatattcagcacctcacagttactgaggaggtggcagtccataactggctggcccgcgtggggagagaacggctatctaggatggctatatcaggagatgactgcgtagttaaaccacttgatgaccgtttcgccaacgcactgaccgctctcaatgatatgggcaagatccgaaaggacattcaacagtgggagcccagtaaaggctggaacgattggacacaggtgcctttttgctcccaccatttccacgaactgatcatgaaggacgggcgcgtcttggtggtgccatgtagaaatcaggatgagttaattggacgggccaggatcagccaaggtgctggctggtctctgcgcgaaactgcctgcctcgggaaatcgtatgcacagatgtggtcacttatgtactttcacagacgggacctgaggctagcggccaacgctatatgtagcgccgtcccgtcccattgggttcccaccagtcgaacgacatggtctatccacgcaaagcatgagtggatgaccactgaggacatgctgacagtgtggaatcgtgtatggattagagaaaacccttggatggaggataaaaccccagtggaaagctgggaggaaatcccctatctcggaaagcgcgaggaccagtggtgcggctccttgattggtctgacttcacgggctacctgggccaagaatatccaggcagccataaaccaagtcaggagtcttattgggaatgaggaatacacagattacatgccttctatgaaaagattccgccgggaggaagaggaagcgggagtgctgtggtga

SEQ ID NO: 14865 - RNA, 9876 nt, synthetic construct
  misc_feature 1..9876: note = derived and/or modified CDS sequence (opt3) from DENV-2__EU482783__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgcccagaggatcgagacctggatactgcggcatcctggcttcacaatcatggcagccattttggcttacaccgtgggcacgactcactttcagcgcgcactcatcttcattctgctggccgctgttgccccatccatgacaatgagatgcatcgggatatctaacagggattttgtggaaggagtctcgggtggctcatgggtggacattgtactcgagcacgggagctgtgttaccactatggcgaagaataagcccacattagatttcgaactgatcaaaaccgaggcaaagcagcctgccacgcttcggaaatattgcattgaagctaagttgaccaacacaactaccgagagtcgctgtccaacacaaggagagccctccctgaatgaagagcaggacaaacgatttgtgtgcaagcattctatggtcgatagaggctggggtaacgggtgtggactattcggcaagggcgggatcgtgacttgcgccatgtttacctgcaaaaagaatatggaaggaaaaatcgtgcagcctgagaacctcgaatacacaattgtcataaccccacacagcggtgaggagcatgcagttggcaatgacactgggaagcacggaaaagaaatcaagattacgccgcagtcccccatcacagaggctgaactgaccggctatggtactgtgaccatggagtgttcacctaggacagggcttgatttcaacgaaatggtactgttgcaaatggaggacaaagcctggctcgtgcaccggcagtggtttctggatttaccactgccctggctccctggcgcggacacccagggaagtaattggatacagaaggagactcttgtcacattcaagaacccacatgccaaaaagcaagacgtggttgtgctgggcagccaggaaggggcaatgcacacggctttgaccggagccactgagattcagatgtcttccggtaatctactgtttacaggccatctcaaatgccgtctgcgcatggataagcttcaactgaaagggatgtcatacagcatgtgtaccggaaagttcaagatcgtcaaagaaatcgctgagacacagcacggcactattgtgatcagagtacagtatgagggtgacgggagtccctgcaagattccgttcgaaataatggatttggagaaaaggcatgttctcggccggctgatcaccgtgaaccctattgtcacggaaaaggactctcccgtgaacatcgaggccgaaccaccttttggagattcctacatcattataggcgtcgagcccgggcagttaaaactgaattggttcaagaagggaagctcgatcggtcaaatgtttgagaccacaatgcgaggcgcaaaacgcatggccattctaggggacactgcttgggatttcggatctctcggcggtgtgtttacctccatcgggaaggcgctgcaccaggttttcggcgcaatttacggagccgctttttcaggcgtgagttggacaatgaaaatccttataggggtaatcattacttggatcggaatgaacagcagatccacctctttgagcgtctcactggtgctcgttggcgtgattacgctgtatcttggtgccatggtccaggcagacagtgggtgtgtggtatcctggaagaataaagaactgaagtgcggaagcggcatcttcataacagataacgtgcacacctggactgagcagtacaagtttcaaccagaatctccctcaaaattggccagtgctattcagaaggcccatgaggaaggtatctgtggcattaggagcgttacacggctcgagaatctgatgtggaaacagatcacccctgagttaaaccacatactgtccgaaaatgaggtcaagctaactatcatgaccgggggaattaaaggcatcatgcaggcagggaagcgctctctcagaccacaaccgacagaactgaaatattcgtggaagacgtggggaaaggcgaaaatgcttagcaccgagtcccataaccagactttcttgattgacggccccgaaacagctgagtgccctaataccaacagggcctggaattcactggaggtggaagattacggttttggggtgttcacaactaacatctggctcaagctgcgtgagaaacaggacgtcttttgtgacagtaagttaatgtctgcagccataaaagataatcgggctgttcacgccgacatgggatattggattgaaagcgcactgaacgatacctggaagatggagaaggcttccttcatcgaggtgaaatcatgccactggccaaagagccatacgctttggtctaatggcgtgttggaatccgagatgatcattcccaaaagtttcgccggtcctgtaagccagcacaactaccgaccaggctattacacacaaaccgcggggccctggcatctcggaaagctggaaatggactttgatttctgtgagggcactaccgtcgtggttacagaagactgcgggaacagaggaccgtctctaaggactaccacagcctccggcaaactgatcacggagtggtgctgtcgctcatgcaccctccctccactgcggtacagaggtgaggatgggtgttggtatggaatggaaattaggccccttaaggagaaggaagagaatttggtgaacagtctggtcactgctggccacggtcagatagacaattttagcttaggcgtgctcgggatggcactgttccttgaagagatgctgcgcacacgagttggaaccaaacatgccatcttgctcgtgactgtatcgtttgtcacactgattaccggcaacatgtccttccgggatctagggcgtgtgatggtgatggtcggagctgccatgacggacgatatcggcatgggtgttacttacctggcactcctggcggcctttaaggtgagacctaccttcgctgccgggcttttgctgaggaaattaacatctaaggagctcatgatggcaaccattggaatcgctctgcttagccagtcaactatacccgaaacaatcctggagctaaccgacgccctcgcactgggcatgatggtattgaaaattgtgcgcaatatggaaaagtatcaactggccgtcacaatcatggctattagttgcgtgccaaacgcggttatcttacagaatgcctggaaggtgtcctgtactatactcgcagctgtctctgtgagccctctgcttctgacctcctcacagcagaaagccgattggattcccttggccctcacgatcaagggcctgaacccaacagctatctttctaaccactctgagccggaccagtaaaaagagatcttggccgcttaatgaggcaattatggccgttgggatggtgtccatactcgcgagctcgctgttgaaaaacgacatccctatgacaggacccctggtcgctggtggcttactcactgtatgctacgtgctgaccgggaggtcagccgaccttgaactggagcgagcaacggatgttaagtgggaggaccaagccgaaatttctggaagttccccaatcttgagcattacaatcgctgaggatggctctatgagcataaaaaatgaagaggaggaacagaccctcactatcctgattcgcacaggtctactggtgatctccgggcttttccccgtctcaattcctatcaccgcagccgcgtggtatctctgggaggtgaagaagcagcgggctggagtactgtgggacgtgccaagtccccctccggtcggcaaagccgaattggaggatggcgcatacagaataaagcagaaagggattttaggatatagccaaatcggtgccggcgtttacaaggaagggacttttcacacaatgtggcacgtgaccaggggagctgtgctgatgcatcgtggcaaacgcatcgagccatcttgggccgacgtcaagaaggatctcatttcctacggtgggggatggaaactggagggcgaatggaaggagggcgaagaggtgcaggttcttgcactggaacccgggaaaaaccctcgggctgtacagacgaagccaggattgttcaaaactaataccggtacaatcggcgccgtgtcactagactttagtcccgggaccagcggatcccctatagtcgatagaaagggcaaggtggttggtctgtatgggaacggagtggtcacaaggtctggcgcgtacgtgtcggccattgcacagactgagaaaagcatcgaggacaatccggaaattgaggatgacatcttccgaaagaaacggctcaccataatggatctgcaccccggcgctgggaagacgaaacgctatcttccagccattgtaagagaagctatcaagaggggattacggacactgatcctcgcacctactcgagtcgtggccgccgagatggaagaggctttgagaggtctgcccattcgctaccaaaccccagcgatcagggcagagcatacaggccgtgaaattgttgacctcatgtgtcacgccaccttcactatgcggctgctttcacctgtgagagtccccaactataacctgataatcatggacgaggctcattttaccgatccagcctccattgcagccagggggtacatcagtacacgcgtggaaatgggagaggctgcgggcatcttcatgacggccactccgcctggttctcgagacccctttccacagagcaatgcacccattatggatgaggaaagagagatacctgaacggtcctggaactcagggcacgagtgggttaccgacttcaagggaaaaacagtgtggtttgtcccatctatcaaggctggcaatgatattgccgcatgcttgaggaaaaacggcaagaaagtgatccagctaagccgcaagaccttcgacagtgaatatgtaaagactcgtacaaatgattgggactttgtggttaccacggatatttccgagatgggggccaacttcaaagctgagagagtcatcgacccccggaggtgtatgaagcctgtgatactgactgatggagaagagcgcgtgatcctcgccggtccgatgccagtcacacacagctctgcggcacaacgaagaggccggattgggaggaatcccaaaaacgaaaatgaccagtacatctacatgggagagcctttagaaaacgacgaggattgcgcccattggaaggaggctaaaatgctgcttgacaatattaacacccccgaaggcatcataccatcaatgtttgagcctgaacgcgagaaggtagatgccattgacggtgaatatagactgaggggggaggctcggaaaaccttcgtggatctcatgcgtcgcggcgacttgcccgtttggctggcataccgagtggccgctgagggaatcaattatgccgatagaaggtggtgttttgacggcgtcaagaacaatcagattctcgaagagaacgtggaagttgagatctggactaaggagggggaacggaaaaagctgaaaccacgctggcttgatgcaagaatatactccgaccctctagcgctgaaggagttcaaagaattcgccgctggaaggaagagtttgacattaaacctgatcaccgagatgggtcggctcccgacatttatgactcagaaggcccgagatgcactggacaatcttgctgtgctgcacacggccgaagcaggcgggagagcctataaccatgctctcagcgagttgcccgagaccctggaaacactactgctccttactctgttagcgaccgtcacaggaggcattttcttgtttctgatgtcgggtaaaggggtgggcaagatgaccctcggaatgtgctgcatcattactgcctctatcctgctttggtacgcacaaatacagccacactggattgctgcctccatcatcctggagttctttctcattgtattgctgatccctgaacccgagaaacagcgcacgccacaggataatcaattaacctatgtggttatagccattctaacagtcgtggcagctactatggccaacgaaatgggcttcctggagaagaccaaaaaggacctcgggcttggaagcatcgcgacacaggagcctgaatcaaatattctggacatcgatttgaggcccgctagtgcctggaccctgtacgcagtggccactacatttgtcacgccgatgctccggcactctatagagaactccagcgttaatgtgtcactgaccgctatcgcaaaccaggccactgtacttatgggtctcggcaaggggtggccactgagtaaaatggacattggagtgcctttgctggcgatcggctgttacagccaggtcaatcccattacattaaccgctgccctactgctccttgtggcacattatgccatcattggtccagggctgcaagctaaggccacccgtgaagcacagaaaagagctgccgcgggcatcatgaagaaccccacagttgatggaataactgtgattgacttggatcctatcccgtacgaccccaaattcgagaagcagctgggccaggtcatgctcctgatcctttgcgtaacgcaagtgttaatgatgaggaccacatgggccctgtgtgaagcactcactttggctaccgggccaatttccacactgtgggagggaaatcctggccgcttttggaacaccactatagccgtttctatggcaaatatcttccggggtagctatctagctggggccggactgctcttttccattatgaagaacacgacaaatacccgaagaggcactggtaacatcggcgagacccttggggaaaaatggaagtcaaggctgaatgccttgggaaaatctgagttccagatttacaagaaaagtggcatccaggaagtggatcgcacactggcgaaggaggggataaaacggggagagactgaccaccatgctgtctcgagaggcagcgcaaagctccgttggtttgtggaaaggaacatggtcacccccgagggtaaggtggttgatctggggtgcggacggggcggttggtcctattactgtggcgggttaaaagacgtgcgcgaagtaaagggacttacaaaaggcgggcctggacacgaggaaccaatccccatgtctacgtatggctggaacctggtgcgactccaatcaggtgtcgatgttttcttcacccctccagagaagtgcgacactctactgtgtgatattggggagagctcccccaatccgacaatcgaagccggaagaaccttgagggtgctgagtctcgtcgagaactggcttaataacgacactcagttttgcattaaagtgctgaatccttacatgccatctgtaatcgaaaagatggagacattgcagcggaagtacggcggcgctctggtgcgcaaccccctcagcagaaattcaacccatgaaatgtattgggtttccaacgccacggggaatatagtgagtagcgtcaacatgatttctaggatgttaatcaatcgattcaccatgaaacacaagaaagcaacatacgagcctgacgtggatctgggatccggtactcggaacatcggcattgagtcagaaataccaaatcttgacatcattgggaagcgtatcgagaaaattaagcaggaacacgagaccagctggcattatgatcaagaccacccctacaagacatgggcctatcatggatcgtacgaaactaaacagaccggctctgctagttccatggtcaacggtgtggttagactgctaacaaagccgtgggatgtagtgcctatggtcacccagatggcgatgactgacacgacaccctttgggcagcaacgcgtgttcaaagagaaggttgataccaggactcaggagccaaaagaaggaaccaagaagctcatgaaaatcacagccgagtggctgtggaaggaattgggcaaaaagaaaacgcctcggatgtgtaccagagaggagtttactcgcaaggtgaggagcaatgcagctctgggcgccatattcacagacgaaaacaaatggaagtcagcacgagaggccgtcgaagattcccggttttgggagctcgtggacaaggaaagaaaccttcacctggaggggaaatgcgagacctgtgtatataatatgatgggaaagagggaaaaaaagttaggtgagttcggcaaagctaaggggtctcgcgccatctggtacatgtggctgggagcgcgttttttggaattcgaggcactcggctttctgaacgaagatcactggttcagccgggagaatagtctatccggtgtggagggggaaggacttcataagctgggctacattctcagagacgttagcaaaaaggagggcggggccatgtatgctgacgatactgccggatgggacacaaggatcaccctggaagatttgaaaaacgaggaaatggtcacaaatcacatggagggtgagcataagaaactggcagaagctatttttaagctcacttaccagaacaaggtggtgcgcgtccagcgacccaccccacggggcacggttatggacatcatttctagaagggatcaacgcgggtcaggacaggtgggcacctatggtcttaatacattcactaacatggaggcccagctgataagacaaatggaaggggagggagtattcaaaagtatccagcggttaaccgtgacagaggaaattgctgtccagaattggctggccagggtgggccgtgagcgattgtcccgcatggcaatcagcggcgacgattgcgttgtgaagcccctcgacgatagatttgcgtctgccctgactgctctaaacgacatggggaaagtccggaaggatatccagcaatgggaaccttcgaggggatggaatgactggacccaggtgccattctgctcacaccattttcacgagcttattatgaaagatggtcgcgtactggttgtgccgtgtagaaaccaggacgaactcataggccgggccaggatcagccagggggcaggatggtccctgaaggagacggcttgcttgggcaagagttacgcccaaatgtggtctttaatgtatttccaccgacgtgacctgagactcgcagccaatgcgatttgtagcgctgtcccctcccattgggtgcctacatcacgcaccacttggagtatccacgccaaacatgagtggatgacaaccgaagatatgcttactgtgtggaaccgggtctggattcaggagaatccatggatggaagacaagacccccgttgagtcttgggaagaggtgccttacctgggtaaaagggaggatcagtggtgcgggagcctaatcggactgacatccagagcaacgtgggccaagaacatacagaccgctatcaaccaagtacgctcactcattggcaatgaagagtatactgactacatgccaagcatgaaacggtttaggcgagaagaggaagaggccggcgtgttgtggtga

SEQ ID NO: 14866 - RNA, 9876 nt, synthetic construct
  misc_feature 1..9876: note = derived and/or modified CDS sequence (opt3) from DENV-2__EU482784__SS-prME
  source 1..9876: mol_type = other RNA
agcgccggcatgatcattatgctgataccaaccgtgatggctttccacctcactactaggaatggggaacctcatatgatcgtcggtattcaagaaaagggaaaatcccttctgtttaagacggaggacggcgttaatatgtgcaccttgatggcaatggatttaggggaactgtgtgaggacacaatcacttacaaatgcccacttctcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaggaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatatacgggggatcatgcaagccggaaaacgctcgctcagacctcagccaaccgagctgaagtacagctggaagacatggggcaaagctaagatgctttccacggaatcatataaccagaccttcttgattgacgggccggagactgccgagtgccccaatacaaacagggcatggaatagtctggaagtggaggattacggatttggcgtgttcaccacaaacatctggctcaaactgaaggaaaaacaggacgtattttgtgactctaagttaatgagcgcggctattaaggattcccgtgccgtccatgcagacatgggttattggatcgagtcagccctgaatgatacttggaaaatagagaaggctagcttcattgaagtgaaatcttgccactggcctaagtcccataccctttggagtaacggggttttggagagcgaaatgatcatccccaagaatttcgccggacccgtgtctcaacacaactaccggcctggctaccacacgcagacagcaggtccatggcatctcggccgactggagatggactttgatttctgtgaagggaccactgtcgtggttaccgaggactgcggaaacagaggcccctccctaaggacaactaccgcttcagggaagctgattacagagtggtgctgtcgcagttgcacgctcccgcctctgcggtatagaggagaagatggctgttggtacggtatggagatcaggccacttaaggaaaaagaggaaaatttggtgaacagcctggtaaccgccgggcacggacagattgacaatttttcgttaggcgtcctcggtatggcgctgttccttgaggagatgctgcgcactcgaataggcacaaagcatgccatcttgctcgtggctgtgtcctttgtcaccctgattactgggaacatgtctttccgggatctaggacgtgttatggtgatggtaggcgcaacaatgaccgacgatatcgggatgggagtgacgtatctggccctcctggctgcctttaaagtcagacccactttcgcagcgggccttttgctgaggaagttaaccagcaaagaactcatgatgacaaccattggtatcgtgctgctttcacaaagtactatacctgagacagttctggaactaaccgacgccctcgctctggggatgatggtgttgaagatcgtccgcaatatggagaagtaccagctggccgtgacaattatggcaatcttatgcgttcccaacgctgtgattctccagaatgcctggaaagtctcctgtactatcctggcagtagtgtctgttagcccacttctgttgacctcctcacagcaaaagacggattggatacctctcgccctgacaattaaaggactaaaccccaccgctatctttctgactacccttagccggacaaataagaaaagaagttggccactcaacgaagcgatcatggccgtgggcatggtctctattctggcatccagcttgctgaagaatgacataccgatgactggccctttagtggctgggggactcctgaccgtatgctatgtgcttacgggtaggtcggccgacctggagttggagcgagccacagatgtcaaatgggaagaccaggctgagatctcaggctctagtcccattctctccatcaccattagcgaagatgggtctatgagcatcaagaacgaggaggaagaacagactctgacaatactaatccgcaccggactgcttgttatttccggcctcttcccaatctcaattcccatcactgcagccgcgtggtacctgtgggaagtgaagaaacagcgggctggtgtgttgtgggacgtccctagtccaccccctatggggaaggccgagttagaagatggagcatatagaataaaacaaaagggcattctgggctacagccagatcggggccggagtgtacaaagagggtacatttcacaccatgtggcatgttacgaggggcgctgtactcatgcacaaggggaagcgtatcgagccgtcttgggcagacgtgaaaaaggatctgatttcctatggaggcggttggaaacttgaaggggagtggaaggaaggagaggaagtccaggtgctggccttggagccaggcaaaaatccccgcgcggttcagactaagcctggcctattcaagaccaacacagggaccatcggagctgtgtcactggactttagtccaggtacaagcggctcccccataattgataaaaaggggaaagtcgtgggactctacggcaatggtgtagtcactcggtctggggcctatgtgtcggcaatcgcccaaaccgaaaagagcattgaagacaaccctgagatcgaagatgacatattcagaaaaaggcgactgacgattatggatcttcacccgggagctggcaagacaaagcggtacttacccgccatcgttcgcgaggcaatcaaaagaggcctgaggactctcattttggctccaacccgggtggtcgccgcggaaatggaggaggccctgcgagggctccctatcagatatcagacacccgcaattcgcgctgaacataccggaagggagatagtggacctgatgtgtcacgccactttcaccatgcgtcttctgtcaccagttcgggtgcctaactacaatttgatcattatggacgaagctcattttacagatcccgcatccatcgccgccagaggttatatcagtacgagggtcgagatgggcgaggctgcggggattttcatgactgcaaccccaccgggatctcgcgacccttttccccagagcaacgccccaataatcgatgaagaacgagaaattcccgagagatcctggaactcaggccacgaatgggtgacagacttcaagggtaaaaccgtatggtttgtgccttctatcaaggctgggaacgatattgccgcatgcctacggaaaaatggaaagaaggttatccaactgagcaggaaaactttcgacagtgagtacgtcaagacacgcaccaacgattgggactttgtggtgacgactgatatatccgagatgggcgccaatttcaaagctgaacgtgtcatcgacccaagacggtgtatgaagcccgtaattctcacagatggcgaggaaagggtgatcttagcggggcctatgccggttacccatagctctgccgcacagcgccgaggaagaattggtcggaaccccaaaaatgagaacgaccagtacatctatatgggcgaacccctggagaatgacgaggattgcgctcactggaaggaagccaaaatgcttctggacaacataaatacccctgaggggattatcccctcaatgtttgaaccagagagggaaaaggtggatgcaattgacggagagtaccgcctcagaggcgaggccaggaagactttcgtcgatttgatgcggcgtggtgacctgcctgtgtggctcgcttataaagttgccgcggaagggatcaactacgcagatcgccgatggtgttttgacggcataaagaataaccagatcctggaggaaaacgtggaggtcgagatttggacaaaagaaggagagagaaagaaacttaagcccaggtggctagatgcccggatctattccgacccactggctttgaaggagttcaaagagttcgccgctggccgcaagagtttaaccctgaatctcattacagaaatggggagactgcctacttttatgacgcagaaaaccagggatgcacttgacaacctggccgtgctccacacagctgaggccggaggtcgggcatacaatcatgcgttgagcgagctgccggaaactctagagaccctgctccttctgacattattggccaccgtaactggcgggatcttcctgtttctcatgtcgggacgaggcataggtaagatgacgctggggatgtgctgcattatcaccgcttctatccttctgtggtatgcccagattcagccccactggatcgcagcttccataattctcgagttctttttgatcgtgctgttaattccagagcctgaaaaacagagaacaccccaagataaccagctaacttacgttgtcatcgccatactgaccgtggtggcagccacaatggctaatgagatgggcttcctcgagaagaccaagaaagaccttggactgggcagcatcgcgactcagcagccagaatcaaacattttggacatcgatctgcgccctgccagtgcatggacactctacgctgtcgccacgacctttgttactcccatgctgaggcattctattgaaaattccagcgtgaacgtatcacttacagccatcgcaaatcaagctaccgtgctcatggggctgggaaagggttggccgttgagtaaaatggacattggcgtcccactgttagccatcgggtgttatagccaggtgaaccctataaccctaacagcggctctgctccttctggttgcccactacgcaattatcggacccggcttgcaggccaaggctactcgggaagcacagaaacgtgccgcggctggtatcatgaagaatccaacggtggatgggattaccgtcatagacctggatcccatcccttatgacccgaagttcgagaaacaactcggccaggtaatgctgcttattttatgcgtgacacaggttctgatgatgagaactacctgggccctctgtgaagcattgacactggccaccggacccatctccactctatgggagggcaacccagggaggttttggaatacgacaattgctgtgtctatggccaacatcttccgcggaagctacctggcaggcgctggtctcctattttccataatgaagaataccactaacacccggcgagggacaggaaatatcggcgagactctgggtgaaaaatggaagtcaagattgaacgccctgggcaaatctgagttccaaatttataagaaaagtgggatccaggaagtcgataggaccctcgcgaaggagggaattaagcgcggcgagacagaccaccatgccgtgtcgcgggggagcgcaaaactgagatggtttgtcgaacgtaacatggtgacgcctgagggaaaggttgtggatttaggctgcggtagagggggatggtcctactattgtggcggtcttaaaaatgtacgggaagtgaagggcctgaccaaagggggacccggccacgaggaacctatcccaatgtctacttacgggtggaacctcgtccgcctacagtcaggagttgacgtgttcttcataccccctgagaagtgcgatacactgttgtgtgacattggcgagagctccccaaatcccaccgtcgaagctggtcgaactctgagagtgctcaaccttgtagagaattggctgaacaataacacacagttttgcatcaaggtgttgaatccgtacatgcctagtgttatcgagaaaatggaggccctgcaaaggaagtatgggggagcactcgtgcggaacccattatctcgcaatagcacccatgaaatgtactgggtctcaaacgcttccggcaatattgtgagtagcgtcaacatgatatctagaatgctgatcaataggttcacgatgcgacacaaaaaggccacctatgagcccgatgtggaccttggctccgggacacggaacattggaatcgagtcagaaattcctaacctggacatcataggtaaacgtatcgagaagattaagcaggaacatgagactagctggcactacgatcaggaccacccatataaaacctgggcctaccatggctcgtatgaaacaaagcagactgggtctgcgagttccatggttaatggagtagtgagactactcaccaaaccctgggatgtcctgccgacagtgacccaaatggctatgactgacacgacaccttttggccagcagcgcgttttcaaggagaaagtggataccaggactcaggagcccaaggaaggtaccaagaaattgatgaagatcacagcagagtggctgtggaaagaactcgggaagaaaaagacgccacggatgtgtaccagagaggagtttactcgcaaagtcaggagcaacgccgctcttggagccattttcacagacgaaaataagtggaagtcagcacgagaggccgtggaagattcccggttttgggagctggtagacaaagaaagaaacttacacctggagggcaagtgcgagacctgtgtgtacaatatgatgggcaaaagggaaaagaaattgggggagttcggaaaggctaagggttctcgcgcgatctggtacatgtggctcggcgcccgttttctggagttcgaggcactagggtttcttaacgaagatcattggttcagccgggagaatagtctgtccggagttgagggcgaaggtctccacaaactggggtatattttgagagacgtcagcaagaaagagggaggcgctatgtacgccgatgacactgcaggctgggacacaaggataaccctggaagatctcaagaacgaggaaatggtgacaaatcacatggagggggagcataagaaacttgccgaagctatctttaaactgacttatcaaaacaaagtggtccgcgttcagcgacctaccccacggggaacggtgatggacattatctctagaagggatcagcgcggttcaggccaagtagggacctacggattaaatacattcactaacatggaggcccagctgatcagacagatggaaggcgagggtgtgttcaagaatattcagcacttgaccgtcacagaggaagtggcggttcataactggctcgcacgggtggggagggagcgtctgagtcgaatggccatatccggagacgattgcgtcgtgaaaccactagacgatcgctttgctaatgcccttactgcactgaacgacatgggcaagatcagaaaagatattcaacagtgggaacccagcaagggctggaacgactggacccaggtacctttctgctctcaccattttcacgagctcatcatgaaggatgggcgggttctggtggtcccatgtaggaatcaggacgaattgattggacgcgctagaatctcgcaaggtgccggctggtcattacgggagacggcttgcctggggaaaagctatgcccagatgtggtccctcatgtacttccacaggcgagatcttcgtctggcagcgaacgccatatgtagtgctgtgccgtctcattgggtgcccacaagcagaaccacttggtccatccacgccaagcatgagtggatgacaaccgaagacatgctaactgtctggaatcgcgtttggattcgggagaacccttggatggaagacaaaaccccagtggagtcatgggaagagatcccctatctgggaaagagggaggatcagtggtgcggcagtctcattggtttgacatctagagcaacgtgggctaaaaatatccaggccgcaataaaccaagtacgcagcctgattgggaatgaagagtacaccgactacatgccttccatgaagcggtttaggcgagaagaggaagaggccggagtgctttggtga

SEQ ID NO: 14867 - RNA, 9876 nt, synthetic construct
  misc_feature 1..9876: note = derived and/or modified CDS sequence (opt3) from DENV-2__EU482785__SS-prME
  source 1..9876: mol_type = other RNA
accgccggcgtgatcattatgctgatacccacagctatggcattccacctcactacgcgtaatggggaacctcatatgatcgtcggaaggcaggaaaagggtaaaagccttctgtttaagaccgaagacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgcccagaggatcgagacctggatactgcggcatcctggcttcacaatcatggcagccattttggcttacaccgtgggcacgactcactttcagcgcgcactcatcttcattctgctggccgctgttgccccatccatgacaatgagatgcatcgggatatctaacagggattttgtggaaggagtctcgggtggctcatgggtggacattgtactcgagcacgggagctgtgttaccactatggcgaagaataagcccacattagatttcgaactgatcaaaaccgaggcaaagcagcctgccacgcttcggaaatattgcattgaagctaagttgaccaacacaactaccgagagtcgctgtccaacacaaggagagccctccctgaatgaagaacaggacaaacgatttgtgtgcaagcattctatggtcgatagaggctggggtaacgggtgtggactattcggcaagggcgggatcgtgacttgcgccatgtttacctgcaaaaagaatatggaaggaaaaatcgtgcagcctgagaacctcgaatacacaattgtcataaccccacacagcggtgaggagcatgcagttggcaatgacactgggaagcacggaaaagaaatcaagattacgccgcagtcccccatcacagaggctgaactgaccggctatggtactgtgaccatggagtgttcacctaggacagggcttgatttcaacgaaatggtactgttgcaaatggaggacaaagcctggctcgtgcaccggcagtggtttctggatttaccactgccctggctccctggcgcggacacccagggaagtaattggatacagaaggagactcttgtcacattcaagaacccacatgccaaaaagcaagacgtggttgtgctgggcagccaggaaggggcaatgcacacggctttgaccggagccactgagattcagatgtcttccggtaatctactgtttacaggccatctcaaatgccgtctgcgcatggataaacttcaactgaaagggatgtcatacagcatgtgtaccggaaagttcaagatcgtcaaagaaatcgctgagacacagcacggcactattgtgatcagagtacagtatgagggtgacgggagtccctgcaagattccgttcgaaataatggatttggagaaaaggcatgttctcggccggctgatcaccgtgaaccctattgtcacggaaaaggactctcccgtgaacatcgaggccgaaccaccttttggagattcctacatcattataggcgtcgagcccgggcagttaaaactgaattggttcaagaagggaagctcgatcggtcaaatgtttgagaccacaatgcgaggcgcaaaacgcatggccattctaggggacactgcttgggatttcggatctctcggcggtgtgtttacctccatcgggaaggcgctgcaccaggttttcggcgcaatttacggagccgctttttcaggcgtgagttggacaatgaaaatccttataggggtaatcattacttggatcggaatgaacagcagatccacctctttgagcgtctcactggtgctcgttggcgtgattacgctgtatcttggtgccatggtccaggcagacagtgggtgtgtggtatcctggaagaataaagaactgaagtgcggaagcggcatcttcataacagataacgtgcacacctggactgagcagtacaagtttcaaccagaatctccctcaaaattggccagtgctattcagaaggcccatgaggaaggtatctgtggcattaggagcgttacacggctcgagaatctgatgtggaaacagatcacccctgagttaaaccacatactgtccgaaaatgaggtcaagctaactatcatgaccggggacattaaaggaatcatgcaggcaggcaagcgctctctcagaccacaaccgacagaactgaaatattcgtggaagacgtgggggaaggcgaaaatgcttagcaccgagtcccataaccagactttcttgattgatggacccgaaacagctgagtgccctaataccaacagggcctggaactcactggaggtggaagactacggctttggtgtgttcacaactaacatctggctcaagctgcgtgagaaacaggacgtcttttgtgatagtaagttaatgtctgcagccataaaagacaatcgggctgttcacgccgatatggggtattggattgaaagcgcactgaacgacacctggaagatggagaaggcttccttcatcgaggtgaaatcatgccactggccaaagagccatacgctttggtctaatggagtgttggaatccgagatgatcattcccaaaagtttcgccggccctgtaagccagcacaactaccgaccaggttattacacacaaaccgcgggcccctggcatctcgggaagctggaaatggattttgacttctgtgagggaactaccgtcgtggttacagaagattgcggcaacagagggccgtctctaaggactaccacagcctccggaaaactgatcacggagtggtgctgtcgctcatgcaccctccctccactgcggtacagaggcgaggacggttgttggtatgggatggaaattaggccccttaaggagaaggaagagaatttggtgaacagtctggtcactgctggacacggccagatagataattttagcttaggtgtgctcggcatggcactgttccttgaagagatgctgcgcacacgagttgggaccaaacatgccatcttgctcgtgactgtatcgtttgtcacactgattaccggaaacatgtccttccgggacctaggccgtgtgatggtgatggtcggggctgccatgacggatgacatcggaatgggcgttacttacctggcactcctggcggcctttaaggtgagacctaccttcgctgccggtcttttgctgaggaaattaacatctaaggagctcatgatggcaaccattgggatcgctctgcttagccagtcaactatacccgaaacaatcctggagctaaccgatgccctcgcactgggaatgatggtattgaaaattgtgcgcaatatggaaaagtatcaactggccgtcacaatcatggctattagttgcgtgccaaacgcggttatcttacagaatgcctggaaggtgtcctgtactatactcgcagctgtctctgtgagccctctgcttctgacctcctcacagcagaaagccgactggattcccttggccctcacgatcaagggcctgaacccaacagctatctttctaaccactctgagccggaccagtaaaaagagatcttggccgcttaatgaggcaattatggccgttggcatggtgtccatactcgcgagctcgctgttgaaaaacgacatccctatgacagggcccctggtcgctggaggtttactcactgtatgctacgtgctgaccggcaggtcagccgatcttgaactggagcgagcaacggacgttaagtgggaggatcaagccgaaatttctgggagttccccaatcttgagcattacaatcgctgaggacggatctatgagcatcaagaatgaagaggaggaacagaccctcactatcctgattcgcacaggcctactggtgatctccggtcttttccccgtctcaattcctatcaccgcagccgcgtggtatctctgggaggtgaagaagcagcgggctggggtactgtgggatgtgccaagtccccctccggtcgaaaaagccgagttggaagacggagcatacagaataaagcagaaaggcattttaggctatagccaaatcggggccggagtttacaaggagggtacttttcacacaatgtggcacgtgaccaggggcgctgtgctgatgcatcgtgggaaacgcatcgagccatcttgggccgatgtcaagaaggacctcatttcctacggaggcggttggaaactggaaggggagtggaaggaaggagaggaagtgcaggttcttgcactggagcccggcaaaaaccctcgggctgtacagacgaagccaggcttgttcaaaactaataccgggacaatcggagccgtgtcactagattttagtcccggtaccagcggctcccctatagtcgacagaaaggggaaggtggttggactgtatggcaacggtgtggtcacaaggtctggggcgtacgtgtcggccattgcacagactgagaaaagcatcgaagataatccggagattgaagacgatatcttccgaaagaaacggctcaccataatggacctgcaccccggagctggcaagacgaaacgctatcttccagccattgtaagagaggctatcaagaggggcttacggacactgatcctcgcacctactcgagtcgtggccgccgaaatggaggaggctttgagagggctgcccattcgctaccaaaccccagcgatcagggcagaacatacaggacgtgagattgttgacctcatgtgtcacgccaccttcactatgcggctgctttcacctgtgagagtccccaactataacctgataatcatggatgaagctcattttaccgacccagcctccattgcagccaggggttacatcagtacacgcgtggagatgggcgaggctgcggggatcttcatgacggccactccgcctggatctcgagatccctttccacagagcaatgcacccattatggacgaagagagagaaatacctgagcggtcctggaactcaggccacgaatgggttaccgatttcaagggtaaaacagtgtggtttgtcccatctatcaaggctgggaatgacattgccgcatgcttgaggaaaaacggaaagaaagtgatccagctaagccgcaagaccttcgatagtgagtatgtaaagactcgtacaaatgactgggattttgtggttaccacggacatttccgagatgggcgccaacttcaaagctgaaagagtcatcgatccccggaggtgtatgaagcctgtgatactgactgacggcgaggaacgcgtgatcctcgccgggccgatgccagtcacacacagctctgcggcacaacgaagaggacggattggtaggaatcccaaaaacgagaatgaccagtacatctacatgggcgaacctttagagaacgatgaggactgcgcccattggaaggaagctaaaatgctgcttgataatattaacacccccgaggggatcataccatcaatgtttgaacctgagcgcgaaaaggtagacgccattgatggagagtatagactgaggggcgaggctcggaaaaccttcgtggacctcatgcgtcgcggtgatttgcccgtttggctggcataccgagtggccgctgaagggatcaattatgccgacagaaggtggtgttttgatggcgtcaagaacaatcagattctcgaggaaaacgtggaggttgagatctggactaaggaaggagagcggaaaaagctgaaaccacgctggcttgacgcaagaatatactccgatcctctagcgctgaaggagttcaaagagttcgccgctggcaggaagagtttgacattaaacctgatcaccgaaatggggcggctcccgacatttatgactcagaaggcccgagacgcactggataatcttgctgtgctgcacacggccgaggcaggaggtagagcctataaccatgctctcagcgagttgcccgaaaccctggagacactactgctccttactctgttagcgaccgtcacaggcgggattttcttgtttctgatgtcgggaaaaggcgtgggtaagatgaccctcgggatgtgctgcatcattactgcctctatcctgctttggtacgcacaaatacagccacactggattgctgcctccatcatcctggagttctttctcattgtattgctgatccctgagcccgaaaaacagcgcacgccacaggacaatcaattaacctatgtggttatagccattctaacagtcgtggcagctactatggccaacgagatgggcttcctggagaagaccaaaaaggacctcggacttggcagcatcgcgacacaggaacctgagtcaaatattctggatatcgacttgaggcccgctagtgcctggaccctgtacgcagtggccactacatttgtcacgccgatgctccggcactctatagaaaactccagcgttaatgtgtcactgaccgctatcgcaaaccaggccactgtacttatggggctcggaaagggttggccactgagtaaaatggatattggcgtgcctttgctggcgatcgggtgttacagccaggtcaatcccattacattaaccgctgccctactgctccttgtggcacattatgccatcattggaccaggcctgcaagctaaggccacccgtgaggcacagaaaagagctgccgcgggtatcatgaagaaccccacagttgacggggtgactgtcatagatttggaccctattccgtacgatcccaaattcgaaaagcagctgggccaggtaatgctcctgatcctttgcgtgacgcaagttttaatgatgaggaccacatgggccctgtgtgaggcactcactttggctaccggaccaatctccacactgtgggagggcaatcctgggcgcttttggaacaccactattgccgtgtctatggcaaatatattccggggaagctatctagctggcgccggtctgctcttttccatcatgaagaacacgacaaatacccgaagagggactggaaacattggcgaaacccttggtgagaaatggaagtcaaggctgaatgccttgggcaaatctgagttccagatctacaagaaaagtgggattcaggaggtcgaccgcacactggcgaaggagggaatcaaacggggcgaaactgatcaccatgctgtgtcgagagggagcgcaaagctccgttggtttgtcgagaggaacatggtgacccccgaaggaaaggttgtggacctgggctgcggtcgcgggggatggtcctattactgtggcggtttaaaagatgtacgggaggtgaagggccttacaaaagggggacctggccacgaagaaccaatacccatgtctacgtatgggtggaacctggtccgactccaatcaggagttgacgtgttcttcacccctccagagaagtgcgatactctactgtgtgacatcggcgaaagctcccccaatccgacaattgaggccggtagaaccttgagggtcctgagtctcgtggaaaactggcttaataacgacactcagttttgcatcaaagtactgaatccttacatgccatctgtgattgagaagatggaaacattgcagcggaagtacgggggagctctggttcgcaaccccctcagcagaaattcaacccatgagatgtattgggtgtccaacgccacgggcaatatcgtcagtagcgtgaacatgatatctaggatgttaattaatcgattcaccatgaaacacaagaaagcaacatacgagcctgatgtcgacctgggctccgggactcggaacatcggaatcgaatcagagattccaaatcttgatataatcggtaagcgtattgagaaaataaagcaggaacacgaaaccagctggcattatgaccaagatcacccctacaagacatgggcctatcatggctcgtacgagactaaacagaccgggtctgctagttccatggtgaacggagttgtaagactgctaacaaagccgtgggacgtggtccctatggtgacccagatggcgatgactgatacgacaccctttggccagcaacgcgttttcaaagagaaggtggacaccaggactcaggaaccaaaagagggtaccaagaagctcatgaaaattacagccgaatggctgtggaaggagttggggaaaaagaaaacgcctcggatgtgtaccagagaggaatttactcgcaaggtcaggagcaatgcagctctgggagccatcttcacagatgagaacaaatggaagtcagcacgagaagccgtggaggactcccggttttgggaactcgtagataaggagagaaaccttcacctggagggcaaatgcgaaacctgtgtgtataatatgatgggcaagagggagaaaaagttaggggagttcggaaaagctaagggttctcgcgccatatggtacatgtggctgggcgcgagatttttggagttcgaagcactcgggtttctgaacgaggaccactggttcagccgggagaatagtctatccggagttgaaggcgagggtcttcataagctggggtacatcctcagagacgtcagcaaaaaggaaggaggcgccatgtatgctgatgacactgccggctgggatacaaggattaccctggaggacttgaaaaacgaagagatggtgacaaatcacatggagggggaacataagaaactggcagaggctatctttaagctcacttaccagaacaaggtggtccgcgttcagcgacccaccccacggggaacggtgatggatattatctctagaagggaccaacgcggttcaggccaggtagggacctatggacttaatacattcactaacatggaagcccagctgattagacaaatggagggcgagggtgtgttcaaaagtatacagcggttaaccgtcacagaagagatcgctgtgcagaattggctggccagggttgggcgtgaacgattgtcccgcatggcaattagcggagatgactgcgtggtcaagcccctcgatgacagatttgcgtctgccctgactgctctaaacgatatgggcaaagtgcggaaggacatccagcaatgggagccttcgaggggctggaatgattggacccaggtaccattctgctcacaccattttcacgaacttatcatgaaagacgggcgcgttctggtggtcccgtgtagaaaccaggacgagctcattggacgggccaggataagccagggtgcaggctggtccctgaaggagacggcttgcttggggaagagttacgcccaaatgtggtctttaatgtatttccaccgacgtgatctgagactcgcagccaatgcgatctgtagcgctgtgccctcccattgggtgcctacatcacgcaccacttggagtattcacgccaaacatgaatggatgacaaccgaggacatgcttactgtctggaaccgggtttggatccaggaaaatccatggatggaggataagacccccgtggaatcttgggaggaggtaccttacctgggaaaaagggaagaccagtggtgcggcagcctaattggtctgacatccagagcaacgtgggccaagaacatccagaccgctataaaccaagtgcgctcactcatcgggaatgaggaatatactgattacatgccaagcatgaaacggtttaggcgagaggaagaggaggccggagtcttgtggtga

SEQ ID NO: 14868 - RNA, 9876 nt, synthetic construct
  misc_feature 1..9876: note = derived and/or modified CDS sequence (opt3) from DENV-2__EU482786__SS-prME
  source 1..9876: mol_type = other RNA
agcgcaggcatgatcattatgctgatccccaccgtgatggctttccacctcactactagaaacggggagcctcatatgatcgtcggtattcaagaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccggcaaggatagccctgttaacatcgaggctgaacccccatttggagactcgtacattatcatcggcgtggagcctgggcagttaaagctgaattggttcaaaaagggatcttccattggtcaaatgtttgagacgaccatgcggggcgccaaacgaatggctatactaggggatacagcctgggacttcggatcactcggcggtgtatttacaagtatcgggaaggcactgcatcaggtcttcggcgccatttatggagctgcgtttagcggcgtgtcctggaccatgaaaatccttattggggttatcataacatggatcggaatgaactctcgcagcacttcattgagtgtgtccctggtcctcgtgggcattgtaaccctgtaccttggtgtgatggttcaggcagatagcgggtgtgtcgtgtcttggaagaataaggaactgaaatgcggatcaggcatcttcattacggacaacgtgcacacatggaccgagcagtataagtttcaacccgaaagtccaagcaaattggcctccgctatccagaaggcccaggaggaaggtatatgtggcattagatctgtcactaggctcgagaatctgatgtggaaacagatcacacccgagttaaaccacattctggcagaaaatgaggttaagctaaccatcatgactggggatataaaaggaatcatgcaagccggcaagcggtcgctccgccctcagccaaccgaactgaagtacagctggaaaacatgggggaaggctaaaatgctttccacggagtcatataaccagaccttcttgattgacggaccggaaactgccgagtgccccaatacaaacagagcatggaatagtctggaggtggaagattacggctttggtgtgttcaccacaaacatctggctcaagctgaaagagaagcaggacgcgttttgtgactctaagttaatgagcgctgccattaaagataatagggcagtacatgccgacatggggtattggatcgaatccgctctgaacgatacttggaagatagagaaagcctcattcattgaggtcaagaattgccactggcctaaaagccataccctttggtctaacggagtgttggaatccgagatgatcatcccaaagaacctcgcaggccccgttagtcaacacaattaccgtcctggttaccacacgcagattgctggcccatggcatctggggaagctagaaatggacttcgatttttgtgacggaacaaccgtgatcgtcactgaggattgcggcaaccgggggcccagcctgcgaaccacaactgcctctggaaaactcattaccgaatggtgctgtagatcctgcacactgccgcctcttaggtatcgcggcgaggacggttgttggtacgggatggagatacggccattgaaggaaaaagaggaaaatctggtgaactcattagttacggcgggacacggccaggtggataatttcagtctcggtgtactgggcatggccctttttctggaggaaatgttgagaaccagggtcgggactaagcatgctatcctcctggtggcagtgagcttcgtcacactaattaccggaaacatgtcgtttaaagacctgggccgcgttgtggtaatggtgggggccactatggctgatgacatcggaatgggcgtcacatatctcgccctgcttgcagcgttcaaggtgcgacccacctttgccgctggtttgctgttacggaagctcacgtccaaagagctgatgatgactaccattgggatcgttcttctgtctcaaagcacaatacctgagaccgtgctagaactcactgatgccctggcattgggaatgatggtcctgaagatcgtgcgtaatatggagaaataccagttagctgttacaattatggccatcctctgcgtgcccaacgcagtcgtactgcagaatgcctggaaggtgtcatgtaccattcttgctgttgtgagtgtctccccactgttgctcacatctagccagcagaagactgactggatccctctggcgctaaccataaagggcctgaaccccacggccattttccttacaaccctctccagaactaataaaaagaggtcatggccactgaacgaagcaatcatggctgtgggcatggtaagcatcttggccagttctctgttaaagaatgacattccgatgaccgggcctctcgtggccggaggtctgcttacagtctgctatgttctgactggccgctccgctgatttggagctcgaacgggcaaccgacgtgaaatgggaggatcaggccgagataagcgggtcgtcacccatcctgtctattacgatcagtgaagacggatccatgagcattaagaacgaggaagaggagcagacactaaccatcctgataagaactggccttctcgtgatctctggtctgtttccaattagcatccccattacagcggctgcctggtacttgtgggaagtcaaaaagcagagggcaggggtgttatgggatgttccttccccaccccctatgggaaaagccgagctggaagacggcgcttatcgaatcaagcaaaagggcatactcgggtactcacagattggagcaggagtatacaaagagggcaccttccacactatgtggcatgtgacacgcggggccgtcctgatgcacaagggaaaacggatcgaaccgagttgggcggatgtgaagaaagaccttatcagctatggcggtgggtggaagctggagggagagtggaaggaaggcgaggaagttcaggtgttggctctagagccaggcaaaaatcccagagccgtccagaccaagcctgggctgtttaaaacgaacactggaaccattggtgcagtgtctctcgatttctccccaggcacatcagggagtcccatcatagacaagaaaggaaaggtagtcggcctgtacggtaacggggtggttaccaggagcggagcctatgtgtccgctattgcccaaacagaaaagtctatcgaggataatcctgagattgaagacgatatctttcgtaaacgccggcttactataatggacttacacccgggcgcaggcaagaccaaaagatacctgcccgctattgtcagggaggccatcaagcgagggctccggacgttgatcctggcgccaacacgcgtggttgccgcagaaatggaggaagctctcagaggactgcctattaggtatcagactcccgccatcaaagctgagcataccggtcgggagattgtggaccttatgtgtcacgcaacattcaccatgcgactgttgtcgccagtcagagtgcctaactacaatctaataatcatggatgaagcccatttcactgaccccgccagcattgctgcgcgcggctatatctcaaccagggtagagatgggggaagcagccggaatctttatgacagctacgccaccgggctcccgtgatcctttcccccagagtaacgccccaattatagacgaggagcgggaaatccccgagagatcttggaatagcggtcacgaatgggtgactgattttaaggggaagaccgtttggttcgtcccttccattaaagcaggaaacgacatcgccgcttgcctgaggaagaatggcaaaaaggtgattcaactctcacgcaaaacatttgattctgagtacgtgaagacccgaactaacgactgggatttcgtcgtaacaaccgacatcagcgaaatgggcgcgaattttaaagccgagagagtgatagatccacggaggtgtatgaagcccgttatcttaacggacggggaggaacgcgtgattctggcaggacctatgccggtcactcatagttccgctgcccagcgtagaggtcggatcggcaggaacccaaagaatgagaacgaccagtacatttatatgggggaaccccttgagaatgatggagactgcgcacactggaaagaagccaagatgctgctcgataacatcaatacacctgagggcataattcccagcatgttcgagccagaacgcgagaaagtggacgctatcgatggtgaataccgattgagaggggaggcccggaagacctttgttgacctgatgaggcgcggcgatctccctgtgtggctggcgtataaagtcgcagccgaaggaattaactacgctgacagaaggtggtgtttcgatggcatcaagaacaatcagatacttgaggagaacgtggaagtagagatctggaccaaggaaggggagcggaaaaagctaaaaccccgttggctggacgcccgcatttattctgatccattggctttaaaggagtttaaagagttcgcagccggacgaaagtcactgactctcaatctgatcacagagatgggtagacttcctaccttcatgacacaaaagactagggacgctctggataacctcgccgtgttgcacacggcagaagcgggcgggcgggcctacaatcatgctctgtccgagctaccggaaaccctggagacactccttctgttaactttgctggccaccgttacaggaggcatttttctcttcctgatgagtggtcgcgggatcggcaaaatgacccttggaatgtgctgcataattactgcaagcatcctgctctggtatgctcagatccagccccactggattgccgcatcgatcatattggagtttttcctgattgtcttactaatcccagaacctgagaagcagagaacgccccaagacaaccagctgacctacgtggtgattgccatcctcacagtcgttgctgcgactatggccaatgaaatgggctttcttgagaaaaccaagaaagacctggggttgggatctatagcaacacagcagccagaatccaacatcctggatattgacctcaggcctgctagcgcctggaccctgtacgccgtggcaactacattcgtaacgcccatgcttcggcattcaatcgagaatagttctgtgaacgtctccctcaccgctattgccaatcaagcgactgtgctgatgggtttgggcaaggggtggccgctgagcaagatggatatcggagttccattactagctattggctgttattcacaggtgaaccctatcacactgaccgccgcactccttctgttggtcgcccactacgctataattggtcccgggctgcaggcaaaagccacccgagaggcgcagaagagagctgccgcaggcatcatgaaaaatccaacagtagacggaatcactgtgattgatctcgaccccataccttatgatccgaagtttgaaaaacaactgggccaggttatgcttttaatcctgtgcgtgacgcaggtcctcatgatgcgcaccacatgggccttgtgtgaggctctgactctagccaccgggcccattagtacactgtgggaaggaaacccaggcaggttctggaataccactatcgcagtgagcatggctaacatttttcggggttcctacctcgccggggcgggacttctgttctctatcatgaagaatacgacaaacacccgtagaggcactggtaacataggcgagaccttgggggaaaaatggaaaagcaggctgaatgccctcggaaagtccgagtttcaaatctataaaaagtcaggcattcaggaggtcgaccgcacactggcaaaagaagggatcaagcggggagagactgatcaccatgctgtgtctcgaggcagtgccaaattaagatggttcgttgaaaggaacatggtgacccctgagggtaaggtagtggaccttgggtgcggacgcggcggttggtcgtactattgtggcgggctgaagaatgtccgggaggttaaaggactcacaaagggcgggcccggacacgaagaacctattccaatgagcacgtacggctggaacctagtgagactgcagtccggtgtcgatgtgtttttcataccccctgaaaaatgcgacaccttgctgtgtgatataggggagtcttcaccaaatcccactgtagaagcaggacgtacactcagggtgcttaacctggttgagaattggttgaacaataacacccagttctgcattaaggtgctgaatccgtacatgcctagcgtcatcgagaaaatggaagctctccaacggaagtatggcggcgccttagtgcgcaacccactgtcccgaaatagtactcatgagatgtactgggtctctaacgccagcgggaatatcgtgtcatccgttaacatgattagtagaatgcttataaacaggtttacaatgcggcacaagaaagcgacctatgaacccgacgtagacctgggaagcggtacgcgcaatatcggcattgagtctgaaatccctaacctagatattatcgggaagagaatagagaaaatcaagcaggagcatgaaacctcctggcactacgaccaggatcacccatataaaacatgggcttaccatggatcatatgagactaagcagaccggcagcgcatcgtctatggtgaatggtgtcgtgaggctcctgacaaagccctgggacgttttgccgactgtgacccaaatggccatgacagataccactcctttcgggcagcagcgagtctttaaagaaaaggtggacacgcggacacaggagcccaaagaaggaaccaagaaactgatgaagattactgctaaatggctctggaaggagcttggcaagaaaaagaccccacgtatgtgtacaagagaggagttcacgcgcaaagtaaggagtaacgccgcactgggcgccatctttaccgatgagaataagtggaaatccgctcgggaagcggtggaggacagcagattctgggagttagttgataaggaacgcaacctgcacttggaggggaagtgcgaaacttgtgtctacaatatgatgggaaaaagggagaagaaactcggtgaatttggcaaggccaaagggtcacgagcaatttggtacatgtggctgggagctcggttcctagagtttgaggcccttggcttcctgaacgaagaccattggttttccagagaaaattctctcagcggtgtggaaggggagggactgcacaagttgggctatatcctgagggatgtgagtaagaaagaaggcggggcaatgtacgccgacgacacagctggatgggatacccgcattactctcgaggaccttaagaacgaggaaatggtcacaaatcacatggagggtgaacataaaaagctggccgaggcgatattcaaattaacctatcaaaacaaggttgtgcgtgtacagcggcctacacccagaggcactgtgatggatatcatttccaggcgcgaccagcgagggagcggacaagtcggcacctacggtctgaatacgtttaccaacatggaagcacagttgatccggcagatggagggggagggagtgttcaagaatatccagcacctcacagttactgaagaggtggccgtccaaaactggctggctagagtgggcagggaacgcctatctagaatggccatttcaggcgatgactgcgtagttaaaccacttgatgaccggttcgcaaacgctctgaccgccctcaatgatatggggaagataaggaaagacatccagcagtgggagcccagtaagggatggaacgattggacacaggtgcctttttgctcccatcacttccatgagctgattatgaaagacggtcgtgtcttggtggtgccatgtcgaaatcaagatgaattaatcggccgcgctagaattagccagggggccggatggtctctgcgggagactgcatgcctcggcaagtcgtatgcgcagatgtggtcacttatgtactttcacaggcgcgacctgagactagccgctaacgccatctgtagcgcagtcccgtcccactgggttcccaccagtcggacgacatggtctatacatgctaagcacgaatggatgaccactgaggacatgctgacagtgtggaatagggtatggatccgagaaaacccttggatggaggataaaaccccagtggagagctgggaagagattccctatctcggtaagcgtgaagaccagtggtgcgggtccttgatcggactgacttcaagagccacctgggccaaaaatattcaagccgcgatcaaccaggtccgcagtcttataggcaatgaggaatacacagattacatgccttctatgaagcggttcaggagagaggaggaagaggctggcgtgctgtggtga

SEQ ID NO: 14869 - RNA, 9876 nt, synthetic construct
  misc_feature 1..9876: note = derived and/or modified CDS sequence (opt3) from DENV-2__EU482787__SS-prME
  source 1..9876: mol_type = other RNA
accgccggagtgataattatgctgatacccacagctatggcattccacctcactacgaggaatggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaatgaaccggaggatattgactgttggtgcaattccacatctacctgggtgacttatggaacatgtaccacgactggcgagcaccgccgagaaaagcgttcagtagcgctggtgccccatgtcggtatggggcttgagacccggacagaaacttggatgagtagcgagggagcttggaaacacgcccagaggatcgagacctggatactgcggcatcctggcttcacaatcatggcagccattttggcttacaccgtgggcacgactcactttcagcgcgcactcatcttcattctgctggccgctgttgccccatccatgacaatgcgttgcatcgggatatctaacagggattttgtggaaggagtctcgggtggctcatgggtggacattgtactcgagcacgggagctgtgttaccactatggcgaagaataagcccacattagatttcgaactgatcaaaaccgaggcaaagcagcctgccacgcttcggaaatattgcattgaagctaagttgaccaacacaactaccgagagtcgctgtccaacacaaggagagccctccctgaatgaagaacaggacaaacgatttgtgtgcaagcattctatggtcgataggggctggggtaacgggtgtggactattcggcaagggcgggatcgtgacttgcgccatgtttacctgcaaaaagaatatggaaggaaaaatcgtgcagcctgagaacctcgaatacacaattgtcataaccccacacagcggtgaggagcatgcagttggcaatgacactgggaagcacggaaaagaaatcaagattacgccgcagtcccccatcacagaggctgaactgaccggctatggtactgtgaccatggagtgttcacctaggacagggcttgatttcaacgaaatggtactgttgcaaatggaggacaaagcctggctcgtgcaccggcagtggtttctggatttaccactgccctggctccctggcgcggacacccagggaagtaattggatacagaaggagactcttgtcacattcaagaacccacatgccaaaaagcaagacgtggttgtgctgggcagccaggaaggggcaatgcacacggctttgaccggagccactgagattcagatgtcttccggtaatctactgtttacaggccatctcaaatgccgtctgcgcatggataaacttcaactgaaagggatgtcatacagcatgtgtaccggaaagttcaagatcgtcaaagaaatcgctgagacacagcacggcactattgtgatcagagtacagtatgagggtgacgggagtccctgcaagattccgttcgaaataatggatttggagaaaaggcatgttctcggccggctgatcaccgtgaaccctattgtcacggaaaaggactctcccgtgaacatcgaggccgaaccaccttttggagattcctacatcattataggcgtcgagcccgggcagttaaaactgaattggttcaagaagggaagctcgatcggtcaaatgtttgagaccacaatgcgaggcgcaaaacgcatggccattctaggggacactgcttgggatttcggatctctcggcggtgtgtttacctccatcgggaaggcgctgcaccaggttttcggcgcaatttacggagccgctttttcaggcgtgagttggacaatgaaaatccttataggggtaatcattacttggatcggaatgaacagcagatccacctctttgagcgtctcactggtgctcgttggcgtgattacgctgtatcttggtgccatggtccaggcagacagtgggtgtgtggtatcctggaagaataaagaactgaagtgcggaagcggcatcttcataacagataacgtgcacacctggactgagcagtacaagtttcaaccagaatctccctcaaaattggccagtgctattcagaaggcccatgaggaaggtatctgtggcattaggagcgttacacggctcgagaatctgatgtggaaacagatcacccctgagttaaaccacatactgtccgaaaatgaggtcaagctaactatcatgaccggggacattaaaggaatcatgcaggcaggcaagcgctctctcagaccacaaccgacagaactgaaatattcgtggaagacgtgggggaaggcgaaaatgcttagcaccgagtcccataaccagactttcttgattgatggacccgaaacagctgagtgccctaataccaacagggcctggaactcactggaggtggaagactacggctttggtgtgttcacaactaacatctggctcaagctgcgtgagaaacaggacgtcttttgtgatagtaagttaatgtctgcagccataaaagacaatcgggctgttcacgccgatatggggtattggattgaaagcgcactgaacgacacctggaagatggagaaggcttccttcatcgaggtgaaatcatgccactggccaaagagccatacgctttggtctaatggagtgttggaatccgagatgatcattcccaaaagtttcgccggccctgtaagccagcacaactaccgaccaggttattacacacaaaccgcgggcccctggcatctcgggaagctggaaatggattttgacttctgtgagggaactaccgtcgtggttacagaagattgcggcaacagagggccgtctctaaggactaccacagcctccggaaaactgatcacggagtggtgctgtcgctcatgcaccctccctccactgcggtacagaggcgaggacggttgttggtatgggatggaaattaggccccttaaggagaaggaagagaatttggtgaacagtctggtcactgctggacacggccagatagataattttagcttaggtgtgctcggcatggcactgttccttgaagagatgctgcgcacacgagttgggaccaaacatgccatcttgctcgtgactgtatcgtttgtcacactgattaccggaaacatgtccttccgggacctaggccgtgtgatggtgatggtcggggctgccatgacggatgacatcggaatgggcgttacttacctggcactcctggcggcctttaaggtgagacctaccttcgctgccggtcttttgctgaggaaattaacatctaaggagctcatgatggcaaccattgggatcgctctgcttagccagtcaactatacccgaaacaatcctggagctaaccgatgccctcgcactgggaatgatggtattgaaaattgtgcgcaatatggaaaagtatcaactggccgtcacaatcatggctattagttgcgtgccaaacgcggttatcttacagaatgcctggaaggtgtcctgtactatactcgcagctgtctctgtgagccctctgcttctgacctcctcacagcagaaagccgactggattcccttggccctcacgatcaagggcctgaacccaacagctatctttctaaccactctgagccggaccagtaaaaagagatcttggccgcttaatgaggcaattatggccgttggcatggtgtccatactcgcgagctcgctgttgaaaaacgacatccctatgacagggcccctggtcgctggaggtttactcactgtatgctacgtgctgaccggcaggtcagccgatcttgaactggagcgagcaacggacgttaagtgggaggatcaagccgaaatttctgggagttccccaatcttgagcattacaatcgctgaggacggatctatgagcatcaagaatgaagaggaggaacagaccctcactatcctgattcgcacaggcctactggtgatctccggtcttttccccgtctcaattcctatcaccgcagccgcgtggtatctctgggaggtgaagaagcagcgggctggggtactgtgggatgtgccaagtccccctccggtcggaaaagccgaattggaggacggcgcatacagaataaagcagaaaggcattttagggtatagccaaatcggagccggtgtttacaaggaaggcacttttcacacaatgtggcacgtgaccagaggggctgtgctgatgcatcgtggaaaacgcatcgagccatcttgggccgatgtcaagaaggacctcatttcctacggcggtgggtggaaactggagggagaatggaaggagggcgaagaggtgcaggttcttgcactggaacccggcaaaaaccctcgggctgtacagacgaagccagggttgttcaaaacttcaaccggaacaatcggtgccgtgagtctagattttagccccggcacctccgggtctcctatagtcgacagaaagggaaaggtggttggcctgtatggtaatggggtggtcacaaggtcgggagcgtacgtgagcgccattgcacagactgagaaatcaatcgaggataacccggaaattgaggacgatatcttccgaaagaaacggctcaccataatggacctgcaccccggcgctggcaagacgaaacgctatcttccagccattgtaagagaagctatcaagagggggttacggacactgatcctcgcacctactcgagtcgtggccgccgagatggaagaggctttgagaggactgcccattcgctaccaaaccccagcgatcagggcagagcatacaggtcgtgaaattgttgacctcatgtgtcacgccaccttcactatgcggctgctttcccctgtgagagtccccaattataacctgataatcatggatgaggctcattttaccgacccagccagtattgcagccaggggctacatctctacacgcgtggaaatgggggaggctgcgggaatcttcatgacggccactccgcctggcagccgagatccctttccacagtccaacgcacccattatggacgaggaaagagagatacctgaacggtcatggaactctggtcacgagtgggttaccgatttcaaggggaaaacagtgtggtttgtcccaagcatcaaggctggaaacgacattgccgcatgcttgaggaaaaatggcaagaaagtgatccagctaagtcgcaagaccttcgattccgaatatgtaaagactcgtacaaacgactgggattttgtggttaccacggacattagcgagatgggcgccaatttcaaagctgagagagtcatcgatccccggaggtgtatgaagcctgtgatactgactgacggggaagaacgcgtgatcctcgccggaccgatgccagtcacacactcttcagcggcacaacgaagaggtcggattggcaggaaccccaaaaatgaaaacgaccagtacatctacatgggggagcctttagaaaatgatgaggactgcgcccattggaaggaggctaaaatgctgcttgataacattaatacccccgaaggaatcataccatccatgtttgagcctgaacgcgagaaggtagacgccattgatggcgaatatagactgaggggtgaggctcggaaaaccttcgtggacctcatgcgtcgcggggatttgcccgtttggctggcataccgagtggccgctgagggcatcaactatgccgacagaaggtggtgttttgatggagtcaagaataaccagattctcgaagagaatgtggaagttgagatctggactaaggagggcgaacggaaaaagctgaaaccacgctggcttgacgcaagaatatacagtgatcctctagcgctgaaggagttcaaagagttcgccgctgggagaaagagcttgacattaaacctgatcaccgagatgggacggctcccgacatttatgactcagaaggcccgagacgcactggataaccttgctgtgctgcacacggccgaagcaggaggtagagcctataatcatgctctctcggagttgcccgagaccctggaaacactactgctccttactctgttagcgaccgtcacagggggaattttcttgtttctgatgtctggcaaaggtgtggggaagatgaccctcggcatgtgctgcatcattactgcctccatcctgctttggtacgcacaaatacagccacactggattgctgccagcatcatcctggagttctttctcattgtattgctgatccctgaacccgagaaacagcgcacgccacaggacaaccaattaacctatgtggttatagccattctaacagtcgtggcagctactatggccaatgaaatgggattcctggagaagaccaaaaaggacctcggccttgggtcaatcgcgacacaggagcctgaaagtaacattctggatatcgacttgaggcccgcttctgcctggaccctgtacgcagtggccactacatttgtcacgccgatgctccggcactccatagagaatagctcagttaacgtgagtctgaccgctatcgcaaatcaggccactgtacttatgggactcggtaagggctggccactgagcaaaatggatattggggtgcctttgctggcgatcggatgttactcccaggtcaaccccattacattaaccgctgccctactgctccttgtggcacattatgccatcattggcccaggtctgcaagctaaggccacccgtgaagcacagaaaagagctgccgcggggatcatgaagaatcccacagttgacggcgtgactgtcatagatttggaccctattccgtacgatcccaaattcgagaagcagctgggacaggtaatgctcctgatcctttgcgtgacgcaagttttaatgatgaggaccacatgggccctgtgtgaagcactcactttggctaccggcccaatctctacactgtgggaggggaaccctggacgcttttggaataccactattgccgtgagcatggcaaacatattccggggctcctatctagctggtgccgggctgctcttttcaatcatgaagaatacgacaaacacccgaagaggaactggcaatattggtgagacccttggcgaaaaatggaagtctaggctgaacgccttggggaaaagtgagttccagatctacaagaaatcgggcattcaggaagtcgaccgcacactggcgaaggagggcatcaaaagaggggaaactgatcaccatgctgtgagcagaggatccgcaaagctccgttggtttgtcgaaaggaatatggtgacccccgagggcaaggttgtggacctgggttgcgggcggggaggctggtcttattactgtggtggcttaaaagatgtacgcgaagtgaaggggcttacaaaaggaggccctgggcacgaggaaccaatacccatgtcaacgtatggatggaacctggtccgactccaaagcggcgttgacgtgttcttcacccctccagagaagtgcgatactctactgtgtgacatcggtgagtccagtcccaacccgacaattgaagccgggagaaccttgagggtcctgtctctcgtggagaattggcttaacaatgacactcagttttgcatcaaagtactgaacccttacatgccaagcgtgattgaaaagatggagacattgcagcggaagtacggaggcgctctggttcgcaatcccctctcaagaaactccacccatgaaatgtattgggtgagtaatgccacgggcaacatcgtcagctctgtgaatatgatatccaggatgttaattaaccgattcaccatgaaacacaagaaagcaacatacgagcctgatgtcgacctggggtcaggaactcggaatatcggtatcgagagcgaaattccaaaccttgatataatcggcaagcgtattgagaaaatcaagcaggaacacgagacctcgtggcattatgaccaagatcacccctacaagacatgggcctatcatgggtcttacgaaactaaacagaccggaagtgcttccagcatggtgaatggcgttgtaagactgctaacaaagccgtgggacgtggtccctatggtgacccagatggcgatgactgatacgacaccctttggtcagcaacgcgttttcaaagagaaggtggacaccaggactcaggagccaaaagaagggaccaagaagctcatgaaaattacagccgagtggctgtggaaggaattgggcaaaaagaaaacgcctcggatgtgtaccagagaggagtttactcgcaaggtcaggtcaaacgcagctctgggcgccatcttcacagatgaaaataaatggaagtccgcacgagaggccgtggaagactctcggttttgggagctcgtagataaggaaagaaaccttcacctggagggcaaatgcgagacctgtgtgtataacatgatggggaagagggagaaaaagttaggagagttcggtaaagctaagggcagccgcgccatatggtacatgtggctgggggcgagatttttggagttcgaggcactcggatttctgaatgaagaccactggttcagtcgggagaactccctaagcggcgttgagggtgaagggcttcataagctgggatacatcctcagagacgtctctaaaaaggagggcggcgccatgtatgctgatgacactgccgggtgggatacaaggattaccctggaagacttgaaaaatgaggaaatggtgacaaaccacatggagggagagcataagaaactggcagaagctatctttaagctcacttaccagaataaggtggtccgcgttcagcgacccaccccacggggtacggtgatggatattatctcaagaagggaccaacgcggcagtgggcaggtaggaacctatggccttaacacattcactaatatggaggcccagctgattagacaaatggaaggtgagggggtgttcaaatccatacagcggttaaccgtcacagaggaaatcgctgtgcagaactggctggccagggttggacgtgagcgattgagccgcatggcaatttctggcgatgactgcgtggtcaagcccctcgatgacagatttgcgtcggccctgactgctctaaatgatatgggcaaagtgcggaaggacatccagcaatgggaaccttcaagggggtggaacgattggacccaggtaccattctgcagccaccattttcacgagcttatcatgaaagacggacgcgttctggtggtcccgtgtagaaatcaggacgaactcattggtcgggccaggatatcccagggcgcagggtggagtctgaaggagacggcttgcttgggaaagtcttacgcccaaatgtggagcttaatgtatttccaccgacgtgatctgagactcgcagccaacgcgatctgttccgctgtgccctcacattgggtgcctacaagtcgcaccacttggtctattcacgccaaacatgagtggatgacaaccgaagacatgcttactgtctggaatcgggtttggatccaggagaacccatggatggaagataagacccccgtggagagctgggaagaggtaccttacctgggcaaaagggaggaccagtggtgcggttccctaattgggctgacatcaagagcaacgtgggccaagaatatccagaccgctataaaccaagtgcgcagcctcatcggaaacgaagagtatactgattacatgccatctatgaaacggtttaggcgagaagaggaagaggccggcgtcttgtggtga

SEQ ID NO: 14870 - RNA, 9876 nt, synthetic construct
  misc_feature 1..9876: note = derived and/or modified CDS sequence (opt3) from DENV-2__EU482788__SS-prME
  source 1..9876: mol_type = other RNA
accgccggcgtgataattatgctgatacccacagctatggcattccacctcactacgaggaatggggagcctcatatgatcgtcgggaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagacccggacagaaacttggatgagtagcgagggagcttggaaacacgcccagaggatcgagacctggatactgcggcatcctggcttcacaatcatggcagccattttggcttacaccgtgggcacgactcactttcagcgcgcactcatcttcattctgctggccgctgttgccccatccatgacaatgcgttgcatcgggatatctaacagggattttgtggaaggagtctcgggtggctcatgggtggacattgtactcgagcacgggagctgtgttaccactatggcgaagaataagcccacattagatttcgaactgatcaaaaccgaggcaaagcagcctgccacgcttcggaaatattgcattgaagctaagttgaccaacacaactaccgagagtcgctgtccaacacaaggagagccctccctgaatgaggaacaggacaaacgatttgtgtgcaagcattctatggtcgatagaggctggggtaacgggtgtggactattcggcaagggcgggatcgtgacttgcgccatgtttacctgcaaaaagaatatggaaggaaaaatcgtgcagcctgagaacctcgaatacacaattgtcataaccccacacagcggtgaggagcatgcagttggcaatgacactgggaagcacggaaaagaaatcaagattacgccgcagtcccccatcacagaggctgaactgaccggctatggtactgtgaccatggagtgttcacctaggacagggcttgatttcaacgaaatggtactgttgcaaatggaggacaaagcctggctcgtgcaccggcagtggtttctggatttaccactgccctggctccctggcgcggacacccagggaagtaattggatacagaaggagactcttgtcacattcaagaacccacatgccaaaaagcaagacgtggttgtgctgggcagccaggaaggggcaatgcacacggctttgaccggagccactgagattcagatgtcttccggtaatctactgtttacaggccatctcaaatgccgtctgcgcatggataaacttcaactgaaagggatgtcatacagcatgtgtaccggaaagttcaagatcgtcaaagaaatcgctgagacacagcacggcactattgtgatcagagtacagtatgagggtgacgggagtccctgcaagattccgttcgaaataatggatttggagaaaaggcatgttctcggccggctgatcaccgtgaaccctattgtcacggaaaaggactctcccgtgaacatcgaggccgaaccaccttttggagattcctacatcattataggcgtcgagcccgggcagttaaaactgaattggttcaagaagggaagctcgatcggtcaaatgtttgagaccacaatgcgaggcgcaaaacgcatggccattctaggggacactgcttgggatttcggatctctcggcggtgtgtttacctccatcgggaaggcgctgcaccaggttttcggcgcaatttacggagccgctttttcaggcgtgagttggacaatgaaaatccttataggggtaatcattacttggatcggaatgaacagcagatccacctctttgagcgtctcactggtgctcgttggcgtgattacgctgtatcttggtgccatggtccaggcagacagtgggtgtgtggtatcctggaagaataaagaactgaagtgcggaagcggcatcttcataacagataacgtgcacacctggactgagcagtacaagtttcaaccagaatctccctcaaaattggccagtgctattcagaaggcccatgaggaaggtatctgtggcattaggagcgttacacggctcgagaatctgatgtggaaacagatcacccctgagttaaaccacatactgtccgaaaatgaggtcaagctaactatcatgaccggggacattaaaggaatcatgcaggcaggcaagcgctctctcagaccacaaccgacagaactgaaatattcgtggaagacgtgggggaaggcgaaaatgcttagcaccgagtcccataaccagactttcttgattgatggacccgaaacagctgagtgccctaataccaacagggcctggaactcactggaggtggaagactacggctttggtgtgttcacaactaacatctggctcaagctgcgtgagaaacaggacgtcttttgtgatagtaagttaatgtctgcagccataaaagacaatcgggctgttcacgccgatatggggtattggattgaaagcgcactgaacgacacctggaagatggagaaggcttccttcatcgaggtgaaatcatgccactggccaaagagccatacgctttggtctaatggagtgttggaatccgagatgatcattcccaaaagtttcgccggccctgtaagccagcacaactaccgaccaggttattacacacaaaccgcgggcccctggcatctcgggaagctggaaatggattttgacttctgtgagggaactaccgtcgtggttacagaagattgcggcaacagagggccgtctctaaggactaccacagcctccggaaaactgatcacggagtggtgctgtcgctcatgcaccctccctccactgcggtacagaggcgaggacggttgttggtatgggatggaaattaggccccttaaggagaaggaagagaatttggtgaacagtctggtcactgctggacacggccagatagataattttagcttaggtgtgctcggcatggcactgttccttgaagagatgctgcgcacacgagttgggaccaaacatgccatcttgctcgtgactgtatcgtttgtcacactgattaccggaaacatgtccttccgggacctaggccgtgtgatggtgatggtcggggctgccatgacggatgacatcggaatgggcgttacttacctggcactcctggcggcctttaaggtgagacctaccttcgctgccggtcttttgctgaggaaattaacatctaaggagctcatgatggcaaccattgggatcgctctgcttagccagtcaactatacccgaaacaatcctggagctaaccgatgccctcgcactgggaatgatggtattgaaaattgtgcgcaatatggaaaagtatcaactggccgtcacaatcatggctattagttgcgtgccaaacgcggttatcttacagaatgcctggaaggtgtcctgtactatactcgcagctgtctctgtgagccctctgcttctgacctcctcacagcagaaagccgactggattcccttggccctcacgatcaagggcctgaacccaacagctatctttctaaccactctgagccggaccagtaaaaagagatcttggccgcttaatgaggcaattatggccgttggcatggtgtccatactcgcgagctcgctgttgaaaaacgacatccctatgacagggcccctggtcgctggaggtttactcactgtatgctacgtgctgaccggcaggtcagccgatcttgaactggagcgagcaacggacgttaagtgggaggatcaagccgaaatttctgggagttccccaatcttgagcattacaatcgctgaggacggatctatgagcatcaagaatgaagaggaggaacagaccctcactatcctgattcgcacaggcctactggtgatctccggtcttttccccgtctcaattcctatcaccgcagccgcgtggtatctctgggaggtgaagaagcagcgggctggggtactgtgggatgtgccaagtccccctccggtcggaaaagccgaattggaggacggcgcatacagaataaagcagaaaggcattttagggtatagccaaatcggagccggtgtttacaaggaaggcacttttcacacaatgtggcacgtgaccagaggggctgtgctgatgcatcgtggaaaacgcatcgagccatcttgggccgatgtcaagaaggacctcatttcctacggcggtgggtggaaactggagggagaatggaaggagggcgaagaggtgcaggttcttgcactggaacccggcaaaaaccctcgggctgtacagacgaagccagggttgttcaaaactaataccggaacaatcggtgccgtgtcactagattttagtcccggcaccagcgggtcccctatagtcgacagaaagggaaaggtggttggcctgtatggtaacggggtggtcacaaggtctggagcgtacgtgtcggccattgcacagactgagaaaagcatcgaggataatccggaaattgaggacgatatcttccgaaagaaacggctcaccataatggacctgcaccccggcgctggcaagacgaaacgctatcttccagccattgtaagagaagctatcaagagggggttacggacactgatcctcgcacctactcgagtcgtggccgccgagatggaagaggctttgagaggactgcccattcgctaccaaaccccagcgatcagggcagagcatacaggtcgtgaaattgttgacctcatgtgtcacgccaccttcactatgcggctgctttcacctgtgagagtccccaactataacctgataatcatggatgaggctcattttaccgacccagcctccattgcagccaggggctacatcagtacacgcgtggaaatgggggaggctgcgggaatcttcatgacggccactccgcctggctctcgagatccctttccacagagcaatgcacccattatggacgaggaaagagagatacctgaacggtcctggaactcaggtcacgagtgggttaccgatttcaaggggaaaacagtgtggtttgtcccatctatcaaggctggaaatgacattgccgcatgcttgaggaaaaacggcaagaaagtgatccagctaagccgcaagaccttcgatagtgaatatgtaaagactcgtacaaatgactgggattttgtggttaccacggacatttccgagatgggcgccaacttcaaagctgagagagtcatcgatccccggaggtgtatgaagcctgtgatactgactgacggggaagaacgcgtgatcctcgccggaccgatgccagtcacacacagctctgcggcacaacgaagaggtcggattggcaggaatcccaaaaacgaaaatgaccagtacatctacatgggggagcctttagaaaacgatgaggactgcgcccattggaaggaggctaaaatgctgcttgataatattaacacccccgaaggaatcataccatcaatgtttgagcctgaacgcgagaaggtagacgccattgatggcgaatatagactgaggggtgaggctcggaaaaccttcgtggacctcatgcgtcgcggggatttgcccgtttggctggcataccgagtggccgctgagggcatcaattatgccgacagaaggtggtgttttgatggagtcaagaacaatcagattctcgaagagaacgtggaagttgagatctggactaaggagggcgaacggaaaaagctgaaaccacgctggcttgacgcaagaatatactccgatcctctagcgctgaaggagttcaaagagttcgccgctgggaggaagagtttgacattaaacctgatcaccgagatgggacggctcccgacatttatgactcagaaggcccgaaatgcactggacaaccttgctgtgctgcacacggccgaagcaggaggtagagcctataatcatgctctcagcgagttgcccgagaccctggaaacactactgctccttactctgttagcgaccgtcacagggggaattttcttgtttctgatgtcgggcaaaggtgtggggaagatgaccctcggcatgtgctgcatcattactgcctctatcctgctttggtacgcacaaatacagccacactggattgctgcctccatcatcctggagttctttctcattgtattgctgatccctgaacccgagaaacagcgcacgccacaggataaccaattaacctatgtggttatagccattctaacagtcgtggcagctactatggccaatgaaatgggattcctggagaagaccaaaaaggacctcggccttgggagcatcgcgacacaggagcctgaatcaaacattctggacatcgatttgaggcccgctagtgcctggaccctgtacgcagtggccactacatttgtcacgccgatgctccggcactctatagaaaattccagcgttaacgtgtcactgaccgctatcgcaaatcaggccactgtacttatgggactcggtaagggctggccactgagtaaaatggacattggggtgcctttgctggcgatcggatgttacagccaggtcaaccccattacattaaccgctgccctactgctccttgtggcacattatgccatcattggcccaggtctgcaagctaaggccacccgtgaagcacagaaaagagctgccgcggggatcatgaagaatcccacagttgatggcataactgtgattgacttggatcctatcccgtacgaccccaaattcgagaagcagctgggacaggtcatgctcctgatcctttgcgtaacgcaagtgttaatgatgaggaccacatgggccctgtgtgaagcactcactttggctaccggcccaatttccacactgtgggaggggaaccctggacgcttttggaataccactatagccgtttctatggcaaacatcttccggggcagctatctagctggtgccgggctgctcttttccattatgaagaatacgacaaacacccgaagaggaactggcaatatcggtgagacccttggcgaaaaatggaagtcaaggctgaacgccttggggaaatctgagttccagatttacaagaaaagtggaatccaggaagtggatcgcacactggcgaaggagggcataaaaagaggggaaactgaccaccatgctgtctcgagaggaagcgcaaagctccgttggtttgtggaaaggaacatggtcacccccgagggcaaggtggttgatctgggttgcgggcggggaggctggtcctattactgtggtggcttaaaagacgtgcgcgaagtaaaggggcttacaaaaggaggccctgggcacgaggaaccaatccccatgtctacgtatggatggaatctggtgcgactccaatcaggcgtcgatgttttcttcacccctccagagaagtgcgacactctactgtgtgatattggtgagagctcccccaacccgacaatcgaagccgggagaaccttgagggtgctgagtctcgtcgagaattggcttaacaatgacactcagttttgcattaaagtgctgaacccttacatgccatctgtaatcgaaaagatggagacattgcagcggaagtacggaggcgctctggtgcgcaatcccctcagcagaaactcaacccatgaaatgtattgggtttccaatgccacgggcaacatagtgagtagcgtcaatatgatttctaggatgttaatcaaccgattcaccatgaaacacaagaaagcaacatacgagcctgacgtggatctggggtccggaactcggaatatcggtattgagtcagaaataccaaaccttgacatcattggcaagcgtatcgagaaaattaagcaggaacacgagaccagctggcattatgatcaagaccacccctacaagacatgggcctatcatgggtcgtacgaaactaaacagaccggatctgctagttccatggtcaatggcgtggttagactgctaacaaagccgtgggatgtagtgcctatggtcacccagatggcgatgactgacacgacaccctttggtcagcaacgcgtgttcaaagagaaggttgataccaggactcaggagccaaaagaagggaccaagaagctcatgaaaatcacagccgagtggctgtggaaggaattgggcaaaaagaaaacgcctcggatgtgtaccagagaggagtttactcgcaaggtgaggagcaacgcagctctgggcgccatattcacagacgaaaacaaatggaagtcagcacgagaggccgtcgaagattcccggttttgggagctcgtggacaaggaaagaaatcttcacctggagggcaaatgcgagacctgtgtatataacatgatggggaagagggagaaaaagttaggagagttcggtaaagctaagggctctcgcgccatctggtacatgtggctgggggcgagatttttggagttcgaggcactcggatttctgaatgaagatcactggttcagccgggagaacagtctatccggcgtggagggtgaagggcttcataagctgggatacattctcagagacgttagcaaaaaggagggcggcgccatgtatgctgacgatactgccgggtgggacacaaggatcaccctggaagatttgaaaaatgaggaaatggtcacaaaccacatggagggagagcataagaaactggcagaagctatttttaagctcacttaccagaataaggtggtgcgcgtccagcgacccaccccacggggtacggttatggacatcatttctagaagggatcaacgcggctcaggacaggtgggaacctatggccttaacacattcactaatatggaggcccagctgataagacaaatggaaggtgagggggtattcaaaagtatccagcggttaaccgtgacagaggaaattgctgtccagaactggctggccagggtgggacgtgagcgattgtcccgcatggcaatcagcggcgacgattgcgttgtgaagcccctcgacgatagatttgcgtctgccctgactgctctaaatgacatgggcaaagtccggaaggatatccagcaatgggaaccttcgagggggtggaacgactggacccaggtgccattctgctcacaccattttcacgagcttattatgaaagatggacgcgtactggttgtgccgtgtagaaatcaggacgaactcataggtcgggccaggatcagccagggcgcagggtggtccctgaaggagacggcttgcttgggaaagagttacgcccaaatgtggtctttaatgtatttccaccgacgtgacctgagactcgcagccaacgcgatttgtagcgctgtcccctcccattgggtgcctacatcacgcaccacttggagtatccacgccaaacatgagtggatgacaaccgaagatatgcttactgtgtggaatcgggtctggattcaggagaacccatggatggaagacaagacccccgttgagtcttgggaagaggtgccttacctgggcaaaagggaggatcagtggtgcggtagcctaatcgggctgacatccagagcaacgtgggccaagaacatacagaccgctatcaatcaagtacgctcactcattggaaacgaagagtatactgactacatgccaagcatgaaacggtttaggcgagaagaggaagaggccggcgtgttgtggtga

SEQ ID NO: 14871 - RNA, 9876 nt, synthetic construct
  misc_feature 1..9876: note = derived and/or modified CDS sequence (opt3) from DENV-2__EU482697__SS-prME
  source 1..9876: mol_type = other RNA
agcgccggcatgatcattatgctgatacccaccgtgatggctttccacctcacaactagaaacggggagcctcatatgatcgtcggaattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagagcaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccaattaaagctgaattggttcaagaaagggtcttccattggacagatgtttgaaacgaccatgcggggtgccaagcgaatggctatactaggcgatacagcctgggacttcgggtcactcggaggcgtatttactagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacaatataaatttcagcccgagagtccaagcaagttggcctccgctatccagaaagcccaggaagagggcatatgtggtattagatctgtcactaggctcgagaatctgatgtggaagcaaatcacacccgaattaaaccacattctggcagagaatgaagttaaactaaccatcatgactggcgatataaaggggatcatgcaggccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaagacgcgttttgtgactctaagttaatgagcgctgccattaaggataatagggcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatcccaaaaaacctcgcaggacccgttagtcagcacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaagctcattaccgagtggtgctgtagatcctgcacactgccgcctcttaggtatcgcggagaggacggctgttggtacggtatggaaatacggccattgaaagagaaggaagagaatctggtgaactcattagttacggcggggcacggacaagtggataatttcagtctcggcgtactgggtatggccctttttctggaagagatgttgagaaccagggtcggcactaaacatgctatcctcctggtggcagtgagcttcgtcacactaattaccgggaacatgtcgtttaaggacctgggacgcgttgtggtaatggtgggcgccactatgacagatgacatcgggatgggagtcacctatctcgctctgcttgccgcattcaaagtgcgacccacgtttgcggccggcttgctgttacggaagctcacttccaaggagctgatgatgaccacaattggtatcgttcttctgtctcagagcaccatacctgaaactgtgctagagctcacagatgctctggccttggggatgatggtcctgaaaatcgtgcgtaatatggaaaagtaccagttagcagttaccattatggctatcctctgcgtgcccaacgccgtcattctgcagaatgcatggaaagtatcatgtacaatccttgccgtggttagtgtgtccccactgttgctcacttctagccaacagaagaccgactggatacctctggctctaacgattaaaggactgaaccccacagcgatcttccttaccactctctccagaaccaataagaaaaggtcatggccactgaacgaggccatcatggcagtcggcatggtgagcattttggctagttctctgttaaagaatgacataccgatgacaggccctctcgtagccgggggactgcttactgtgtgctatgtcctgaccggtcgctccgccgatttggaactcgagcgggctacggacgttaagtgggaggatcaggcagaaatcagcggctcgtcacccattctgtctatcacaattagtgaggacgggtccatgagcatcaaaaacgaagaggaggaacagaccctaactatactgatcagaacaggacttctcgtgatttctggcctgtttccaatcagcattcccatcaccgccgcggcttggtacttgtgggaggtgaagaaacaaagggccggtgtcttatgggatgtgccttccccaccccctatggggaaggcagaactggaggacggagcctatcgaataaaacagaagggcattctcggctactcacagatcggggctggagtttaccgcgaaggtactttccacacaatgtggcatgtaacccggggcgcagtgctgatgcacaaggggaaaagaatcgagccgagttgggccgatgtcaagaaagaccttattagctatggaggcggttggaagctggagggggaatggaaagagggagaagaggtgcaggttttggcgctagaaccaggcaagaatcccagggctgtgcaaacgaagcctggcctgtttaaaactaacaccgggacaatcggagccgtctctctcgatttctccccaggtacctcaggcagtcccataattgacaagaaagggaaggtggtaggactgtacggcaacggtgtcgtgacacgtagcggggcatatgtttccgccatcgctcagactgagaaatctattgaggataatcctgaaatcgaggacgatatatttcgcaagcggagacttaccattatggacttacacccgggagccggcaagacgaaaaggtacctgcccgcaatcgtgcgagaagctatcaagcggggcctccgcacattgattctggccccaactagagtcgtggcggccgagatggaagaggcactcagggggctgcctatccggtatcagacccccgctattcgagccgagcatacaggaagagaaatagttgaccttatgtgtcacgctaccttcactatgcgcctgttgtcgccagtgagggtccctaactacaatctaatcattatggatgaggcacatttcaccgaccccgccagcatcgccgctcgtggttatatctcaacacgggtggaaatgggcgaggcggcagggatttttatgacggccactccaccgggatccagagatcctttcccccaaagtaacgctccaataatcgacgaggaaagggagattcccgaacgctcttggaatagcggccacgagtgggtaaccgattttaaaggtaagacagtgtggttcgttccttccatcaaagccgggaacgacattgcagcctgcctgcgaaagaatggaaagaaagtcatccagctctcaagaaagacctttgattctgaatacgtgaaaactcggacaaacgactgggatttcgtggtcaccacggacataagcgagatgggcgctaattttaaggcggagagggtaatcgatccacgccgttgtatgaaacccgtgattttaactgacggcgaagagagagttatcctggccgggcctatgccggtgacacatagttccgcagctcagcggaggggacgcattggtcgaaacccaaagaatgaaaacgaccagtacatctatatgggcgagccccttgaaaatgatgaggactgcgcccactggaaagaggcaaagatgctgctcgataacataaatacccctgaagggattatccccagcatgttcgagccagaaagagagaaggtcgacgccattgatggagaataccggttgaggggcgaggctcgcaaaacctttgtggacctgatgagaaggggtgatctccctgtttggctggcctataaggtggcggcagaggggatcaactacgccgaccggcgttggtgtttcgatggcataaaaaacaatcaaatccttgaagagaacgtcgaagtggagatttggactaaggagggagaacgcaaaaagctaaagccccgatggctggacgctagaatctattctgatccattggccttaaaagagtttaaggaattcgctgcaggcaggaaatcactgacactcaatctgattaccgagatggggcggcttcctacattcatgactcagaagacgcgcgacgccctggataacctcgctgtattgcacaccgccgaagcaggaggtagagcgtacaatcatgccctgtccgagctaccggagacactggaaactctccttctgttaaccttgctggctacagtgaccggcgggatctttctcttcctgatgagtggaaggggcataggtaaaatgactcttgggatgtgctgcattatcacggccagcatcctgctctggtatgcacagattcagccccactggatcgctgcctcgataattttggagtttttcctgatcgttttactaattccagaacctgagaagcaacggaccccccaggacaaccagctgacatacgtcgtgatcgcaatactcactgtggtcgccgctaccatggcgaatgaaatgggctttcttgagaagacaaaaaaggacctgggattgggctctatcgccacccagcaaccagagtccaacattctggatatcgacctccgacctgcaagcgcttggactctgtacgccgttgccacaacgttcgtgacccccatgcttagacattcaattgaaaatagttctgtaaacgtgtccctcactgcaatcgctaatcaggccacagtcctgatggggttgggaaaaggttggccgctgagcaagatggatattggcgtgccattactagcgatcgggtgttattcacaggttaaccctataaccctgaccgctgccctccttctgttggtggcacactacgccattatcggacccggcctgcaggctaaagcaacacgcgaggcccaaaagagggcggctgccggtatcatgaagaatccaactgtcgacgggattacggtaatagatctcgaccccatcccttatgatccgaaatttgaaaagcagctgggccaggtgatgcttttaattctgtgcgttacccaagtgctcatgatgcggacaacttgggcattgtgtgaggccctgaccctagctacaggacccatcagtaccctgtgggaaggcaacccagggcgtttctggaatactacgattgccgtcagcatggcaaacatctttagaggatcctacctcgctggcgccggtcttctgttctctataatgaaaaatacaaccaacactaggcgcgggaccggaaacatgggcgagacattgggtgagaagtggaaaagccggctgaatgcgctcggcaagtccgaatttcagatctataaaaagtcagggattcaggaggtggaccgaactctggccaaggaaggaatcaaaagaggcgagaccgatcaccatgcagtctctagggggagtgctaagttacgctggttcgtggagcggaacatggttacacctgaaggaaaagtggtagaccttggctgcggtagagggggatggtcgtactattgtggcggtctgaagaatgtgcgtgaggtcaaaggcctcacgaaggggggacccggccacgaagagcctattccaatgagcacctacgggtggaacctagttaggctgcagtccggagtggatgtctttttcatcccccctgaaaagtgcgacactttgctgtgtgatataggcgagtcttcaccaaatcccacagtggaggccggtcggaccctccgcgtacttaacctggtggaaaattggttgaacaataacactcaattctgcattaaagttctgaatccgtacatgcctagcgtgatcgagaagatggaagcactccagcgaaaatatgggggagctttagtcagaaacccactgtccaggaatagtacacatgagatgtactgggtgtctaacgccagcggcaatatcgtctcatccgtgaacatgattagtcggatgcttataaaccgctttaccatgagacacaagaaagccacgtatgaacccgacgttgacctgggcagcgggaccaggaatatcggaacagagtctgagattcctaacctagatatcattggtaagcgaatcgaaaagataaaacaggagcatgaaacttcctggcactacgaccaggatcacccatataagacctgggcgtaccatggctcatatgagacaaaacaaactgggagcgcttcgtctatggtaaatggagtggtccggctcctgaccaagccctgggacgtgttgccgatggttacacagatggcaatgaccgatactacgcctttcggccagcagcgtgtgtttaaagaaaaggtcgacacaagaacccaagagcccaaggagggtactaaaaagctgatgaaaatcaccgccgaatggctctggaaggagcttgggaaaaagaaaacaccacgcatgtgtacgagggaagagttcacccggaaggtgagaagtaacgctgccctgggagcaatttttactgatgagaataagtggaaatccgcccgcgaagctgtagaggacagcaggttctgggaattagtggataaggagcgaaactttcacctggaaggcaaatgcgagacatgtgtttacaatatgatgggcaagcgggagaaaaagttgggggaattcggaaaggcgaaaggttcaagagccatctggtacatgtggctcggcgcaaggtttctggagttcgaagctctagggtttcttaacgaggaccattggttctcccgcgaaaattctctgagcggagtcgagggcgagggtctccacaagctggggtatattttgcgtgatgtgagtaaaaaggaaggaggcgccatgtacgcagacgacaccgccggctgggatactcggatcacactggaggacctcaaaaacgaagagatggtgaccaatcacatggaaggggagcataagaagcttgctgaggccatttttaaactgacatatcagaacaaggtcgttagagtgcagaggcctactccccgcggaaccgtaatggatataatctcccgacgggaccaaagaggtagcggccaggtggggacgtacggattaaataccttcacaaacatggaagcgcagctgattaggcagatggagggcgaaggtgtcttcaaaaatatccaacacttgactgtgaccgaggaggttgcagtgaagaactggctcgcccgcgtcgggagagaacggctgtctaggatggctatctcaggagatgactgcgtggtaaaaccactagatgaccgttttgccaacgcacttacagctctgaatgatatgggcaagattcgaaaggacatacagcagtgggagcccagtaaaggctggaacgattggactcaggttcctttctgctcccatcactttcatgaactcatcatgaaggacgggcgcgtgctggtcgtgccatgtagaaatcaagatgagttgattggacgggccaggatcagccagggtgctggctggtctttacgcgaaaccgcctgcctggggaaatcgtatgcacagatgtggtcactcatgtacttccacagacgggaccttaggctggcggccaacgctatttgtagcgccgtgccgtcccactgggtccccacgagtcgaacaacctggtctatccatgcaaagcacgagtggatgactacagaggacatgctaaccgtttggaatcgtgtgtggataagagaaaacccttggatggaggataaaactccagtagaaagctgggaggaaatcccctatctgggaaagcgcgaggaccagtggtgcggctccctcattggtttgacctcacgggctacatgggccaagaatatccaagcagccattaaccaggtgaggagtctgatcgggaatgaggaatacacggattacatgccttctatgaaaagatttcgccgggaggaagaggaagcgggagtcctttggtga

SEQ ID NO: 14872 - RNA, 9876 nt, synthetic construct
  misc_feature 1..9876: note = derived and/or modified CDS sequence (opt3) from DENV-2__EU482699__SS-prME
  source 1..9876: mol_type = other RNA
agcgccggcatgatcattatgctgatacccaccgtgatggctttccacctcacaactagaaacggggagcctcatatgatcgtcggaattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagagcaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaagcttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggaaaaaagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttactagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcacataaccagaccttcttgattgacgggccggagactgccgagtgccccaatacaaacagagcatggaatagtctggaagtggaggattatggatttggcgtgttcaccacaaacatctggctcaggctgaaggaaaaacaggacgcgttttgtgactctaagttaatgagcgctgccattaaggataatcgtgcagtacacgccgacatgggttactggatcgagtccgctctgaacgatacttggaaaatagagaaggcctcattcattgaagtcaaaaattgccattggcctaagagccacaccctttggtctaacggggtgttggagtccgaaatgatcatcccaaaaaacctcgcaggacccgttagtcaacacaattatcggcctggctaccatacgcagattgctggtccatggcacctgggcaagctagagatggacttcgatttttgtgacgggacaaccgtgatcgtcactgaagattgcggaaaccgaggccccagcctgagaaccacaactgcctctgggaagctcattaccgagtggtgctgtaggtcctgcacactgccgcctcttcgctaccggggagaggacggctgttggtatggtatggaaataagaccattgaaagagaaggaagagaatctggtgaactcattagttacggcggggcatggacaggtggataatttcagtctcggcatcctgggtatggccctttttctggaagagatgttgaggacccgcgtaggcactaaacacgctattctcctggcagccgtcagcttcgtgacactaatcaccgggaacatgtcgtttaaggacctgggacgagtgatggtcatggttggcgctactatggccgatgacattgggatgggagtgacatacctcgcactgcttgcggccttcaaagtacggcccacctttgctgccggcttgctgttacgtagactcacgtccaaggagctgatgatgactaccatcggtatagtgcttctgtctcaaagcacaatccctgaaaccgtcctagagctcactgatgcactggctttggggatgatggtgctgaagattgttaggaaaatggaaaagtatcagttagccgtgacaatcatggcaattctctgcgtccccaatgccgtgatcctgcagaacgcttggaaagtttcatgtaccatacttgcggtggtcagtgtatccccactgttgctcacatctagccagcaaaagactgactggattcctctggccctaaccatcaaaggactgaatcccacggcaatcttccttacaaccctctcccgcactaacaagaaacggtcatggccactgaatgaggctattatggccgtgggcatggttagcatattggccagttctctgttaaagaacgacatcccgatgaccggccctctcgtggctgggggactgcttacagtctgctacgtgctgactggtagatccgcagatttggaactcgagagggccaccgacgtaaagtgggaggatcaggcggaaattagcggctcgtcacccatcctgtctattacgatcagtgaggacgggtccatgagcataaaaaatgaagaggaggaacagacactaaccatcctgattcgaactggacttctcgtgatctctggcctgtttccaattagcatccccataacagctgccgcatggtatttgtgggaggtcaagaaacagcgcgccggtgttttatgggatgtgccttccccaccccctgtggggaaggctgaactggaggacggagcataccggattaaacaaaagggcatcctcggctattcacagatcggggccggagtctacaaggaaggtaccttccatactatgtggcacgtgacaagaggcgcggttctgatgcacaaagggaagaggattgagccgagttgggctgatgtaaaaaaggaccttatcagctacggaggcggttggaaactggagggggaatggaaggagggagaagaggtgcaggtcttggccctagaaccaggcaagaacccccgtgcagtgcagaccaaacctggcctgtttaagacgaatactgggaccataggagccgtttctctcgatttctccccaggtacatcaggcagtcccattatcgacaaaaaggggaaagtggtcggactgtatggcaacggtgtggtaacccgcagcggggcttacgtctccgccattgcacaaacagagaagtctatcgaggataaccctgaaatagaggacgatatttttcggaagagaaggcttactatcatggacttacatccgggagctggcaaaaccaagcgatatctgcccgccatcgtgcgggaagcgattaaacgcggcctcagaacgttgatcctggccccaacaagggttgtggcagctgagatggaagaggccctccgggggctgcctattcgataccagactcccgctataagagcagagcacaccggacgcgaaatcgtcgaccttatgtgtcatgccacattcaccatgaggctgttgtcgccagtgcgtgttcctaattataacctaattatcatggatgaggcccacttcactgaccccgctagcatcgcggcacggggttacatttcaaccagagtggaaatgggcgaggccgctgggatatttatgacagccacgccaccgggatccagggatcctttcccccagagtaatgcaccaatcattgacgaggaacgcgagatccccgaacgatcttggaacagcggccatgagtgggtcactgattttaagggtaaaaccgtgtggttcgtaccttccattaaggccgggaatgacatcgctgcgtgcctgagaaagaacggaaaaaaggtgatacaactctcacggaaaacatttgattctgaatatgttaagaccaggactaatgactgggatttcgtcgtgacaaccgacatcagcgagatgggcgccaactttaaagcagagcgcgtgattgatccacgtagatgtatgaagcccgtcatcttaacggacggcgaagagcgggtaattctggctgggcctatgccggtgactcacagttccgccgcacagaggcgcggacgaatcggtagaaatccaaaaaacgaaaatgaccagtacatatacatgggcgagccccttgaaaacgatgaggactgcgcccactggaaggaggctaagatgctgctcgataatattaacacacctgaagggatcattcccagcatgttcgagccagaacgggagaaagttgacgccatcgatggagaatataggttgcgcggcgaggcgagaaagacctttgtggacctgatgaggcggggtgatctccctgtctggctggcatacaaagtggccgctgaggggataaattatgccgaccgtcgctggtgtttcgatggcatcaagaacaaccagattcttgaagagaatgttgaagtggagatctggaccaaaggaggcgagaagaagaaactaaagccccgatggctggacgctagaatttactctgatccattggcattaaaagaatttaaggagttcgccgctgggaggaaatcactgactctcaacctgatcacagaaatgggacggcttcctaccttcatgacacaaaagactcgcgacgccctggataatctcgcagtcttgcatacggcggaggccggtggcagagcttataaccacgccctgtccgaactaccggagaccctggagacactccttctgttaactttgctggcaaccgtgacagggggaatatttctcttcctgatgagtggcaggggtattgggaagatgacccttggcatgtgctgcatcatcactgctagcattctgctctggtacgcccagatccagccccattggatagcagcctcgattatcttggaatttttcctgattgtattactaatcccagagcctgaaaaacagcggacgccccaagacaatcagctgacctatgtggttatagctatcctcacagtcgtggcggccactatggcaaacgagatgggatttcttgaaaagaccaaaaaggacctgggcttggggtctattgctacacagcagccagagtccaatatcctggatattgacctccgacctgccagcgcctggaccctgtacgcagtggctactacattcgtcacgcccatgcttagacactcaatcgagaacagttctgttaatgtgtccctcaccgccattgcgaaccaagctactgtactgatgggattgggtaaaggctggccgctgagcaagatggatatcggggtgccattactagccataggatgttactcacaggtcaatcctattacactgaccgcagccctccttctgttggtggctcactatgcaatcatcggccccggtctgcaggccaaggcgacccgcgaagctcagaaaagggccgcagccgggattatgaagaacccaacagttgacggcataactgtgatcgatctcgaccccattccttacgatccgaaatttgagaagcaactgggacaggtcatgcttttaatcctgtgcgtaacgcaggtgctcatgatgcggaccacatgggctttgtgtgaagccctgactctagcaaccggccccattagtacactgtgggaggggaatccaggacgtttctggaacaccactatcgctgttagcatggccaatatatttagaggctcctatctcgcgggtgccgggcttctgttctctatcatgaaaaacacgacaaataccaggcgcggaactggcaacatgggtgaaaccttgggcgagaagtggaaaagccggctgaacgcactcgggaagtccgagtttcaaatttacaagaaatcaggaatccaggaagtggaccgaacactggctaaggagggcattaaaagaggggaaactgatcatcacgccgtctctaggggaagtgcaaagttacgctggttcgtggagcggaatatggtcacccctgagggcaaagtggttgaccttggttgcgggagaggaggctggtcgtattactgtggtggcctgaagaacgtgcgtgaagtaaaggggctcacaaaaggaggccccgggcatgaggaacctatcccaatgagcacgtatggatggaatctagtgaggctgcagtccggcgtcgatgtttttttcataccccctgagaagtgcgacaccttgctgtgtgatattggtgaatcttcaccaaaccccactgtggaggctgggcggacactccgcgtccttaatctggtggagaactggttgaataacaatacccagttctgcatcaaagtactgaacccgtacatgcctagcgtgatcgaaaagatggaggccctccaacgaaaatacggaggcgccttagttagaaatccactgtccaggaacagtactcacgaaatgtattgggtgtctaatgcgagcggcaacattgtctcatccgtgaatatgataagtcggatgcttatcaaccgctttacaatgagacataagaaggctacctacgagcccgacgtcgacctggggagcggaacgaggaacattggtatcgaatctgagattcctaatctagatatcataggcaaacgaatcgagaagattaaacaggaacacgagacctcctggcactatgaccaggatcatccatacaagacatgggcatatcacgggtcatacgaaactaaacagaccggaagcgcctcgtctatggtgaacggcgttgtacggctcctgacaaagccctgggacgtgttgccgactgtcacccaaatggctatgacagataccactcctttcggtcagcagcgtgtgtttaaggagaaagttgacacgagaacacaggaacccaaggaggggaccaaaaagctgatgaaaatcactgccgagtggctctggaaggaacttggaaaaaagaagaccccacgcatgtgtacaagggaggaattcacgcggaaagtgagaagtaatgcagccctgggcgctatttttaccgatgagaacaagtggaaatccgcgcgcgaggccgtcgaagacagcaggttctgggagttagtggataaggaacgaaatctgcatttggagggcaaatgcgaaacttgtgtatataacatgatggggaagcgggagaagaaactcggagagtttggtaaggcaaaaggctcaagagctatctggtacatgtggctgggggccaggttcctagaatttgaggcacttggattcctgaatgaagaccactggttttcccgcgagaactctctcagcggcgtggaaggtgaggggctgcacaagttgggatacattctgcgtgatgttagtaaaaaggagggcggcgccatgtatgctgacgacacagccgggtgggatacccggataactctcgaagaccttaagaatgaggaaatggtcacaaaccatatggagggagaacacaaaaagctggcggaggcaatcttcaaattaacctaccaaaataaggtggtgagagtccagaggcctacaccccgcggtactgttatggatattatctcccgacgggaccagagaggcagcgggcaagtgggaacctatggcctgaacacgtttaccaatatggaggcccagttgatcaggcagatggaaggtgagggggtattcaaaaacattcagcatctcacagtgactgaagaggtcgctgtgcaaaattggctggcccgcgttggaagagagcggctatctaggatggcaatatcaggcgatgactgcgtggtcaagccacttgatgaccgtttcgctaacgccctgaccgctctcaacgatatgggcaagatccgaaaagacattcagcagtgggaacccagtaaggggtggaatgattggacacaggtgcctttttgctcccaccatttccacgagctgatcatgaaagacggacgcgtattggttgtgccatgtagaaaccaagatgaattaattggtcgggccaggatcagccagggcgcagggtggtctctgcgcgagactgcgtgcctcggaaagtcgtacgcccagatgtggtcacttatgtattttcacagacgggacctgaggctagctgccaatgcaatatgtagcgctgtcccgtcccattgggtgcccaccagtcgaacgacatggtctatccacgccaaacatgaatggatgaccactgaggacatgctgacagtgtggaaccgtgtctggattagagagaatccttggatggaagataagaccccagttgagagctgggaagagatcccctacctcggcaagcgcgaagaccagtggtgcggttccttgattgggctgacttcacgggcaacctgggccaaaaacatccaagcggctataaatcaggtgaggagtcttattggaaacgaggagtatacagattacatgccttctatgaagagattccgccgggaagaggaagaggccggcgtactgtggtga

SEQ ID NO: 14873 - RNA, 9876 nt, synthetic construct
  misc_feature 1..9876: note = derived and/or modified CDS sequence (opt3) from DENV-2__EU482701__SS-prME
  source 1..9876: mol_type = other RNA
agcgccggaatgatcattatgctgatccccacagtgatggctttccacctcacaactcggaacggggagcctcatatgatcgtcggcattcaggaaaagggtaaatcccttctgtttaagacggaggacggcgttaatatgtgcaccttgatggcaatggatttaggggaactgtgtgaggacacaatcacttacaaatgcccactactcaagcaaaacgaaccggaggatattgactgttggtgcaattctacctcaacatgggtgacctatggaacttgtacaaccacgggcgagcacaggcgggaaaaacgcagtgtagccctggtgccccatgtcggtatggggcttgagactcgaaccgaaacatggatgagctccgagggagcgtggaagcacgctcagcgtatcgagacttggatactgagacatcctggcttcaccatcatggccgcaattttggcctacacaatcggcaccacgcactttcagagggtgctcattttcatcctgctgactgctgttgcaccatctatgacaatgcggtgcatagggatttcgaaccgcgattttgtggaaggagtctcaggtggcagctgggtggacatcgtactcgagcacgggagttgtgttaccactatggccaagaataaacccacattagatttcgaactgattaagaccgaggctaaacagcctgccacgcttagaaagtattgcatcgaagcgaaattgaccaacacaactaccgagtccaggtgtccaacacaaggagagccctctctgaaggaggaacaggacaagcggtttgtgtgcaaacatagcatggtcgatcgcggctggggtaatgggtgtggactattcggcaagggcgggatcgtgacttgcgcaatgtttacctgcaaaaagaacatggaaggaaaaattgtgcagcctgagaatctcgaatacacaatagtcgttaccccacactccggtgaggagcatgccgtgggcaacgacactgggaagcacggaaaagaaatcaaggtaacgccgcagtcaagtattacagaggctgaactgaccggctatggtactgtgaccatggagtgtagcccccgaacagggcttgatttcaatgaaatggtcctgttgcaaatggagaacaaggcctggctcgtgcacagacagtggtttctggacttacctctgccatggctccccggcgcagataaacaggagtctaattggatccagaaggaaacccttgttactttcaaaaaccctcatgctaagaaacaagacgtggtcgtgctgggatcccaggagggcgccatgcacgcggccttgacaggggcaacggaaatacagatgtcaagcggaaatctactgtttaccggtcatctcaagtgcaggctgcggatggacaaacttcaactgaaaggcatgagttactctatgtgtactgggaagttcaaagtagttaaggagattgctgagacacagcacggaaccatcgtgatccgtgtccagtatgaaggcgatggttccccatgcaaaattcccttcgagatcatggacttggaaaagcgctacgtgctcgggagactgattacagtcaacccgatagtgactgagaaggatagccctgttaacatcgaagccgagcccccatttggcgactcgtacattatcatcggagtggagcctggccagttaaaactgaattggttcaagaaagggtcttccattggacaaatgtttgaaaccacgatgaggggtgctaagcggatggccatactaggcgataccgcatgggacttcgggtcactcggaggcgtatttacaagtatcggtaaagccctgcatcaggtcttcggggctatttatggcgcggcatttagcggagtgtcctggactatgaagatccttattggcgttatcataacctggatcgggatgaactctcgaagcacatcattgagtgtgtccctggtcctcgtgggaattgtaactctgtaccttggcgtgatggttcaggccgatagcggttgtgtcgtgtcttggaagaataaagagctgaagtgcgggtcaggaatcttcattaccgacaacgtgcacacgtggacagaacagtataaatttcaacccgagagtccaagcaagttggcttccgccatccagaaagcacaggaagagggcatatgtggtattcgctctgtcaccagactcgagaatctgatgtggaagcagatcactcccgaattaaaccacattctggccgagaatgaagttaaactaacaatcatgaccggcgatataaaggggatcatgcaagctggaaagaggtcgctccggcctcagccaactgagctgaaatacagctggaagacctggggcaaagccaagatgctttccacagaatcacataaccagacgttcttgattgacgggccggagaccgcagagtgccccaatactaaccgcgcgtggaatagtctggaagtggaggattatggatttggcgtgttcacaaccaacatctggctcagactgaaagaaaagcaggacgctttttgtgactctaagttaatgagcgccgcagtaaaagataatagggccgtccacgctgacatgggttactggattgagtccgccctgaacgatacatggaagatcgagaaagcatcattcatagaagtgaagaattgccattggcctaaaagccacactctttggtctaacggggttttggagtccgaaatggtgattccaaagaacctcgctggacccgtcagtcaacacaattatcgtcctggctaccatacccagatcgccggtccatggcacctgggcaagctagagatggacttcgatttttgtgacgggacgacagtgatcgttaccgaagattgcggaaaccggggccccagcctgcgaactaccacagcgtctgggaaactcattactgagtggtgctgtagatcctgcaccctgccgcctcttaggtaccgcggagaggacggctgttggtatggtatggaaatccggccattgaaggagaaagaagagaatctggtgaactcattagtaacagccgggcatggacaggtcgataatttcagtctcggcattctgggtatggctctttttctggaagagatgttgagaacgagggtgggcaccaagcacgcaatactcctggtggccgtcagcttcgttactctaatcacagggaacatgtcgtttaaagacctgggacgcgtggtagtgatggtcggcgctaccatggccgatgacattgggatgggagtgacttacctcgcactgcttgcggccttcaaggttcgacccacatttgctgccggcttgctgttacggaagctcacctccaaagagctgatgatgacgactatcggtgtggtccttctgtctcaaagcaccattcctgatacagtgctagaactcaccgacgcactggctttggggatgatggttctgaagatcgtgcgtaatatggagaaatatcagttagccgtcactataatggcaatcctctgcgtacccaacgccgtgattctgcagaatgcttggaaggtttcatgtacaatccttgcggtggtcagtgtgtccccactgttgctcacctctagccagcaaaagactgactggattcctctggccctaactatcaagggactgaaccccaccgcaatattccttacgacactctccagaaccaataaaaagaggtcatggccactgaacgaagctattatggccgtaggcatggtgagcatcttggccagttctctgttaaagaatgatatcccgatgactggccctctcgtcgctgggggactgcttaccgtttgctacgtgctgacaggtcgctccgcagacttggagctcgaacgggccactgatgtgaaatgggaggaccaggcggagattagcggctcgtcacccatactgtctatcaccattagtgaagatgggtccatgagcatcaagaacgaggaagaggagcagacgctaacaattctgatcagaaccggacttctcgtcatatctggcctgtttccaatcagcattcccatcactgctgccgcatggtatttgtgggaagtgaaaaagcagagggccggtgttttatgggacgtaccttccccaccccctatggggaaagctgagctggaagatggagcataccgaattaagcaaaagggcatcctcggctattcacagataggggccggagtgtacaaagagggtacattccataccatgtggcacgtcactcgcggcgcggtgctgatgcacaaggggaaacggattgaaccgagttgggctgacgttaagaaagatcttatcagctacggaggcggttggaagctggagggggagtggaaggaaggagaggaagtgcaggtcttggccctagagccaggcaaaaatcccagagcagtgcagacaaagcctggcctgtttaaaaccaacacggggactatcggagccgtatctctcgacttctccccaggtacctcaggcagtcccattatcgataagaaagggaaggtcgtgggactgtatggcaacggtgttgtgacaaggagcggggcttacgtctccgccatagcacaaaccgaaaagtctattgaggacaatcctgagatcgaagatgacatttttcgtaaacgccggcttacaatcatggacttacatccgggagctggcaagactaaaagatatctgcccgccatagtgagggaggcgattaagcgaggcctccggaccttgatcctggccccaacgcgcgttgtggcagctgaaatggaggaagccctcagagggctgcctatcaggtaccagacacccgctattcgggcagagcacactggacgagagatcgtcgatcttatgtgtcatgccaccttcacaatgagactgttgtcgccagtgcgcgtacctaactataatctaattataatggacgaagcccacttcaccgatcccgctagcatcgcggcaaggggttacatttcaactcgtgtggagatgggcgaagccgctgggatctttatgaccgccacaccaccgggatcccgggaccctttcccccagagtaacgcaccaatcattgatgaggagagagaaatacccgagaggtcttggaatagcggccatgaatgggttacggactttaaaggtaagactgtctggttcgtgccttccatcaaggccgggaacgatattgctgcgtgcctgcgcaaaaatggaaagaaagtgatccaactctcacgaaagacctttgactctgagtatgtcaaaacaagaaccaacgattgggacttcgtagtgactacagatattagcgaaatgggcgccaattttaaggcagagcgggttatcgacccaaggcgctgtatgaaacccgtgatattaaccgacggcgaggaacgtgtcatcctggctgggcctatgccggtgacgcacagttccgccgcacagagacggggaaggattggtcgcaacccaaagaatgagaacgatcagtacatctacatgggcgaaccccttgagaatgacgaagattgcgcccactggaaggaggctaaaatgctgctcgacaacattaatactcctgaggggatcatacccagcatgttcgaaccagagcgagaaaaggttgatgccattgacggagagtatagattgcggggcgaagcgaggaaaacatttgtggatctgatgcgcagaggtgacctccctgtctggctggcatacaaggtggccgctgaggggatcaactatgccgataggcggtggtgtttcgacggcattaaaaacaatcagatccttgaggaaaacgtagaggtggaaatatggaccaaggagggagagcgtaagaaactaaagccccgctggctggatgctcgaatctactctgacccattggcattaaaagaatttaaggagttcgccgctggcagaaaatcactgaccctcaatctgattactgaaatggggaggcttcctacattcatgacccaaaagacacgggatgccctggacaacctcgcagttttgcatactgcggaggccggaggtcgcgcttataatcacgccctgtccgaactaccggagacgctggagaccctccttctgttaacattgctggcaactgtcaccggcgggatctttctcttcctgatgagtggaagaggcattggtaagatgacacttgggatgtgctgcatcataaccgctagcattctgctctggtacgcccagatccagccccattggatcgcagcctcgattatcttggaatttttcctgatagtgttactaattccagagcctgaaaaacagaggactccccaagacaaccagctgacgtatgtggtcatcgctattctcaccgttgtggcggccacaatggcaaatgagatgggctttcttgaaaagactaaaaaggatctgggattgggctctatcgctacccagcagccagagtccaacatactggacatcgatctccggcctgccagcgcctggacactgtacgcagtagctaccactttcgtgacacccatgcttcgacactcaattgagaatagttctgtcaacgtgtccctcacggccatcgcgaatcaagctaccgttctgatggggttgggaaaaggttggccgctgagcaagatggacattggcgtgccattactagccatcgggtgttactcacaggtcaaccctattactctgacagcagccctccttctgttggtagctcactatgcaatcataggacccggcctgcaggccaaggcgaccagagaagctcagaaacgcgccgcagccggtattatgaagaatccaaccgtggatgggatcacagttatcgacctcgatcccattccttacgacccgaaatttgagaagcaactgggccaggtgatgcttttaatactgtgcgtcactcaggtgctcatgatgaggacgacctgggctttgtgtgaagccctgacactagcaactggacccatcagtaccctgtgggagggcaacccagggcggttctggaatacaaccattgctgtcagcatggccaacatctttcgtggatcctatctcgcgggcgccggtcttctgttctctattatgaaaaatactacgaacacaagaagggggaccggaaacatgggcgaaactttgggtgagaagtggaaaagccgcctgaatgcactcggcaagtccgagtttcaaatctacaagaaatcagggatacaggaagtggatcggaccctggctaaggagggaatcaaacgaggcgaaacagaccatcacgccgtttctagagggagtgcaaagttaaggtggttcgtggagcgcaacatggtaactcctgagggaaaagtggtcgatcttggctgcggtagagggggatggtcgtattactgtggcggtctgaagaatgttagagaagtgaagggcctcaccaaagggggacccggccatgaggaacctattccaatgagcacatatgggtggaacctagtccgtctgcagtccggagtggacgtatttttcataccccctgagaagtgcgatacgttgctgtgtgacattggcgaatcttcaccaaatcccaccgtggaggctggtaggactctccgggttcttaacctggtggagaattggttgaacaataacacacagttctgcatcaaagtcctgaatccgtacatgcctagcgtgatagaaaagatggaggccctccaacgcaaatacgggggagccttagtccgaaacccactgtccagaaatagtacccacgaaatgtattgggtgtctaacgcgagcggcaatattgtttcatccgtaaacatgatcagtaggatgcttatcaaccggtttactatgcgccataagaaggctacatacgagcccgacgtggatctgggcagcgggaccagaaatattggaatagaatctgagatccctaacctagacattatcggtaaaaggattgagaagatcaaacaggaacacgagacgtcctggcactatgatcaggaccatccatacaagacctgggcatatcacggctcatacgaaacaaaacagactgggagcgcctcgtctatggtcaatggagtggttcgactcctgaccaagccctgggatgtgttgccgacagtcactcaaatggctatgaccgacacaacccctttcggccagcagcgggtgtttaaggagaaagtagatactcgtacgcaggaacccaaggagggtaccaaaaagctgatgaaaataaccgccgagtggctctggaaggaacttgggaaaaagaagactccaagaatgtgtacccgcgaggagttcacaaggaaagtgcggagtaacgcagccctgggagctatctttacggacgagaataagtggaaatccgcgagagaggccgttgaagatagccgcttctgggagttagtcgacaaggaaaggaacctgcatttggagggcaaatgcgaaacctgtgtgtataatatgatgggcaagcgagagaagaaactcggggagtttggaaaggcaaaaggttcacgggctatttggtacatgtggctgggcgccagattcctagaatttgaggcacttgggttcctgaacgaagatcactggttttccagggaaaattctctcagcggagtggaaggcgagggtctgcacaagttggggtacatcctgcgcgacgtcagtaaaaaggagggaggcgccatgtatgctgacgatactgccggctgggacacacgtattaccctcgaagatcttaagaacgaggaaatggttactaatcatatggagggggaacacaaaaagctggcggaggcaatcttcaaattaacataccaaaacaaggtggtacgggtgcagagacctacccccaggggaacagtcatggacattatatcccgccgagatcagcggggtagcggccaagtggggacttatggactgaatacctttacgaacatggaggcccagttgatcagacagatggaaggcgagggtgttttcaaaaatattcagcatctcaccgtgacagaagaggtcgctgtgcaaaactggctggccagggtagggcgcgagagactatctcggatggcaatctcaggagacgattgcgttgtgaagccacttgacgataggttcgctaacgccctgactgctctcaatgacatgggcaagatccgtaaagatattcagcagtgggaacccagtaagggctggaacgactggacccaggtccctttttgctcccaccatttccacgagctgataatgaaagatgggcgagtgttggtggtcccatgtcgcaatcaagacgaattaatcggtagagcccggattagccagggagcaggctggtctctgagggagacagcgtgcctcgggaagtcgtacgcccagatgtggtcacttatgtattttcaccgcagagacctgcggctagctgccaacgcaatctgtagcgctgttccgtcccattgggtgcccacaagtaggaccacgtggtctattcacgccaaacatgaatggatgacaaccgaggatatgctgactgtatggaatcgagtgtggatccgtgagaacccttggatggaagacaagacaccagtcgagagctgggaagagataccctacctcggaaagagagaagatcagtggtgcggctccttgatcggtctgacctcacgcgcaacttgggccaaaaatattcaagcggctatcaaccaggtgcggagtcttattgggaatgaggagtataccgactacatgccttctatgaagaggttcagacgcgaagaggaagaggccggagttctgtggtga

SEQ ID NO: 14874 - RNA, 9876 nt, synthetic construct
  misc_feature 1..9876: note = derived and/or modified CDS sequence (opt3) from DENV-2__EU482703__SS-prME
  source 1..9876: mol_type = other RNA
agcgccggaatgatcattatgctgatacccaccgtgatggctttccacctcactactagaaacggggagcctcatatgatcgtcgggattcaagaaaagggtaaatcccttctgtttaagacggaggacggcgttaatatgtgcaccttgatggcaatggatttaggggaactgtgtgaggacacgatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagaggtacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactgccgagtgccccaatacaaacagagcatggaatagtctggaagtggaggattacggatttggcgtgttcaccacaaacatctggctcaagctgaaagaaaagcaggacgcgttttgtgactctaagttaatgagcgctgccattaaagataatagggcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaaactcattaccgagtggtgctgtagatcctgcacactgccgcctcttaggtatcgcggagaggacggctgttggtacggtatggaaatacggccattgaaggagaaagaagagaatctggtgaactcattagttacggcggggcacggacaggtggataatttcagtctcggcgtactgggtatggccctttttctggaagagatgttgagaaccagggtcggcactaagcatgctatcctcctggtggcagtgagcttcgtcacactaattaccgggaacatgtcgtttaaagacctgggacgcgttgtggtaatggtgggcgccactatggctgatgacatcgggatgggagtcacatatctcgccctgcttgcagcgttcaaggtgcgacccacctttgccgctggcttgctgttacggaagctcacgtccaaagagctgatgatgactaccattggtatcgttcttctgtctcaaagcacaatacctgaaaccgtgctagagctcactgatgccctggcattggggatgatggtcctgaagatcgtgcgtaatatggaaaaataccagttagctgttacaattatggccatcctctgcgtgcccaacgcagtcattctgcagaatgcctggaaggtaggatgtaccatccttgctgtggtttcagtgagtccactgttgctcacatcctctcagcagaaaactgactggatacctctggcgctaaccattaagggcctgaaccccacggccatcttccttacaaccctcagcagaactaataaaaagaggtcctggccactgaacgaggcaatcatggctgtcggcatggtgtcaattttggccagcagtctgttaaagaatgacataccgatgaccgggcctctcgtagccggaggtctgcttacagtgtgctatgtcctgactggccgctctgctgatttggaactcgagcgggcaaccgacgttaaatgggaggatcaggccgaaatctccgggagctcgcccattctgtcaatcacgatttctgaggacggaagtatgtccatcaagaacgaagaggaggaacagacactaaccatactgatcagaactggccttctcgtgattagcggtctgtttccaatctctattcccatcacagcggctgcctggtacttgtgggaggtgaaaaagcagagggcaggggtcttatgggatgtgcctagcccaccccctatgggaaaagccgaactggaggacggcgcttatcgaataaagcaaaagggcattctcgggtactcccagatcggagccggtgtttacaaagaaggcaccttccacactatgtggcatgtaacacgcggggcagtgctgatgcacaagggaaaacggatcgagccgtcatgggcggatgtcaagaaagaccttattagttatggcggtgggtggaagctggagggagaatggaaggagggcgaagaggtgcaggttttggctctagaaccaggcaaaaatcccagagccgtgcagaccaagcctgggctgtttaaaacgaacactggaaccatcggtgcagtcagcctcgatttctctccaggcacatccgggtcacccataattgacaagaaaggaaaggtggtaggcctgtacggtaacggggtcgtgaccaggagtggagcctatgttagcgctatcgcccaaacagagaagtccattgaggataatcctgaaatcgaggacgatatatttcgtaaacgccggcttactattatggacttacacccgggcgcaggcaagaccaaaagatacctgcccgctatcgtgagggaagccatcaagcgagggctccggacgttgattctggcgccaacacgcgtcgtggccgcagagatggaagaggctctcagaggactgcctatcaggtatcagactcccgccattcgggctgagcataccggtcgagaaatagttgaccttatgtgtcacgcaacattcaccatgagactgttgtctccagtgcgcgtccctaactacaatctaatcattatggatgaggcccatttcactgaccccgcctcgatcgctgcgaggggctatatcagcacccgtgtggaaatgggggaggcagccggaatttttatgacagctacgccaccgggctcacgggatcctttcccccagtccaacgccccaataatcgacgaggaaagagagattcccgaaaggagttggaactctggtcacgagtgggtaactgattttaaagggaagaccgtgtggttcgttcctagcatcaaggcaggaaacgacattgccgcttgcctgcgcaaaaatggcaagaaagtcatccaactctcccgaaagacatttgattcagaatacgtgaaaaccagaactaacgactgggatttcgtggtcacaaccgacatatctgagatgggcgcgaattttaaggccgagcgggtaatcgatccaaggcgctgtatgaaacccgtgattttaacggacggggaagaacgtgttatcctggcaggacctatgccggtgactcatagcagtgctgcccagagacggggtaggattggccgcaacccaaagaatgaaaacgaccagtacatctatatgggggagccccttgaaaatgatgaggactgcgcacactggaaggaggccaaaatgctgctcgataacataaatacacctgaaggaattatcccctccatgttcgagccagaacgagagaaggtcgacgctattgatggcgaatacagattgcggggtgaggccaggaaaacctttgtggacctgatgcgcagaggggatctccctgtttggctggcgtataaggtggcagccgagggcatcaactacgctgacaggcggtggtgtttcgatggaatcaaaaataatcagatccttgaagagaacgtcgaagtggagatttggaccaaggagggcgaacgtaagaaactaaagccccgctggctggacgcccgaatctatagcgatccattggctttaaaagagtttaaggagttcgcagccgggagaaaatctctgactctcaatctgattacagagatgggaaggcttcctaccttcatgacacaaaagactcgggacgctctggataacctcgccgtattgcacacggcagaagcgggtggccgcgcctacaatcatgctctgtcagagctaccggagaccctggaaacactccttctgttaactttgctggccaccgtgacagggggaatctttctcttcctgatgtccggcagaggtatagggaagatgacccttggcatgtgctgcattatcactgcaagtatcctgctctggtatgctcagattcagccccactggatcgccgcaagcataattttggagtttttcctgatcgttttactaattccagaacctgagaaacagaggacgccccaagacaaccagctgacctacgtcgtgatcgccatactcacagtggtcgctgcgactatggccaatgaaatgggatttcttgagaagaccaaaaaggacctgggcttggggtcgatcgcaacacagcagccagagtctaacattctggatatcgacctccggcctgcttccgcctggaccctgtacgccgttgcaactacattcgtgacgcccatgcttcgacatagcattgaaaattcaagtgtaaacgtgtctctcaccgctatcgccaatcaagcgactgtcctgatgggattgggtaaaggctggccgctgtccaagatggatattggggtgccattactagctatcggatgttatagccaggttaaccctataacactgaccgccgcactccttctgttggtggcccactacgctattatcggccccggtctgcaggcaaaggccaccagagaggcgcagaaacgcgctgccgcagggatcatgaagaatccaacagtcgacggcattactgtaatagatctcgaccccatcccttatgatccgaaatttgaaaagcaactgggacaggtgatgcttttaattctgtgcgttacacaggtgctcatgatgaggaccacatgggccttgtgtgaggctctgactctagccaccggccccatctcaacactgtgggaagggaacccaggacggttctggaataccactattgcagtcagtatggctaacatctttcgtggcagctacctcgccggtgcggggcttctgttctccataatgaaaaatacgacaaacaccagaaggggaactggcaacatgggtgagaccttgggcgagaagtggaaatctcgcctgaatgccctcggaaagagcgaatttcaaatctataagcggtccggcattcaggaggtggaccgaacactggcaaaagaaggcatcaagagaggggagactgatcaccatgctgtctcaaggggatctgccaaattacgctggttcgtggagcggaacatggttacccctgaaggcaaggtggtagaccttggttgcgggagaggaggctggagttactattgtggtggcctgaaaaatgtgcgtgaggtcaaggggctcacaaagggaggccccgggcacgaagaacctattccaatgtcgacgtacggatggaacctagttaggctgcagagcggcgtggatgtctttttcataccccctgaaaaatgcgacaccttgctgtgtgatataggtgagtcctctccaaatcccactgtggaggcagggcggacactccgcgtacttaacctggtggaaaattggttgaacaataacacccagttctgcattaaggttctgaatccgtacatgccttcagtgatcgagaaaatggaagctctccaacgaaagtatggaggcgccttagtcagaaacccactgagcagaaattccactcatgagatgtactgggtgagtaacgcctctggcaatatcgtcagctcagtgaacatgatttcccggatgcttataaaccgctttacaatgagacacaaaaaggcgacctatgaacccgacgttgacctggggagtggaacgaggaatatcggtattgagagcgagatccctaacctagatattatcggcaagcgaatagagaaaatcaagcaggagcatgaaacctcttggcactacgaccaggatcacccatataaaacatgggcttaccatgggtcctatgagactaagcagaccggatcagcaagctcgatggtaaatggcgtggtccggctcctgacaaaaccctgggacgtgttgccgactgttacccaaatggccatgacagataccactcctttcggtcagcagcgtgtgtttaaggaaaaggtcgacacgagaacacaggagcccaaagaggggaccaagaaactgatgaagattactgctgaatggctctggaaagagcttggaaagaaaaagaccccacgcatgtgtacaagggaagagttcacgaagaaagtgcggtctaacgccgcactgggcgccatctttaccgatgagaataagtggaaaagtgctagagaagcggtagaggactcccgcttctgggaattagtggataaggagaggaacctgcacttggaaggcaaatgcgagacttgtgtttacaatatgatggggaagcgagagaagaaactcggagaatttggtaaggccaaaggcagccgggcaatttggtacatgtggctgggggctagattcctagagtttgaagcccttggattcctgaacgaggaccattggttttcaagggaaaattccctctctggcgtcgagggtgaggggctgcacaagttgggatatatcctgcgcgatgtgagcaaaaaggaaggcggcgcaatgtacgccgacgacacagctgggtgggatacccgtattactctcgaggaccttaagaacgaagagatggtgacaaatcacatgaaaggagaacataagaaactggccgaggcgatattcaagttaacctatcaaaacaaagtcgttcgggtgcagagacctacacccaggggtactgtaatggatatcattagtcgccgagaccagcggggctccgggcaagtgggaacctacggcctgaatacgtttaccaacatggaggcacagttgatcagacagatggaaggtgagggggtcttcaagaatatccagcacctcacagtgactgaagaggttgccgtgcaaaactggctggctagggtcggacgcgagagactaagccggatggccatttctggcgatgactgcgtggtaaagccacttgatgacaggttcgcaaacgctctgaccgccctcaatgatatgggcaaaatacgtaaggacatccagcagtgggaaccctcaaaagggtggaacgattggacacaggttcctttttgcagtcatcacttccatgagctgattatgaaggacggacgagtgttggtcgtgccatgtcgcaatcaagatgaattaatcggtagagctcggatttcccagggcgccgggtggagcctgagggagactgcatgcctcggaaaatcttatgcgcagatgtggtcgcttatgtactttcaccgcagagacctgcggctagccgctaacgccatctgttcagcagtgccgagccactgggtccccacctccaggacgacatggagtatacatgctaagcacgaatggatgaccactgaggacatgctgacagtttggaatcgagtgtggatccgtgagaacccttggatggaagataagaccccagtagagtcttgggaagagattccctatctcggcaaaagagaagaccagtggtgcggtagcttgatcgggctgacttcccgcgccacctgggcaaagaatattcaagccgcgatcaaccaggtgcggtcacttataggaaatgaggagtacacagattacatgcctagtatgaaaaggttcagacgcgaagaggaagaggctggcgtcctgtggtga

SEQ ID NO: 14875 - RNA, 9876 nt, synthetic construct
  misc_feature 1..9876: note = derived and/or modified CDS sequence (opt3) from DENV-2__EU482705__SS-prME
  source 1..9876: mol_type = other RNA
agcgccggaatgatcattatgctgatacccaccgtgatggctttccacctcactactagaaacggggaacctcatatgatcgtcggtattcaagaaaagggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactacagagtgccccaataccaacagagcctggaatagtctggaagtggaggattacggatttggcgtgttcacaactaacatctggctcaagctgaaagaaaagcaggacgcattttgtgactctaagttaatgagcgcggctattaaagataatagggccgtacatgcagacatgggttattggatcgagtccgccctgaacgatacctggaagatagagaaggcttcattcattgaagtcaagaattgccactggcctaaaagccatacgctttggtctaacggggtgttggagtccgaaatgatcatcccaaagaacctcgccggacccgttagtcaacacaattaccgtcctggctaccacacacagattgcaggtccatggcatctgggcaagctagagatggacttcgatttttgtgacgggaccactgtgatcgtcaccgaagattgcggaaaccggggccccagcctgcgaacaactaccgcttctgggaaactcattacagagtggtgctgtagatcctgcacgctgccgcctcttaggtatcgcggagaggacggctgttggtacggtatggaaatacggccattgaaggagaaagaagagaatctggtgaactcattagttaccgccgggcacggacaggtggataatttcagtctcggcgtactgggtatggcgctttttctggaagagatgttgagaactagggtcggcacaaagcatgccatcctcctggtggctgtgagcttcgtcaccctaattactgggaacatgtcgtttaaagacctgggacgcgttgtggtaatggtgggcgcaacaatggccgataatatcgggatgggagtcacctatctcgctctgcttgccgcattcaaggtgcgacccacgtttgcggccggcttgctgttacggcgtctcacttccaaggagctgatgatgaccacaattggtatcgttcttctgtctcaaagcaccatacctgaaactgtgctagagctcacagacgctctggccttggggatgatggtcctgaaaatcgtgagaaacatggaaaagtaccagttagcagttaccattatggctatcctctgcgtgcccaatgccgtcattctgcagaacgcatggaaagtatcatgtacaatccttgccgtggttagtgtgtccccactgttgctcacttctagccagcaaaagaccgattggatacctctggctctaacgattaaaggactgaatcccacagcgatcttccttaccactctctccaggaccaacaagaaacgctcatggccactgaatgaggccatcatggcagtcggcatggtgagcattttggctagttctctgttaaagaacgacataccgatgacaggccctctcgtagccgggggactgcttactgtgtgctatgtcctgaccggtcggtccgccgacttggaactcgagagagctacggatgttaagtgggaggaccaggcagaaatcagcggctcgtcacccattctgtctatcacaattagtgaggatgggtccatgagcatcaaaaatgaagaggaggaacagaccctaactatactgatcaggacaggacttctcgtgatttctggcctgtttccaatcagcattcccatcaccgccgcggcttggtacttgtgggaggtgaagaaacagcgagccggtgtcttatgggacgtgccttccccaccccctatggggaaggcagaactggaggatggagcctatcgcataaaacaaaagggcattctcggctactcacagatcggggctggagtttacaaggaaggtactttccacacaatgtggcatgtaacccggggcgcagtgctgatgcacaaagggaagagaatcgagccgagttgggccgacgtcaaaaaggatcttattagctatggaggcggttggaaactggagggggaatggaaggagggagaagaggtgcaggttttggcgctagaaccaggcaagaaccccagggctgtgcagacgaaacctggcctgtttaagactaacaccgggacaatcggagccgtctctctcgacttctccccaggtacctcaggcagtcccataattgataaaaaggggaaagtggtaggactgtacggcaatggtgtcgtgacacgtagcggggcatatgtttccgccatcgctcaaactgagaagtctattgaggacaaccctgaaatcgaggatgacatatttcgcaagcggagacttaccattatggatttacacccgggagccggcaaaacgaagaggtacctgcccgcaatcgtgcgagaagctatcaaacggggcctccgcacattgattctggccccaactagagtcgtggcggccgagatggaagaggcactcagggggctgcctatccggtatcagacccccgctattcgagccgagcatacaggaagagaaatagttgaccttatgtgtcacgctaccttcactatgcgcctgttgtcgccagtgagggtccctaattacaacctaatcattatggacgaggcacatttcaccgatcccgccagcatcgccgctcgtggttatatctcaacacgggtggaaatgggcgaggcggcagggatttttatgacggccactccaccgggatccagagaccctttcccccagagtaatgctccaataatcgatgaggaaagggagattcccgaacgctcttggaacagcggccacgagtgggtaaccgactttaagggtaaaacagtgtggttcgttccttccatcaaggccgggaatgatattgcagcctgcctgcgaaagaacggcaagaaggtcatccaactctcaagaaaaacctttgactctgaatacgtgaagactcggacaaatgattgggacttcgtggtcaccacggatataagcgagatgggcgctaactttaaagcggagagggtaatcgacccacgccgttgtatgaagcccgtgattttaactgatggcgaagagagagttatcctggccgggcctatgccggtgacacatagttccgcagctcagcggaggggacgcattggtcgaaatcccaaaaacgaaaatgaccagtacatctatatgggcgagccccttgaaaacgacgaggattgcgcccactggaaggaggcaaagatgctgctcgacaatataaacacccctgaagggattatccccagcatgttcgagccagaaagagagaaagtcgatgccattgacggagaataccggttgaggggcgaggctcgcaagacctttgtggatctgatgagaaggggtgacctccctgtttggctggcctataaagtggcggcagaggggatcaactacgccgatcggcgttggtgtttcgacggcataaagaataaccagatccttgaagagaatgtcgaagtggagatttggactaaagagggagaacgcaagaagctaaaaccccgatggctggatgctagaatctattctgacccattggccttaaaggagtttaaagagttcgctgcaggcaggaagtcactgacactcaacctgattaccgagatggggcggcttcctacattcatgactcagaaaacgcgcgatgccctggacaatctcgctgtattgcacaccgccgaagcaggaggtagagcgtacaaccatgccctgtccgagctaccggagacactggaaactctccttctgttaaccttgctggctacagtgaccggcgggatctttctcttcctgatgagtggaaggggcataggtaagatgactcttgggatgtgctgcattatcacggccagcatcctgctctggtatgcacagattcagccccactggatcgctgcctcgataattttggagtttttcctgatcgttttactaattccagaacctgagaagcagcggaccccacaagataatcagctgacatacgtcgtgatcgcaatactcactgtggtcgccgctaccatggcgaacgaaatgggctttcttgagaaaacaaagaaagacctgggattgggctctatcgccacccagcagccagagtccaatattctggacatcgatctccgacctgcaagcgcttggactctgtacgccgttgccacaacgttcgtgacccccatgcttagacattcaattgaaaacagttctgtaaatgtgtccctcactgcaatcgctaaccaagccacagtcctgatggggttgggaaagggttggccgctgagcaaaatggacattggcgtgccattactagcgatcgggtgttattcacaggttaatcctataaccctgaccgctgccctccttctgttggtggcacactacgccattatcggacccggcctgcaggctaaggcaacacgcgaggcccagaagagggcggctgccggtatcatgaaaaacccaactgtcgatgggattacggtaatagacctcgatcccatcccttatgacccgaagtttgaaaaacaactgggccaggtgatgcttttaattctgtgcgttacccaggtgctcatgatgcggacaacttgggcattgtgtgaggccctgaccctagctacaggacccatcagtaccctgtgggaaggcaatccagggcgtttctggaacactacgattgccgtcagcatggcaaatatctttagaggatcctacctcgctggcgccggtcttctgttctctataatgaagaacacaaccaacactaggcgcgggaccggaaatatcggcgagacattgggtgagaaatggaaaagccggctgaacgcgctcggcaaatccgaatttcaaatttataagaagtcagggatccaggaggtggatcgaactctggccaaagaaggaattaagagaggcgagaccgaccaccatgcagtctctagggggagtgctaaattacgctggttcgtggagcggaatatggttacacctgaaggaaaggtggtagatcttggctgcggtagagggggatggtcgtactattgtggcggtctgaaaaacgtgcgtgaggtcaagggcctcacgaaagggggacccggccacgaagaacctatcccaatgagcacctacgggtggaatctagttaggctgcagtccggagtggacgtctttttcataccccctgaaaaatgcgatactttgctgtgtgacattggcgagtcttcaccaaaccccacagtggaggccggtcggaccctccgcgtacttaatctggtggaaaactggttgaataacaatactcagttctgcatcaaggttctgaacccgtacatgcctagcgtgatcgagaaaatggaagcactccaacgaaagtatgggggagctttagtcagaaatccactgtccaggaacagtacacatgagatgtactgggtgtctaatgccagcggcaacattgtctcatccgtgaacatgataagtcggatgcttatcaatcgctttaccatgagacacaaaaaggccacgtatgaacccgatgttgacctgggcagcgggaccaggaacattggaatcgagtctgagattcctaatctagacatcataggtaagcgaatcgagaaaattaagcaggagcatgaaacatcctggcactacgatcaggaccacccatataaaacttgggcgtaccatggctcatatgagaccaagcagacagggagcgcttcgtctatggtaaacggagtggtccggctcctgactaaaccctgggatgtgttgccgaccgttacacaaatggcaatgaccgacactacgcctttcggccagcagcgtgtgtttaaggaaaaggtcgatacaagaacccaggagcccaaagagggtactaagaaactgatgaagatcaccgccgaatggctctggaaagagcttgggaagaaaaagacaccacgcatgtgtacgagggaagagttcacccggaaggtgagaagtaatgctgccctgggagcaatttttactgacgagaacaaatggaagtccgcccgcgaagctgtagaggatagcaggttctgggaattagtggacaaagagcgaaatctgcacttggaaggcaagtgcgagacatgtgtttacaacatgatgggcaaacgggagaagaagctcggggaatttggaaaagcgaagggttcaagagccatctggtacatgtggctgggcgcaaggttcctagagtttgaagctcttgggttcctgaatgaggatcattggttttcccgcgaaaactctctcagcggagtcgagggcgagggtctgcacaaattggggtatattctgcgtgacgtgagtaagaaagaaggaggcgccatgtacgcagatgacaccgccggctgggacactcggataacactcgaggatcttaagaatgaagagatggtgaccaaccacatggaaggggagcataagagactggctgaggccatcttcaaattaacatatcaaaataaggtcgttagggtgcagcgccctactccccgaggaaccgtaatggacattatctcccggagagatcagaggggtagcggccaagtggggacgtacggactgaacacctttacaaatatggaagcgcagttgatccgccagatggagggcgaaggtgtcttcaaaaacattcagcacctcactgtgaccgaggaggttgcagtgcaaaactggctggccagagtcgggcgggaaaggctatctcgtatggctatatcaggagacgattgcgtggtaaagccacttgacgatcgattcgccaatgcactgacagctctcaacgacatgggcaaaatccgcaaggatattcagcagtgggagcccagtaagggctggaatgactggactcaggttcctttttgctcccatcacttccatgaactgatcatgaaagatgggagagtgttggtcgtgccatgtcggaaccaagacgagttaattggaagggcccgcatcagccagggtgctggctggtctctgagagaaaccgcctgcctcgggaagtcgtatgcacagatgtggtcacttatgtactttcaccggagggatctgcgactagcggccaatgctatatgtagcgccgtgccgtcccactgggtccccacgagtcgtacaacctggtctatccatgcaaaacacgagtggatgactacagaggacatgctgaccgtttggaacagagtgtggattcgcgaaaatccttggatggaggacaagactccagtagaaagctgggaggaaatcccctatctcggaaaacgggaggatcagtggtgcggctccttgattggtctgacctcaagggctacatgggccaagaacatccaagcagccataaatcaggtgagaagtcttattgggaacgaggaatacacggactacatgccttctatgaagcgcttccggagggaggaagaggaagcgggagtcctgtggtga

SEQ ID NO: 14876 - RNA, 9876 nt, synthetic construct
  misc_feature 1..9876: note = derived and/or modified CDS sequence (opt3) from DENV-2__EU482463__SS-prME
  source 1..9876: mol_type = other RNA
agcgccggcatgatcattatgctgataccaaccgtgatggctttccacctcactactagaaatggggagcctcatatgatcgtctccattcaggaaaaggggaaatctcttctgtttaagacggaggacggtgttaatatgtgcaccttgatggcgatggatttaggcgaactgtgtgaggacactatcacttacaaatgcccactactcaggcaaaacgaaccggaggatattgactgttggtgcaattcaaccagtacgtgggtgacctatgggacttgtacaaccacgggagagcaccggcgcgaaaagcgaagcgtagccctggtgccacatgtcggcatgggtcttgagactcgtaccgaaacatggatgtcctctgagggggcgtggaaacacgctcagagaatcgagacttggatactgaggcatcctggattcaccatcatggccgcaattttggcctacacaatcggcaccacgcactttcagcgggtgctcattttcatcctgctgactgctgttgcaccatcgatgacaatgcgctgcataggcatttcaaacagagattttgtggaaggggtcagcggaggtagttgggtggacatcgtactcgagcacggctcctgtgttaccactatggccaagaataagcccacattagatttcgaactgattaaaaccgaggctaagcagcctgccacgcttaggaaatattgcatcgaagcgaagttgaccaacacaactaccgagtctcggtgtccaacacaaggggagcccagcctgaaagaagaacaagacaagcgctttgtgtgcaagcattccatggtcgatcgaggatggggcaatggttgtgggctattcggaaaaggcggcatcgtgacttgcgcaatgtttacctgcaagaaaaacatggaagggaagattgtgcagcctgagaatctcgaatacacaatagtcgttaccccacactcaggagaggagcatgccgtgggtaacgacactggcaaacacgggaaggaaatcaaagtaacgccgcagagtagcattacagaggctgaactgaccggatatggcactgtgaccatggagtgttctcccagaacaggtcttgatttcaatgaaatggtcctgttgcaaatggagaacaaggcctggctcgtgcacaggcagtggtttctggacttacctctgccatggctccccggggcagataagcaggagtccaattggatccagaaagaaacccttgttactttcaagaaccctcatgctaaaaagcaagacgtggtcgtgctgggctcacaggagggagccatgcacacagcgttgacgggcgccaccgaaatacagatgagcagtgggaatctactgtttactggacatctcaaatgccggctgcgtatggacaaacttcaactgaagggtatgtcttactccatgtgtacaggcaaattcaaggtagttaaagagattgcagagacccagcacgggacaatcgtgatccgcgtccagtatgaaggagatggcagcccatgcaagattcccttcgagatcatggacttggagaagcggtacgtgctcggtaggctgattactgtcaacccgatagtgaccgagaaggattcgcctgttaacatcgaagctgagcccccatttggggactcttacattatcatcggcgtggagcctggacagttaaagctgaattggttcaaaaagggctcctcaattgggcaaatgtttgaaacgaccatgcggggagccaaacgaatggctatactaggtgatacagcctgggacttcggcagtctcgggggagtatttactagcatcggcaaggcactgcatcaggtcttcggtgccatttatggggctgcgttttccggcgtgtcttggaccatgaaaatccttattggagttatcataacatggatcggcatgaacagccgctcaacaagtttgtccgtgagcctggtcctcgtggggattgtaaccctgtaccttggagtgatggttcaggcagattctggctgtgtcgtgtcatggaagaataaggagctgaaatgcggtagtgggatcttcattacggacaacgtgcacacatggaccgaacagtataagtttcaacccgagagcccatccaaattggcctctgctatccagaaggcccaggaagagggaatatgtggcattagatcggtcactaggctcgagaatctgatgtggaaacagatcacacccgaattaaaccacattctggcagagaatgaagttaagctaaccatcatgactggtgatatacggggcatcatgcaagccgggaaacgcagcctcagacctcagccaaccgagctgaagtactcctggaagacatggggaaaagctaagatgctttcaacggaaagttataaccagaccttcttgattgacggcccggagactgccgagtgccccaatacaaacagggcatggaactctctggaagtggaggattacgggtttggagtgttcaccacaaacatctggctcaaactgaaggaaaaacaggacgcgttttgtgacagcaagttaatgtccgctgccattaaggataatcgtgcagtacatgccgacatgggctattggatcgagtcagctctgaacgatacttggaaaatagagaaggccagcttcattgaagtcaaaaattgccactggcctaagtctcataccctttggtccaacggtgtgttggagagtgaaatgatcatccccaaaaatctcgcagggcccgttagccaacacaattaccggcctggataccacacgcagattgctggcccatggcatctgggtaagctagagatggacttcgatttttgtgacggcacaaccgtgatcgtcactgaagattgcgggaaccgaggaccctctctgagaaccacaactgcctccggcaagctcattaccgagtggtgctgtaggtcatgcacactgccgcctcttcgctatagaggggaagacggatgttggtacggcatggaaataagaccattgaaagagaaggaagagaatctggtgaacagtttagttacggcgggtcacggacaggtggataatttcagcctcggagtactgggcatggccctttttctggaagagatgttgaggacccgcgtcggtactaaacatgctatcctcctggtggcagtgtcgttcgtcacactaattaccggcaacatgtcctttaaggacctggggcgagttgtggtaatggtgggagccactatggctgatgacatcggcatgggggtcacatatctcgccctgcttgcagcgttcaaagtgcggcccacctttgccgctggattgctgttacgtaagctcacgtctaaggagctgatgatgactaccattggcatcgttcttctgagccaatcaacaatacctgaaaccgtgctagagctcactgatgccctggcattgggtatgatggtcctgaaaatcgtgagaaatatggaaaagtaccagttagctgttacaattatggccatcctctgcgtgcccaacgcagtcattctgcagaatgcctggaaagtaagttgtaccatccttgctgtggtttccgtgtctccactgttgctcacaagctcccagcaaaagactgactggatacctctggcgctaaccattaaagggctgaaccccacggccatcttccttacaaccctctcaaggactaataagaaacgcagctggccactgaacgaggcaatcatggctgtcggaatggtgagtattttggcctcttccctgttaaagaatgacataccgatgaccggccctctcgtagccggcgggctgcttacagtgtgctatgtcctgactggacggagcgctgatttggaactcgagagagcaaccgacgttaagtgggaggatcaggccgaaatctcgggttcatctcccattctgagtatcacgatttccgaggacggcagcatgtctatcaaaaacgaagaggaggaacagacactaaccatactgatcaggactgggcttctcgtgattagcggactgtttccaatctccattcccatcacagcggctgcctggtacttgtgggaggtgaagaaacagcgagcaggcgtcttatgggatgtgccttcaccaccccctatgggtaaggccgaactggaggacggggcttatcgcataaaacaaaaggggattctcggctacagtcagatcggcgcaggggtttacaaggaaggaaccttccacactatgtggcatgtaacacggggtgccgtgctgatgcacaaaggcaagagaatcgagccgagctgggcggatgtcaaaaaggaccttatttcttatgggggaggctggaaactggagggtgaatggaaggagggggaagaggtgcaggttttggctctagaaccaggaaagaatcccagggccgtgcagaccaaacctggcctgtttaagacgaacactggcaccatcggggcagtctccctcgatttctcaccaggaacaagtggtagccccataattgacaaaaagggcaaagtggtagggctgtacggaaacggcgtcgtgacccgttccggtgcctatgtttctgctatcgcccaaacagagaagtcgattgaggataatcctgaaatcgaggacgatatatttcgcaagcggagacttactattatggacttacacccgggggcaggaaaaaccaagaggtacctgcccgctatcgtgcgagaagccatcaaacggggcctccgcacgttgattctggcgccaacaagagtcgtggccgcagagatggaagaggctctcaggggcctgcctatccggtatcagactcccgccattcgagctgagcataccgggagagaaatagttgaccttatgtgtcacgcaacattcaccatgcgcctgttgagcccagtgagggtccctaactacaatctaatcattatggatgaggcccatttcactgaccccgcctcaatcgctgcgcgtggatatatctccacccgggtggaaatgggtgaggcagccggcatttttatgacagctacgccaccggggagtagagatcctttcccccagtctaacgccccaataatcgacgaggaaagggagattcccgaacgcagctggaactccggacacgagtgggtaactgattttaagggcaaaaccgtgtggttcgttccttcaatcaaggcaggtaacgacattgccgcttgcctgcgaaagaatgggaaaaaggtcatccaactctctagaaaaacatttgatagcgaatacgtgaagacccggactaacgactgggatttcgtggtcacaaccgacataagtgagatgggagcgaattttaaagccgagagggtaatcgatccacgccgttgtatgaagcccgtgattttaacggacggcgaagagagagttatcctggcaggccctatgccggtgactcattccagcgctgcccagcggagggggcgcattggacgaaaccccaaaaatgaaaacgaccagtacatctatatgggtgagccccttgaaaatgatgaggactgcgcacactggaaggaggccaagatgctgctcgataacataaatacacctgaaggcattatcccctctatgttcgagccagaaagagagaaagtcgacgctattgatggggaataccggttgaggggagaggcccgcaagacctttgtggacctgatgagaaggggcgatctccctgtttggctggcgtataaagtggcagccgagggtatcaactacgctgaccggcgttggtgtttcgatgggataaagaacaatcagatccttgaagagaacgtcgaagtggagatttggaccaaagagggcgaacgcaagaagctaaaaccccgatggctggacgccagaatctattcagatccattggctttaaaggagtttaaagagttcgcagccggaaggaagtccctgactctcaatctgattacagagatgggccggcttcctaccttcatgacacagaaaactcgcgacgctctggataacctcgccgtattgcacacggcagaagcaggagggagggcatacaatcatgctctgagtgagctaccggagaccctggaaacactccttctgttaactttgctggccaccgtgacaggtggcatctttctcttcctgatgagcgggaggggaataggcaagatgacccttggtatgtgctgcattatcactgcatcgatcctgctctggtatgctcagattcagccccactggatcgccgcatctataattttggagtttttcctgatcgttttactaattccagaacctgagaagcagcggacgccccaagacaaccagctgacctacgtcgtgatcgccatactcacagtggtcgctgcgactatggccaatgaaatggggtttcttgagaaaaccaagaaagacctgggcttgggatccatcgcaacacagcagccagagagcaacattctggatatcgacctccgacctgcttcagcctggaccctgtacgccgttgcaactacattcgtgacgcccatgcttagacatagtattgaaaattcttccgtaaacgtgagcctcaccgctatcgccaatcaagcgactgtcctgatgggcttggggaagggatggccgctgtcaaaaatggatattggtgtgccattactagctatcggctgttatagtcaggttaaccctataacactgaccgccgcactccttctgttggtggcccactacgctattatcgggcccggactgcaggcaaaggccacccgcgaggcgcagaagagggctgccgcaggcatcatgaaaaatccaacagtcgacggtattactgtaatagatctcgaccccatcccttatgatccgaagtttgaaaaacaactgggacaggtgatgcttttaattctgtgcgttacacaggtgctcatgatgcggaccacatgggccttgtgtgaggctctgactctagccaccggccccatcagcacactgtgggaaggaaacccaggccgtttctggaataccactattgcagtctccatggctaacatctttagagggtcttacctcgccggagcgggccttctgttcagcataatgaagaatacgacaaacaccaggcgcggtactgggaacatcggagagaccttgggcgagaaatggaagtcccggctgaatgccctcggtaaatcagaatttcaaatttataagaagtctggcatccaggaggtggaccgaacactggcaaaagaagggattaagagaggagagactgatcaccatgctgtcagtaggggctcggccaaattacgctggttcgtggagcggaacatggttacccctgaagggaaggtggtagaccttggatgcggcagaggtgggtggagctactattgtggaggcctgaaaaatgtgcgtgaggtcaagggtctcacaaagggcgggcccggacacgaggaacctatcccaatgtccacgtacggctggaacctagttaggctgcagtctggggtggatgtctttttcataccccctgaaaaatgcgacaccttgctgtgtgatattggagagtcaagcccaaatcccactgtggaggcaggccggacactccgcgtacttaacctggtggaaaattggttgaacaataacacccagttctgcatcaaggttctgaatccgtacatgccttccgtgatcgagaaaatggaagctctccaacgaaagtatggtggggccttagtcagaaacccactgagtagaaattctactcatgagatgtactgggtgagcaacgcctcaggaaatattgtctccagtgtgaacatgataagccggatgcttatcaaccgctttacaatgagacacaaaaaggcgacctatgaacccgacgttgacctgggctctggcacgaggaatattgggatcgagtccgagaagcctaacctagatattatcggaaaacgaatagaaaagatcaaacaggagcatgaaacctcatggcactacgaccaggatcacccatataagacatgggcttaccatggtagctatgagactaaacagaccggctcggcatctagtatggtaaatggggtggtccggctcctgacaaagccctgggacgtgttgccgactgttacccaaatggccatgacagataccactcctttcggacagcagcgtgtgtttaaggaaaaagtcgacacgagaacacaggagcccaaggagggcaccaaaaagctgatgaaaattactgctgaatggctctggaaggagcttggtaaaaagaagaccccacgcatgtgtacaagggaagagttcacgcggaaagtgagatccaacgccgcactgggggccatctttaccgatgagaataagtggaaaagcgctcgcgaagcggtagaggactcaaggttctgggaattagtggataaggagcgaaacctgcacttggaaggaaaatgcgagacttgtgtttacaatatgatgggcaagcgggagaagaaactcggcgaatttgggaaggccaaaggatccagagcaatttggtacatgtggctgggtgctaggttcctagagtttgaagcccttggcttcctgaacgaggaccattggttttctcgcgaaaatagcctcagtggggtcgagggagagggcctgcacaagttgggttatatcctgcgtgatgtgtccaaaaaggaagggggagcaatgtacgccgacgacacagctggctgggatacccggattactctcgaggaccttaagaacgaagagatggtgacaaatcacatggaaggcgagcataaaaagctggccgaggcgatattcaaattaacctatcaaaacaaggtcgttagagtgcagaggcctacaccccgcgggactgtaatggatatcattagccgacgggaccagagaggatctggtcaagtgggcacctacgggctgaatacgtttaccaacatggaagcacagttgatcaggcagatggagggagaaggcgtcttcaaaaatatccagcacctcacagtgactgaggaggttgccgtgcataactggctggctcgcgtcggtagagaacggctatcaaggatggccattagtggggatgactgcgtggtaaagccacttgatgaccgtttcgcaaacgctctgaccgccctcaatgatatgggaaagatacgaaaagacatccaacagtgggagccctccaagggctggaacgattggacacaggttcctttttgcagccaccatttccacgaactgattatgaaagacggccgcgtgttggtcgtgccatgtagaaatcaggatgagttaatcgggcgggctaggatttctcaaggagccggttggtcgctgcgcgaaactgcatgcctcggcaagtcatatgcgcagatgtggagccttatgtactttcacagacgggacctgaggctagccgctaacgccatctgttccgcagtgccgagtcattgggtccccacctctcgaacgacatggagcatacacgctaaacatgagtggatgaccactgaggacatgctgacagtttggaatcgtgtgtggatcagagaaaacccttggatggaggataagaccccagtagaatcctgggaggaaattccctatctcgggaagcgcgaggaccagtggtgcggatcattgatcggcctgacaagtcgggccacctgggccaaaaatattcaggccgcgatcaaccaagtgaggtctcttataggtaatgaggaatacacagattacatgcctagcatgaagagattccgccgggaggaagaggaagctggggtcctgtggtga

SEQ ID NO: 14877 - RNA, 9876 nt, synthetic construct
  misc_feature 1..9876: note = derived and/or modified CDS sequence (opt3) from DENV-2__EU482464__SS-prME
  source 1..9876: mol_type = other RNA
agcgccggcatgataattatgctgatacccaccgtgatggctttccacctcactactagaaacggggagcctcatatgatcgtcggtattcaagaaaaaggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactacagagtgccccaataccaacagagcctggaatagtctggaagtggaggattacggatttggcgtgttcacaactaacatctggctcaagctgaaagaaaagcaggacgcattttgtgactctaagttaatgagcgcggctattaaagataatagggccgtacatgcagacatgggttattggatcgagtccgccctgaacgatacctggaagatagagaaggcttcattcattgaagtcaagaattgccactggcctaaaagccatacgctttggtctaacggggtgttggagtccgaaatgatcatcccaaagaacctcgccggacccgttagtcaacacaattaccgtcctggctaccacacacagattgcaggtccatggcatctgggcaagctagagatggacttcgatttttgtgacgggaccactgtgatcgtcaccgaagattgcggaaaccggggccccagcctgcgaacaactaccgcttctgggaaactcattacagagtggtgctgtagatcctgcacgctgccgcctcttaggtatcgcggagaggacggctgttggtacggtatggaaatacggccattgaaggagaaagaagagaatctggtgaactcattagttaccgccgggcacggacaggtggataatttcagtctcggcgtactgggtatggcgctttttctggaagagatgttgagaactagggtcggcacaaagcatgccatcctcctggtggctgtgagcttcgtcaccctaattactgggaacatgtcgtttaaagacctgggacgcgttgtggtaatggtgggcacaaccatggcagatgacatcgggatgggagtcacgtatctcgccctgcttgctgccttcaaggtgcgacccacttttgcagcgggcttgctgttacggaagctcacctccaaagagctgatgatgacaaccattggtatcgttcttctgtctcaaagcactatacctgaaacagtgctagagctcaccgatgccctggctttggggatgatggtcctgaagatcgtgcgtaatatggaaaaataccagttagccgttacaattatggcaatcctctgcgtgcccaacgctgtcattctgcagaatgcctggaaggtatcatgtactatccttgcagtggttagtgtgtccccactgttgctcacctctagccagcagaaaacggactggatacctctggccctaacaattaagggactgaaccccaccgctatcttccttactaccctctccagaacaaataaaaagaggtcatggccactgaacgaggcgatcatggccgtcggcatggtgagcattttggcaagttctctgttaaagaatgacataccgatgactggccctctcgtagctgggggactgcttaccgtgtgctatgtcctgacgggtcgctccgccgatttggaactcgagcgggccacagacgttaaatgggaggatcaggctgaaatcagcggctcgtcacccattctgtctatcaccattagtgaggacgggtccatgagcatcaagaacgaagaggaggaacagactctaacaatactgatcagaaccggacttctcgtgatttctggcctgtttccaatcagcattcccatcactgcagccgcgtggtacttgtgggaggtgaaaaagcagagggctggtgtcttatgggatgtgccttccccaccccctatggggaaagccgaactggaggacggagcatatcgaataaagcaaaagggcattctcggctactcacagatcggggccggagtttacaaagaaggtacattccacaccatgtggcatgtaacgcgcggcgctgtgctgatgcacaaggggaaacggatcgagccgagttgggcagatgtcaagaaagaccttattagctatggaggcggttggaagctggagggggaatggaaggagggagaagaggtgcaggttttggccctagaaccaggcaaaaatcccagagcggtgcagactaagcctggcctgtttaaaaccaacacagggaccatcggagctgtctctctcgatttctccccaggtacatcaggcagtcccataattgacaagaaagggaaggtggtaggactgtacggcaacggtgtcgtgactaggagcggggcctatgtttccgcaatcgcccaaaccgagaagtctattgaggataatcctgaaatcgaggacgatatatttcgtaaacgccggcttacgattatggacttacacccgggagctggcaagacaaaaagatacctgcccgccatcgtgagggaagcaatcaagcgaggcctccggactttgattctggctccaacccgcgtcgtggccgcggagatggaagaggccctcagagggctgcctatcaggtatcagacacccgcaattcgggctgagcataccggacgagaaatagttgaccttatgtgtcacgccactttcaccatgagactgttgtcgccagtgcgcgtccctaactacaatctaatcattatggatgaggctcatttcacagaccccgcaagcatcgccgccaggggttatatctcaacgcgtgtggaaatgggcgaggctgcggggatttttatgactgcaaccccaccgggatcccgggatcctttcccccagagtaacgccccaataatcgacgaggaaagagagattcccgaaaggtcttggaatagcggccacgagtgggtaacagattttaaaggtaagaccgtgtggttcgttccttccatcaaggctgggaacgacattgccgcatgcctgcgcaaaaatggaaagaaagtcatccaactctcacgaaagacttttgattctgaatacgtgaaaacaagaaccaacgactgggatttcgtggtcacgactgacataagcgagatgggcgccaattttaaggctgagcgggtaatcgatccaaggcgctgtatgaaacccgtgattttaacagacggcgaagaacgtgttatcctggcggggcctatgccggtgacccatagttccgccgcacagagacggggaaggattggtcgcaacccaaagaatgaaaacgaccagtacatctatatgggcgagccccttgaaaatgatgaggactgcgctcactggaaggaggccaaaatgctgctcgataacataaatacccctgaagggattatccccagcatgttcgagccagaacgagagaaggtcgacgcaattgatggagaatacagattgcggggcgaggccaggaaaacttttgtggacctgatgcgcagaggtgatctccctgtttggctggcttataaggtggccgcggaggggatcaactacgcagacaggcggtggtgtttcgatggcatcaaaaacaatcagatccttgaagagaacgtcgaagtggagatttggacaaaggagggagaacgtaagaaactaaagccccgctggctggacgcccgaatctattctgatccattggctttaaaagagtttaaggagttcgccgctggcagaaaatcactgaccctcaatctgattacagagatggggaggcttcctactttcatgacgcaaaagacccgggacgcactggataacctcgccgtattgcacacagctgaagccggaggtcgcgcatacaatcatgcgctgtccgagctaccggagactctggaaaccctccttctgttaacattgctggccaccgtgactggcgggatctttctcttcctgatgagtggaagaggcataggtaagatgacgcttgggatgtgctgcattatcaccgctagcatcctgctctggtatgcccagattcagccccactggatcgcagcttcgataattttggagtttttcctgatcgttttactaattccagaacctgagaaacagaggacaccccaagacaaccagctgacttacgtcgtgatcgccatactcaccgtggtcgcagccacaatggctaatgaaatgggctttcttgagaagaccaaaaaggacctgggattgggctctatcgcgactcagcagccagagtccaacattctggatatcgacctccggcctgccagcgcatggacactgtacgctgttgccacgaccttcgtgactcccatgcttcgacattcaattgaaaatagttctgtaaacgtgtccctcacagccatcgcaaatcaagctaccgtcctgatggggttgggaaaaggttggccgctgagcaagatggatattggcgtgccattactagccatcgggtgttattcacaggttaaccctataaccctgacagcggctctccttctgttggtggcccactacgcaattatcggacccggcctgcaggccaaggctactagagaggcacagaaacgcgccgcggctggtatcatgaagaatccaacggtcgacgggattaccgtaatagatctcgaccccatcccttatgatccgaaatttgaaaagcaactgggccaggtgatgcttttaattctgtgcgttacacaggtgctcatgatgaggactacctgggccttgtgtgaggcactgacactagccaccggacccatcagtactctgtgggaaggcaacccagggcggttctggaatacgacaattgctgtcagcatggccaacatctttcgtggatcctacctcgcaggcgctggtcttctgttctctataatgaaaaataccactaacaccagaagggggacaggaaacatcggcgagactttgggtgagaagtggaaaagccgcctgaatgccctcggcaagtccgaatttcaaatttataagaaatcagggatccaggaggtggaccggaccctggcgaaggaaggaattaaacgaggcgagacagatcaccatgccgtctctagagggagtgcaaagttaaggtggttcgtggagcgcaacatggttacgcctgaaggaaaagtggtagaccttggctgcggtagagggggatggtcgtactattgtggcggtctgaagaatgtgagagaggtcaagggcctcaccaaagggggacccggccacgaggaacctatcccaatgagcacttacgggtggaacctagttcgtctgcagtccggagtggatgtctttttcataccccctgaaaagtgcgacacattgctgtgtgatattggcgagtcttcaccaaatcccaccgtggaggctggtaggactctccgggtacttaacctggtggaaaattggttgaacaataacacacagttctgcatcaaagttctgaatccgtacatgcctagcgtgatcgagaagatggaagccctccaacgcaaatatgggggagcattagtccgaaacccactgtccagaaatagtacccatgagatgtactgggtgtctaacgctagcggcaatattgtctcatccgtgaacatgataagtaggatgcttatcaaccggtttacgatgcgccacaagaaggccacctatgaacccgacgttgacctgggcagcgggacaagaaatattggaatcgagtctgagattcctaacctagatatcataggtaaaaggatcgaaaagattaaacaggagcatgaaacttcctggcactacgaccaggatcacccatataagacctgggcctaccatggctcatatgagacaaaacagactgggagcgcgtcgtctatggtaaatggagtggtccgactcctgaccaagccctgggacgtgttgccgacagttacccaaatggctatgactgatacgacacctttcggccagcagcgggtgtttaaggaaaaagtcgacacccgtactcaggagcccaaggagggtaccaaaaagctgatgaaaatcacagcagaatggctctggaaggagcttgggaaaaagaagacgccaagaatgtgtacccgcgaagagttcactaggaaagtgcggagtaacgccgctctgggagccatttttacagatgagaataagtggaaatccgcaagagaagccgtagaggacagccgcttctgggaattagtggataaggagaggaacctgcacttggaaggcaaatgcgagacctgtgtttacaatatgatgggcaagcgagagaagaaactcggggaatttggaaaggctaaaggttcacgggcgatctggtacatgtggctgggcgccagattcctagagtttgaagcacttgggttcctgaacgaggaccattggttttccagggaaaattctctcagcggagtcgagggcgagggtctgcacaagttggggtatattctgcgcgatgtgagtaaaaaggaaggaggcgctatgtacgccgacgacactgcaggctgggatacacgtataaccctcgaggaccttaagaacgaagagatggtgacaaatcacatggaaggggagcataaaaagctggccgaggctatcttcaaattaacttatcaaaacaaggtcgttcgggtgcagagacctacccccaggggaacggtaatggatattatctcccgccgagaccagcggggtagcggccaagtggggacctacggactgaatacatttactaacatggaagcccagttgatcagacagatggagggcgaaggtgtcttcaaaaatattcagcacctcaccgtgacagaggaggttgcggtgcaaaactggctggcaagggtcgggcgcgaaagactatctcggatggccatatcaggagatgactgcgtggtaaagccacttgatgacaggttcgctaacgccctggcagctctcaatgatatgggcaagatccgtaaagacattcagcagtgggagcccagtaagggctggaacgattggactcaggttcctttttgctcccatcacttccatgaactgatcatgaaagacgggcgagtgttggtcgtgccatgtcgcaatcaagatgagttaattggacgggcccggatcagccagggtgctggctggtctctgagggaaaccgcctgcctcgggaagtcgtatgcacagatgtggtcacttatgtactttcaccgcagagacctgcggctagcggccaacgctatatgtagcgccgtgccgtcccactgggtccccacgagtaggacaacctggtctatccatgcaaaacacgagtggatgactacagaggacatgctgaccgtttggaatcgagtgtggattcgtgaaaacccttggatggaggataagactccagtagaaagctgggaggaaatcccctatctcggaaagagagaggaccagtggtgcggctccttgattggtctgacctcacgcgctacatgggccaaaaatatccaagcagccataaaccaggtgcggagtcttattgggaatgaggaatacacggattacatgccttctatgaagaggttcagacgcgaggaagaggaagcgggagtcctgtggtga

SEQ ID NO: 14878 - RNA, 9876 nt, synthetic construct
  misc_feature 1..9876: note = derived and/or modified CDS sequence (opt3) from DENV-2__EU482465__SS-prME
  source 1..9876: mol_type = other RNA
agcgcaggcatgataattatgctgatacccaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacaccatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttatctgcaagcatagcatggtggatcgaggctggggtaatgggtgtggactattcggcaaaggcgggattgtcacttgcgcaatgtttacctgcaagaaaaacatggaaggaaagatagtgcagcctgagaatctcgaatacacaatcgtggtcaccccacactccggtgaggagcatgccgttggcaacgacactgggaaacacggaaaggaaattaaagtgacgccgcagtcaagtatcacagaggctgaactgaccggctatggtactgtaaccatggagtgtagccccagaacagggcttgatttcaatgaaatggtgctgttgcaaatggagaacaaggcctggctcgtccacaggcagtggtttctggacttacctctgccatggctccccggcgcagataagcaggagtctaattggatacagaaagaaacccttgtgactttcaagaaccctcatgctaaaaagcaagacgttgtggtcctgggatcccaggagggcgccatgcacacagcgttgacgggggccaccgaaattcagatgtcaagcggaaatctactgtttactggtcatctcaaatgccggctgcgtatggacaaacttcaactgaagggcatgagttactctatgtgtacagggaaattcaaggtggtaaaagagatcgcagagacccagcacggaacaatcgttattcgcgtgcagtatgaaggcgatggttccccatgcaagatccccttcgagattatggacttggagaagagatacgtcctcgggaggctgataactgtgaacccgatcgtcaccgagaaggatagccctgtgaacattgaagctgagcccccatttggcgactcgtacatcatcattggagttgagcctggccagttaaagctgaattggttcaaaaaggggtcttccataggacaaatgtttgaaacgaccatgcggggtgccaaacgaatggctatcctaggcgatacagcctgggacttcgggtcactcggaggcgtgtttacaagtattggtaaggcactgcatcaggtattcggggccatctatggcgctgcgtttagcggagtctcctggaccatgaaaattcttatcggcgtgataatcacatggattgggatgaactctcgcagcacttcattgagtgtttccctggtgctcgtcggaatcgtgaccctgtaccttggcgtaatggtgcaggcagatagcggttgtgttgtctcttggaagaataaggagctgaaatgcgggtcaggaattttcatcacggacaacgtgcacacatggaccgaacagtataagtttcaacccgagagtccaagcaaattggcctccgctatacagaaggcccaggaagagggcatttgtggtatcagatctgtgactaggctcgagaatctgatgtggaaacagattacacccgaattaaaccacatcctggcagagaatgaagtcaagctaaccataatgactggcgatatcaaagggattatgcaagccggaaagcggtcgctccgccctcagccaaccgagctgaagtacagctggaaaacatggggcaaggctaaaatgctttccacggaatcatataaccagaccttcttgatcgacgggccggagactgccgagtgccccaatacaaacagagcatggaatagtctggaagttgaggattacggatttggcgtgttcaccacaaacatttggctcaagctgaaagaaaagcaggacgcgttttgtgactctaagttaatgagcgctgccatcaaagataatagggcagtgcatgccgacatgggttattggatagagtccgctctgaacgatacttggaagattgagaaagcctcattcatcgaagtaaagaattgccactggcctaaaagccataccctttggtctaacggggtcttggagtccgaaatgatcattccaaagaacctcgcaggacccgtgagtcaacacaattaccgtcctggctaccacacgcagatcgctggtccatggcatctgggcaagctagagatggacttcgatttttgtgacgggacaaccgttattgtgactgaagattgcggaaaccggggccccagcctgcgaaccacaactgcctctgggaaactcataaccgagtggtgctgtagatcctgcacactgccgcctcttaggtatcgcggagaggacggctgttggtacggtatggaaatccggccattgaaggagaaagaagagaatctggtcaactcattagtgacggcggggcacggacaggttgataatttcagtctcggcgtgctgggtatggccctttttctggaagagatgttgagaaccagggtaggcactaagcatgctattctcctggtcgcagtgagcttcgtgacactaatcaccgggaacatgtcgtttaaagacctgggacgcgtcgttgtgatggtaggcgccactatggctgatgacattgggatgggagtgacatatctcgccctgcttgcagcgttcaaggtccgacccacctttgccgctggcttgctgttacggaagctcacgtccaaagagctgatgatgactaccatcggtatagtgcttctgtctcaaagcacaatccctgaaaccgttctagagctcactgatgccctggcattggggatgatggtgctgaagattgtccgtaatatggaaaaataccagttagctgtgacaatcatggccattctctgcgttcccaacgcagtgatcctgcagaatgcctggaaggtctcatgtaccatacttgctgtagtgagtgtttccccactgttgctcacatctagccagcagaagactgactggattcctctggcgctaaccatcaagggactgaaccccacggccatcttccttacaaccctctccagaactaataaaaagaggtcatggccactgaacgaggcaattatggctgtgggcatggtcagcatattggccagttctctgttaaagaatgacatcccgatgaccggccctctcgtggccgggggactgcttacagtatgctatgtgctgactggtcgctccgctgatttggaactcgagcgggcaaccgacgtcaaatgggaggatcaggccgaaattagcggctcgtcacccatcctgtctattacgatcagtgaggacgggtccatgagcataaagaacgaagaggaggaacagacactaaccatcctgattagaactggacttctcgttatctctggcctgtttccaattagcatccccataacagcggctgcctggtacttgtgggaggtgaaaaagcagagggccggtgtgttatgggatgtcccttccccaccccctatggggaaagccgaactggaggacggagcttatcgaattaagcaaaagggcatcctcggctactcacagatcggggcaggagtgtacaaagaaggtaccttccacactatgtggcatgttacacgcggcgccgtactgatgcacaaggggaaacggattgagccgagttgggcggatgtgaagaaagaccttatcagctatggaggcggttggaagctggagggggaatggaaggagggagaagaggtccaggtgttggctctagaaccaggcaaaaatcccagagccgttcagaccaagcctggcctgtttaaaacgaacactgggaccataggagcagtgtctctcgatttctccccaggtacatcaggcagtcccattatcgacaagaaagggaaggtcgtgggactgtacggcaacggtgtagtcaccaggagcggggcctatgtgtccgctattgcccaaacagagaagtctactgaggataatcctgaaatcgaggacgatatatttcgtaaacgccggcttaccattatggacttacacccgggagcaggcaagacgaaaagatacctgcccgctatcgttagggaagccatcaagcgaggcctccggacattgattctggcgccaactcgcgtggtcgccgcagagatggaagaggctctcagagggctgcctatcaggtatcagacccccgccattcgggctgagcatacaggacgagaaatagtggaccttatgtgtcacgcaaccttcactatgagactgttgtcgccagttcgcgtgcctaactacaatctaatcattatggatgaggcccatttcaccgaccccgccagcatcgctgcgaggggttatatctcaacacgtgtcgaaatgggcgaggcagccgggatttttatgacggctactccaccgggatcccgggatcctttcccccagagtaacgccccaataatcgacgaggaaagagagattcccgaaaggtcttggaatagcggccacgagtgggtgaccgattttaaaggtaagacagtatggttcgtgccttccatcaaggcagggaacgacattgccgcttgcctgcgcaaaaatggaaagaaagttatccaactctcacgaaagacctttgattctgaatacgtcaaaactagaacaaacgactgggatttcgtggtgaccacggacataagcgagatgggcgcgaattttaaggccgagcgggtcatcgatccaaggcgctgtatgaaacccgtaattttaactgacggcgaagaacgtgtgatcctggcagggcctatgccggttacacatagttccgctgcccagagacggggaaggattggtcgcaacccaaagaatgaaaacgaccagtacatctatatgggcgagccccttgaaaatgatgaggactgcgcacactggaaggaggccaaaatgctgctcgataacataaatacccctgaagggattatccccagcatgttcgagccagaacgagagaaggtggacgctattgatggagaatacagattgcggggcgaggccaggaaaacctttgtcgacctgatgcgcagaggtgatctccctgtgtggctggcgtataaggttgcagccgaggggatcaactacgctgacaggcggtggtgtttcgatggcatcaaaaacaatcagatccttgaagagaacgtggaagtcgagatttggactaaggagggagaacgtaagaaactaaagccccgctggctggacgcccgaatctattctgatccattggctttaaaagagtttaaggagttcgcagccggcagaaaatcactgacactcaatctgattaccgagatggggaggcttcctacattcatgactcaaaagacgcgggacgctctggataacctcgccgtgttgcacaccgcagaagcgggaggtcgcgcctacaatcatgctctgtccgagctaccggagacactggaaactctccttctgttaaccttgctggccacagtaaccggcgggatctttctcttcctgatgagtggaagaggcataggtaagatgactcttgggatgtgctgcattacgaccgcaagcatcctgctctggtatgctcagatccagccccactggattgccgcatcgatcatattggagtttttcctgattgtgttactaatcccagaacctgagaaacagaggacaccccaagacaaccagctgacttacgttgtcattgccatcctcaccgtggtggctgcgacaatggccaatgaaatgggctttcttgagaagaccaaaaaggacctgggattgggctctatagcaactcagcagccagagtccaacatcctggatattgacctccggcctgctagcgcctggacactgtacgccgtcgcaacgaccttcgttactcccatgcttcgacattcaatcgaaaatagttctgtgaacgtatccctcacagctattgccaatcaagcgaccgtgctgatggggttgggaaaaggttggccgctgagcaagatggatatcggcgtcccattactagctattgggtgttattcacaggtgaaccctatcaccctgacagccgcactccttctgttggttgcccactacgctataattggacccggcctgcaggcaaaggccactagagaggcgcagaaacgcgctgccgcaggtatcatgaagaatccaacggtggacgggatcaccgtcattgatctcgaccccataccttatgatccgaaatttgaaaagcaactgggccaggtaatgcttttaatcctgtgcgtgacacaggttctcatgatgaggactacctgggccttgtgtgaggctctgacactagccaccggacccattagtactctgtgggaaggcaacccagggcggttctggaatacgacaatcgcagtgagcatggctaacatttttcgtggatcctacctcgccggcgcgggtcttctgttctctatcatgaaaaataccactaacaccagaagggggacaggaaacatgggcgagactttgggtgagaagtggaaaagccgcctgaatgccctcggcaagtccgaatttcaaatatataagcggtcagggatccaggaggtcgaccgaaccctggcaaaagaaggaattaagagaggcgagacagatcaccatgctgtgtctagggggagtgccaaattacgctggttcgtcgagcggaacatggtgacgcctgaaggaaaggttgtggaccttggctgcggtagagggggatggtcgtactattgtggcggtctgaaaaatgtacgtgaggtgaagggcctcaccaaagggggacccggccacgaagaacctatcccaatgagcacttacgggtggaacctagtcaggctgcagtccggagttgatgtgtttttcattccccctgaaaaatgcgacacattgctgtgtgatatcggcgagtcttcaccaaatcccaccgtcgaggcaggtcggactctccgcgtgcttaacctggtagaaaattggttgaacaataacacacagttctgcataaaggtgctgaatccgtacatgcctagcgttattgagaaaatggaagctctccaacgaaagtatgggggagccttagtgagaaacccactgtccaggaatagtacccatgagatgtactgggtctctaacgccagcggcaatatcgtgtcatccgtcaacatgatcagtcggatgcttattaaccgctttacgatgagacacaaaaaggcgacctatgaacccgacgtggacctgggcagcgggacaaggaatataggaatcgagtctgagattcctaacctagatatcattggtaagcgaatcgagaaaataaagcaggagcatgaaacttcctggcactacgaccaggatcacccatataaaacctgggcttaccatggctcatatgagacaaagcagactgggagcgcatcgtctatggttaatggagtagtgcggctcctgaccaaaccctgggacgtcttgccgacagtgacccaaatggccatgactgatacgacacctttcggccagcagcgtgtttttaaggaaaaggtggacaccagaactcaggagcccaaagagggtaccaagaaactgatgaagatcacagctgaatggctctggaaagagcttgggaagaaaaagacgccacgcatgtgtaccagggaagagttcactcggaaggtcagaagtaacgccgcactgggagccatttttacagatgagaataaatggaagtccgctcgcgaagcggtggaggacagcaggttctgggaattagtagataaagagcgaaacctgcacttggaaggcaagtgcgagacctgtgtgtacaatatgatgggcaaacgggagaagaagctcggggaatttggaaaagccaagggttcaagagcaatctggtacatgtggctgggcgctaggttcctagagtttgaagcccttgggttcctgaacgaggaccattggttttcccgcgaaaattctctcagcggagttgagggcgagggtctgcacaaattggggtatattctgcgtgatgtcagtaagaaagaaggaggcgcaatgtacgccgacgacactgctggctgggatacacggatcaccctcgaggaccttaagaacgaagagatggtgacaaatcacatggaaggggagcataagaaactggccgaggcgattttcaagttaacttatcaaaacaaagtggtcagagttcagaggcctacaccccgcggaacggtgatggatataatctcccgacgggaccagagaggtagcggccaagtagggacctacggactgaatacatttactaacatggaagcacagttgattaggcagatggagggcgaaggtgtgttcaagaatatccagcacctcaccgtcacagaggaggtggccgttcaaaactggctggctcgcgtggggagagaacggctatctaggatggccatctcaggagatgactgcgtcgtgaaaccacttgatgaccgtttcgcaaacgctctgactgccctcaatgatatgggcaagattcgaaaggacatacagcagtgggagcccagtaaaggctggaacgattggacccaggtacctttttgctcccatcacttccatgaactgatcatgaaggacgggcgcgttttggtggtcccatgtagaaatcaagatgagttaattggacgggctaggatcagccagggtgccggctggtctctgcgcgaaacggcatgcctcgggaaatcgtatgcgcagatgtggtcacttatgtactttcacagacgggacctgaggctagccgctaacgccatttgtagcgcagtgccgtcccactgggtgcccacaagtcgaaccacttggtctatccatgctaagcacgagtggatgacaaccgaggacatgctgactgtctggaatcgtgtttggataagagaaaacccttggatggaggataaaaccccagtggaaagctgggaggaaatcccctatctcggaaagcgcgaggaccagtggtgcggctccttgattggtctgacatcacgggccacgtgggcaaagaatatccaagccgcgattaaccaggtaaggagtcttatcgggaatgaggaatacaccgattacatgccttctatgaaaagattccgccgggaggaagaggaagctggagtgctgtggtga

SEQ ID NO: 14879 - RNA, 9876 nt, synthetic construct
  misc_feature 1..9876: note = derived and/or modified CDS sequence (opt3) from DENV-2__EU482466__SS-prME
  source 1..9876: mol_type = other RNA
agcgcaggaatgatcattatgctgatacccaccgtgatggctttccacctcactactcggaacggggagcctcatatgatcgtcggcattcaggaaaagggtaaatcccttctgtttaagacggaggacggagttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccaattaaagctgaattggttcaagaaagggtcttccattggacagatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacaatataaatttcagcccgagagtccaagcaagttggcctccgctatccagaaagcccaggaagagggcatatgtggtattagatctgtcactaggctcgagaatctgatgtggaagcaaatcacacccgaattaaaccacattctggcagagaatgaagttaaactaaccatcatgactggcgatataaaggggatcatgcaggccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaagacgcgttttgtgactctaagttaatgagcgctgccattaaggataatagggcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatccccaagaacctcgcaggacccgttagtcagcacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaagctcattaccgagtggtgctgtagatcctgcacactgccgcctcttaggtatcgcggagaggacggctgttggtacggtatggaaatacggccattgaaagagaaggaagagaatctggtgaactcattagttacggcggggcacggacaagtggataatttcagtctcggcgtactgggtatggccctttttctggaagagatgttgagaaccagggtcggcactaaacatgctatcctcctggtggcagtgagcttcgtcacactaattaccgggaacatgtcgtttaaggacctgggacgcgttgtggtaatggtgggcgccactatggctgatgacatcgggatgggagtcacatatctcgccctgcttgcagcgttcaaagtgcgacccacctttgccgctggcttgctgttacggaagctcacgtccaaggagctgatgatgactaccattggtatcgttcttctgtctcagagcacaatacctgaaaccgtgctagagctcactgatgccctggcattggggatgatggtcctgaaaatcgtgcgtaatatggaaaagtaccagttagctgttacaattatggccatcctctgcgtgcccaacgcagtcattctgcagaatgcctggaaagtatcatgtaccatccttgctgtggttagtgtgtccccactgttgctcacatctagccaacagaagactgactggatacctctggcgctaaccattaaaggactgaaccccacggccatcttccttacaaccctctccagaactaataagaaaaggtcatggccactgaacgaggcaatcatggctgtcggcatggtgagcattttggccagttctctgttaaagaatgacataccgatgaccggccctctcgtagccgggggactgcttacagtgtgctatgtcctgactggtcgctccgctgatttggaactcgagcgggcaaccgacgttaagtgggaggatcaggccgaaatcagcggctcgtcacccattctgtctatcacgattagtgaggacgggtccatgagcatcaaaaacgaagaggaggaacagacactaaccatactgatcagaactggacttctcgtgatttctggcctgtttccaatcagcattcccatcacagcggctgcctggtacttgtgggaggtgaagaaacaaagggccggtgtcttatgggatgtgccttccccactgcccatggggaaggccgaactcgaggacggagcttatcgaataaaacagaagggcattctgggctactcacagatcggggcaggagtttacaaggaaggtaccttccacactatgtggcatgtaacacgcggcgccgtgcttatgcacaaagggaagcggatcgagcctagttgggcggatgtcaaaaaggacctgattagctatggaggcggttggaaattggagggggaatggaaggagggagaagaggtgcaggttctagctctggaaccgggcaagaatccaagagccgtgcaaaccaaacccggcctctttaagacgaacactgggaccatcggagcagtctctctggatttctcccctggtacatcaggcagtccaataattgacaaaaaggggaaagtggtaggactttacggcaacggtgtcgtgaccaggagcggggcctatgtttccgctatcgcccagacagagaagtctattgaggataatcccgaaatcgaggacgatatatttcgtaagcgccggttaactattatggacctgcaccctggagcaggcaaaaccaagagatacctcccggctatcgtgagggaagccatcaaacgaggcttgcggacgctgattctcgcgcccacacgcgtcgtggccgcagagatggaagaggctctgagagggcttccaatcaggtatcagactcctgccattcgggctgagcataccggacgagaaatagttgacctgatgtgtcacgcaacattcaccatgagattgctatcgcccgtgcgcgtcccaaactacaatctgatcattatggatgaggcccatttcactgaccctgccagcatcgctgcgaggggttatatctcaacccgtgtggaaatgggcgaggcagccgggatttttatgacagctacgcccccaggatcccgggatccgttccctcaaagtaacgcccccataatcgacgaggaaagagagattccagaaaggtcttggaatagcggccacgagtgggtaactgattttaagggtaaaaccgtgtggttcgttccctccatcaaggcagggaacgacattgccgcttgcctccgcaagaatggcaagaaggtcatccagttatcacgaaaaacatttgattctgaatacgtgaagaccagaactaacgactgggatttcgtggtcacaaccgacataagcgagatgggcgcgaattttaaagccgagcgggtaatcgatcctaggcgctgtatgaagccagtgattctgacggacggcgaagaacgtgttatccttgcagggcccatgcctgtgactcatagttccgctgcccagagacggggaaggattggtcgcaacccgaaaaatgaaaacgaccagtacatctatatgggcgagccactggaaaatgatgaggactgcgcacactggaaggaggccaagatgctcttggataacataaatacacccgaagggattatccctagcatgttcgagcccgaacgagagaaagtcgacgctattgatggagaatacagactgcggggcgaggccaggaagacctttgtggacctcatgcgcagaggtgatctgccagtttggcttgcgtataaagtggcagccgaggggatcaactacgctgacaggcggtggtgtttcgatggcataaagaacaatcaaatcctagaagagaacgtcgaagtggagatttggaccaaagagggagaacgtaagaagctgaaacctcgctggttggacgcccgaatctattctgatcccttagctctgaaggagtttaaagagttcgcagccggcagaaagtcactcactctgaatcttattacagagatggggaggctgccaaccttcatgacacagaaaactcgggacgctctcgataacttggccgtactgcacacggcagaagcgggaggtcgcgcctacaatcatgctctatccgagctgcctgagaccctcgaaacacttctgttattgactctgctcgccaccgtgacaggcgggatctttctgttccttatgagtggaagaggcataggtaagatgaccctggggatgtgctgcattatcactgcaagcatcctcttgtggtatgctcagattcagccgcactggatcgccgcatcgataattctggagtttttcttaatcgttctactgattcccgaaccagagaagcaaaggacgcctcaggacaaccagctcacctacgtcgtgatcgccatacttacagtggtcgctgcgactatggccaatgaaatgggctttctggagaaaaccaagaaagacttgggactgggctctatcgcaacacagcaacccgagtccaacattctcgatatcgacctgcggccagctagcgcctggaccctttacgccgttgcaactacattcgtgacgcctatgctccgacattcaattgaaaatagttctgtaaacgtgtccctgaccgctatcgccaatcaggcgactgtcttgatggggctgggaaagggttggcccttaagcaaaatggatattggcgtgccgctactggctatcgggtgttattcacaggttaacccaataacactcaccgccgcacttctgttgctggtggcccactacgctattatcggacctggcctccaggcaaaggccaccagagaggcgcaaaagcgcgctgccgcaggtatcatgaaaaatcccacagtcgacgggattactgtaatagatctggacccaatcccctatgatcctaagtttgaaaaacagcttggccaggtgatgttactgattctctgcgttacgcaagtgttgatgatgaggaccacatgggccctgtgtgaggctctaactctggccaccggaccgatcagtacactctgggaaggcaaccccgggcggttctggaataccactattgcagtcagcatggctaacatctttcgtggatcctaccttgccggcgcgggtctgttgttctctataatgaagaatacgacaaacaccagaagggggactggaaacatgggcgagaccctgggtgagaaatggaaaagccgcctcaatgccctgggcaaatccgaatttcagatctataagaagtcagggattcaggaggtggaccggacattagcaaaagaaggaatcaagcgaggcgagactgatcaccatgctgtctctagagggagtgccaaacttaggtggttcgtggagcgcaacatggttaccccagaaggaaaggtggtagacctgggctgcggtagagggggatggtcgtactattgtggcggtctcaaaaatgtgagagaggtcaagggcctaacaaaagggggacctggccacgaagaaccaattcctatgagcacgtacgggtggaacctggttcgtttgcagtccggagtggatgtctttttcatcccacccgaaaaatgcgacaccctgctctgtgatataggcgagtcttcacctaatccaactgtggaggcaggtaggacacttcgggtactgaacttggtggaaaattggctgaacaataacacccaattctgcattaaggttctcaatccctacatgccgagcgtgatcgagaaaatggaggctttacagcgcaagtatgggggagccctggtccgaaaccctctttccagaaatagtactcatgagatgtactgggtgtctaacgccagcggcaatatcgtctcatccgtgaacatgattagtaggatgctgataaaccggtttacaatgcgccacaaaaaggcgacctatgaaccagacgttgacctaggcagcgggacgagaaatatcggaattgagtctgagacccccaacctcgatatcattggtaagaggatcgagaaaataaagcaggagcatgaaacatcctggcactacgaccaggatcacccttataaaacttgggcttaccatggctcatatgagaccaagcaaacagggagcgcatcgtctatggtaaatggagtggtccgactgttgactaaaccatgggacgtgctgcccaccgttacacagatggccatgaccgatactacgccgttcggccagcagcgggtgtttaaggaaaaggtcgacacacgtacccaagagcctaaagagggtactaagaaactcatgaagatcaccgctgaatggctttggaaagagctggggaagaaaaagacacccagaatgtgtacgcgcgaagagttcaccaggaaggtgcggagtaacgccgcattaggagccatttttactgatgagaataaatggaagtccgctagagaagcggtagaggacagccgcttctgggaactggtggataaagagaggaacttgcacctcgaaggcaagtgcgagacatgtgtttacaatatgatgggcaaacgagagaagaagctgggggaatttggaaaagccaagggttcacgggcaatctggtacatgtggctaggcgctagattccttgagtttgaagccctggggttcctcaacgaggaccattggttttccagggaaaattctctgagcggagtcgagggcgagggtttgcacaaactggggtatattctccgcgatgtgagtaagaaagaaggaggcgcaatgtacgccgacgacaccgctggctgggatactcgtatcacacttgaggacctgaagaacgaagagatggtgaccaatcacatggaaggggagcataagaaattagccgaggcgattttcaagctgacatatcagaacaaagtcgttcgggtgcagagaccaactcctaggggaaccgtaatggatataatctcccgccgagaccaacggggtagcggccaggtggggacgtacggattgaatacctttacaaacatggaagcacagctcattagacagatggagggcgaaggtgtcttcaagaatatccaacacctgactgtgaccgaggaggttgccgtgcagaactggctagctagggtcgggcgcgaaagactttctcggatggccatctcaggagatgactgcgtggtaaaacccctggatgacaggttcgcaaacgctctcacagccctgaatgatatgggcaagattcgtaaggacatacagcagtgggagccaagtaaaggctggaacgattggactcaagttcccttttgctcccatcacttccatgaattgatcatgaaggacgggcgagtgttagtcgtgccttgtcgcaatcaggatgagctgattggtagagctcggatcagccagggagccggctggtctctcagggaaaccgcatgccttgggaaatcgtatgcgcagatgtggtcactgatgtactttcaccgcagagacctacggctggccgctaacgccatttgtagcgcagtgccatcccactgggtcccgacgagtaggacaacctggtctatccatgctaagcacgagtggatgactacagaggacatgctcaccgtttggaatcgagtgtggatacgtgaaaacccctggatggaggataaaactcctgtagaaagctgggaggaaatcccatatttgggaaagagagaggaccaatggtgcggctccctgattggtcttacctcacgcgccacatgggcaaagaatatccaggccgcgattaaccaggtgcggagtctgatcgggaatgaggaatacacggattacatgccctctatgaaaaggttcagacgcgaggaagaggaagctggagtcctctggtga

SEQ ID NO: 14880 - RNA, 9876 nt, synthetic construct
  misc_feature 1..9876: note = derived and/or modified CDS sequence (opt3) from DENV-2__EU482467__SS-prME
  source 1..9876: mol_type = other RNA
agcgcaggcatgatcattatgctgatacccaccgtgatggctttccacctcactactcggaacggggagcctcatatgatcgtcggtattcaagaaaagggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactgccgagtgccccaatacaaacagagcatggaatagtctggaagtggaggattacggatttggcgtgttcaccacaaacatctggctcaagctgaaagaaaagcaggacgcgttttgtgactctaagttaatgagcgctgccattaaagataatagggcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaaactcattaccgagtggtgctgtagatcctgcacactgccgcctcttaggtatcgcggagaggacggctgttggtacggtatggaaatacggccattgaaggagaaagaagagaatctggtgaactcattagttacggcggggcacggacaggtggataatttcagtctcggcgtactgggtatggccctttttctggaagagatgttgagaaccagggtcggcactaagcatgctatcctcctggtggcagtgagcttcgtcacactaattaccgggaacatgtcgtttaaagacctgggacgcgttgtggtaatggtgggcgccactatggctgatgacatcgggatgggagtcacatatctcgccctgcttgcagcgttcaaggtgcgacccacctttgccgctggcttgctgttacggaagctcacgtccaaagagctgatgatgactaccattggtatcgttcttctgtctcaaagcacaatacctgaaaccgtgctagagctcactgatgccctggcattggggatgatggtcctgaagatcgtgcgtaatatggaaaaataccagttagctgttacaattatggccatcctctgcgtgcccaacgcagtcattctgcagaatgcctggaaggtatcatgtaccatccttgctgtggttagtgtgtccccactgttgctcacatctagccagcagaaaactgactggatacctctggcgctaaccattaagggactgaaccccacggccatcttccttacaaccctctccagaactaataaaaagaggtcatggccactgaacgaggcaatcatggctgtcggcatggtgagcattttggccagttctctgttaaagaatgacataccgatgaccggccctctcgtagccgggggactgcttacagtgtgctatgtcctgactggtcgctccgctgatttggaactcgagcgggcaaccgacgttaaatgggaggatcaggccgaaatcagcggctcgtcacccattctgtctatcacgattagtgaggacgggtccatgagcatcaagaacgaagaggaggaacagacactaaccatactgatcagaactggacttctcgtgatttctggcctgtttccaatcagcattcccatcacagcggctgcctggtacttgtgggaggtgaaaaagcagagggccggtgtcttatgggatgtgccttccccaccccctatggggaaagccgaactggaggacggagcttatcgaataaagcaaaagggcattctcggctactcacagatcggggcaggagtttacaaagaaggtaccttccacactatgtggcatgtaacacgcggcgccgtgctgatgcacaaggggaaacggatcgagccgagttgggcggatgtcaagaaagaccttattagctatggaggcggttggaagctggagggggaatggaaggagggagaagaggtgcaggttttggctctagaaccaggcaaaaatcccagagccgtgcagaccaagcctggcctgtttaaaacgaacactgggaccatcggagcagtctctctcgatttctccccaggtacatcaggcagtcccataattgacaagaaagggaaggtggtaggactgtacggcaacggtgtcgtgaccaggagcggggcctatgtttccgctatcgcccaaacagagaagtctattgaggataatcctgaaatcgaggacgatatatttcgtaaacgccggcttactattatggacttacacccgggagcaggcaagaccaaaagatacctgcccgctatcgtgagggaagccatcaagcgaggcctccggacgttgattctggcgccaacacgcgtcgtggccgcagagatggaagaggctctcagagggctgcctatcaggtatcagactcccgccattcgggctgagcataccggacgagaaatagttgaccttatgtgtcacgcaacattcaccatgagactgttgtcgccagtgcgcgtccctaactacaatctaatcattatggatgaggcccatttcactgaccccgccagcatcgctgcgaggggttatatctcaacccgtgtggaaatgggcgaggcagccgggatttttatgacagctacgccaccgggatcccgggatcctttcccccagagtaacgccccaataatcgacgaggaaagagagattcccgaaaggtcttggaatagcggccacgagtgggtaactgattttaaaggtaagaccgtgtggttcgttccttccatcaaggcagggaacgacattgccgcttgcctgcgcaaaaatggaaagaaagtcatccaactctcacgaaagacatttgattctgaatacataaaaaccagaactaacgactgggatttcgtggtgacaaccgacatcagcgagatgggcgcgaattttaaggccgagcgggtcattgatccaaggcgctgtatgaaacccgtaatcttaacggacggcgaagaacgtgtgattctggcagggcctatgccggttactcatagttccgctgcccagagacggggaaggatcggtcgcaacccaaagaatgaaaacgaccagtacatatatatgggcgagccccttgaaaatgatgaggactgcgcacactggaaggaggccaaaatgctgctcgataacattaatacacctgaagggatcattcccagcatgttcgagccagaacgagagaaggtggacgctatcgatggagaatacagattgcggggcgaggccaggaaaacctttgtcgacctgatgcgcagaggtgatctccctgtgtggctggcgtataaggttgcagccgaggggataaactacgctgacaggcggtggtgtttcgatggcatcaaaaacaatcagattcttgaagagaacgtggaagtcgagatctggaccaaggagggagaacgtaagaaactaaagccccgctggctggacgcccgaatttattctgatccattggctttaaaagagtttaaggagttcgcagccggcagaaaatcactgactctcaatctgatcacagagatggggaggcttcctaccttcatgacacaaaagactcgggacgctctggataacctcgccgtgttgcacacggcagaagcgggaggtcgcgcctacaatcatgctctgtccgagctaccggagaccctggaaacactccttctgttaactttgctggccaccgtaacaggcgggatatttctcttcctgatgagtggaagaggcattggtaagatgacccttgggatgtgctgcatcatcactgcaagcattctgctctggtatgctcagatccagccccactggatagccgcatcgattatcttggagtttttcctgattgtgttactaatcccagaacctgagaaacagaggacgccccaagacaaccagctgacctacgttgtcatagccatcctcacagtggtggctgcgactatggccaatgaaatgggctttcttgagaagaccaaaaaggacctgggattgggctctattgcaacacagcagccagagtccaacatcctggatattgacctccggcctgctagcgcctggaccctgtacgccgtcgcaactacattcgttacgcccatgcttcgacattcaatcgaaaatagttctgtgaacgtatccctcaccgctattgccaatcaagcgactgtgctgatggggttgggaaaaggttggccgctgagcaagatggatatcggcgtcccattactagctatagggtgttattcacaggtgaaccctattacactgaccgccgcactccttctgttggttgcccactacgctatcatcggacccggcctgcaggcaaaggccaccagagaggcgcagaaacgcgctgccgcaggtattatgaagaatccaacagtggacgggataactgtcatcgatctcgaccccattccttatgatccgaaatttgaaaagcaactgggccaggtaatgcttttaatcctgtgcgtgacgcaggttctcatgatgaggaccacatgggccttgtgtgaggctctgactctagccaccggacccattagtacactgtgggaaggcaacccagggcggttctggaataccactatcgcagtgagcatggctaacatatttcgtggatcctacctcgccggcgcgggtcttctgttctctatcatgaaaaatacgacaaacaccagaagggggactggaaacatgggcgagaccttgggtgagaagtggaaaagccgcctgaatgccctcggcaagtccgaatttcaaatttataagaaatcagggatccaggaggtcgaccggacactggcaaaggaaggaattaaacgaggcgagactgatcaccatgctgtgtctagagggagtgccaagttaaggtggttcgtcgagcgcaacatggtgacccctgaaggaaaagttgtggaccttggctgcggtagagggggatggtcgtactattgtggcggtctgaagaatgtaagagaggtgaagggcctcacaaaagggggacccggccacgaggaacctatcccaatgagcacgtacgggtggaacctagtccgtctgcagtccggagttgatgtgtttttcataccccctgaaaagtgcgacaccttgctgtgtgatattggcgagtcttcaccaaatcccactgtcgaggcaggtaggacactccgggtgcttaacctggtagaaaattggttgaacaataacacccagttctgcatcaaagtgctgaatccgtacatgcctagcgttatcgagaagatggaagctctccaacgcaaatatgggggagccttagtgcgaaacccactgtccagaaatagtactcatgagatgtactgggtctctaacgccagcggcaatattgtgtcatccgtcaacatgataagtaggatgcttatcaaccggtttacaatgcgccacaagaaggcgacctatgaacccgacgtggacctgggcagcgggacgagaaatattggaatcgagtctgagattcctaacctagatatcataggtaaaaggatcgaaaagattaaacaggagcatgaaacctcctggcactacgaccaggatcacccatataagacatgggcttaccatggctcatatgagactaaacagaccgggagcgcatcgtctatggttaatggagtagtgcgactcctgacaaagccctgggacgtcttgccgactgtgacccaaatggccatgacagataccactcctttcggccagcagcgggtttttaaggaaaaagtggacacgcgtacacaggagcccaaggagggtaccaaaaagctgatgaaaatcactgctgaatggctctggaaggagcttgggaaaaagaagaccccaagaatgtgtacacgcgaagagttcacgaggaaagtccggagtaacgccgcactgggagccatttttaccgatgagaataagtggaaatccgctagagaagcggtggaggacagccgcttctgggaattagtagataaggagaggaacctgcacttggaaggcaaatgcgagacttgtgtgtacaatatgatgggcaagcgagagaagaaactcggggaatttggaaaggccaaaggttcacgggcaatctggtacatgtggctgggcgctagattcctagagtttgaagcccttgggttcctgaacgaggaccattggttttccagggaaaattctctcagcggagttgagggcgagggtctgcacaagttggggtatattctgcgcgatgtcagtaaaaaggaaggaggcgcaatgtacgccgacgacacagctggctgggatacccgtataactctcgaggaccttaagaacgaagagatggtgacaaatcacatggaaggggagcatcggaaactggccgaggcgatcttcaagttaacctatcaaaacaaagtggtcagagttcagaggcctacaccccgcggaactgtgatggatattatctcccgacgggaccagagaggtagcggccaagtagggacctacggactgaatacgtttaccaacatggaagcacagttgatcaggcagatggagggcgaaggtgtgttcaagaatattcaccatctcacagtcactgaggaggtggccgttcagaactggctggctcgcgtggggagagaacggctatctaggatggccatatcaggagatgactgcgtcgtgaaaccacttgatgaccgtttcgcaaacgctctgaccgccctcaatgatatgggcaagatccgaaaggacattcaacagtgggagcccagtaaaggctggaacgattggacacaggtacctttttgctcccaccatttccacgaactgatcatgaaggacgggcgcgttttggtggtcccatgtagaaatcaggatgagttaattggacgggctaggatcagccaaggtgccggctggtctctgcgcgaaactgcatgcctcgggaaatcgtatgcgcagatgtggtcacttatgtactttcacagacgggacctgaggctagccgctaacgccatatgtagcgcagtgccgtcccattgggtgcccaccagtcgaacgacatggtctatccacgctaagcatgagtggatgaccactgaggacatgctgacagtctggaatcgtgtttggattagagaaaacccttggatggaggataaaaccccagtggaaagctgggaggaaatcccctatctcggaaagcgcgaggaccagtggtgcggctccttgattggtctgacttcacgggccacctgggcaaagaatatccaggccgcgataaaccaagtaaggagtcttattgggaatgaggaatacacagattacatgccttctatgaaaagattccgccgggaggaagaggaagctggagtgctgtggtga

SEQ ID NO: 14881 - RNA, 9876 nt, synthetic construct
  misc_feature 1..9876: note = derived and/or modified CDS sequence (opt3) from DENV-2__EU482468__SS-prME
  source 1..9876: mol_type = other RNA
agcgcaggaatgatcattatgctgataccaaccgtgatggctttccacctcactactagaaacggggaacctcatatgatcgtcggtattcaagaaaagggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggataatgaggcatcctggcttcaccatcatggccgcaattctggcctacacaatcggcaccacgcactttcagcgggtgttgattttcatcctcctgactgctgttgcaccatctatgacaatgcgctgcatagggatttcgaacagagattttgtggaaggagtctcaggtggcagctgggtggacatcgtactggagcacgggagttgtgttaccactatggccaagaataagcccacactcgatttcgaattaattaaaaccgaggctaagcagcctgccacgctgaggaaatattgcatcgaagcgaaacttaccaacacaactaccgagtcccggtgtccaacacaaggagagccctctttgaaagaagaacaggacaagcgctttgtgtgcaagcatagcatggtcgatcgaggctggggtaatgggtgtggactgttcggcaaaggcgggatcgtgacttgcgcaatgtttacctgcaagaaaaacatggaaggaaagattgtgcagcctgagaatctagaatacacaatagtcgttaccccacactccggtgaggagcatgccgtgggcaacgacactgggaaacacggaaaggaaatcaaagtaacgccgcagtcaagtattacagaggctgaactcaccggctatggtactgtgaccatggagtgtagccccagaacagggctggatttcaatgaaatggtccttctgcaaatggagaacaaggcctggttggtgcacaggcagtggtttctcgacctgcctttaccatggctgcccggcgcagataagcaggagtctaattggatccagaaagaaaccctcgttactttcaagaaccctcatgctaaaaagcaagacgtggtcgtgcttggatcccaggagggcgccatgcacacagcgctgacgggggccaccgaaatacagatgtcaagcggaaatttgctatttactggtcatctgaaatgccggctccgtatggacaagctgcaacttaagggcatgagttactctatgtgtacagggaaattcaaggtagttaaagagattgcagagacccagcacggaacaatcgtgatccgcgtccagtatgaaggcgatggttccccatgcaagattcccttcgagatcatggacctggagaagagatacgtgttggggaggctcattactgtcaacccgatagtgaccgagaaggatagccctgttaacatcgaagctgagcccccatttggcgactcgtacattatcatcggagtggagcctggccagctgaagttaaattggttcaaaaaggggtcttccattggacaaatgtttgaaacgaccatgcggggtgccaaacgaatggctatactgggcgatacagcctgggacttcgggtcactaggaggcgtatttacaagtatcggtaaggcactccatcaggtcttcggggccatttatggcgctgcgtttagcggagtgtcctggaccatgaaaatcctgattggcgttatcataacatggatcgggatgaactctcgcagcacttcacttagtgtgtccttggtcctggtgggaattgtaaccctctacctgggcgtgatggttcaggcagatagcggttgtgtcgtgtcttggaagaataaggagcttaaatgcgggtcaggaatcttcattacggacaacgtgcacacatggaccgaacagtataagtttcaacccgagagtccaagcaaactggcctccgctatccagaaggcccaggaagagggcatatgtggtattagatctgtcactaggttggagaatctcatgtggaaacagatcacacccgaactgaaccacattttagcagagaatgaagttaagctgaccatcatgactggcgatatacgggggatcatgcaagccggaaaacgctcgctaagacctcagccaaccgagctcaagtacagctggaagacatggggcaaagctaagatgctgtccacggaatcatataaccagaccttccttattgacgggccggagactgccgagtgccccaatacaaacagggcatggaatagtttggaagtggaggattacggatttggcgtgttcaccacaaacatctggctgaaactcaaggaaaaacaggacgcgttttgtgactctaagctgatgagcgctgccattaaggataatcgtgcagtacatgccgacatgggttattggatggagtccgctttaaacgatacttggaaaatcgagaaggcctcattcatagaagtcaaaaattgccactggcctaagagccataccctgtggtctaacggggtgcttgagtccgaaatgattatccccaagaacttggcaggacccgttagtcaacacaattaccggcctggctaccacacgcagatcgctggtccatggcatctcggcaagctggagatggacttcgatttttgtgacgggacaaccgtgattgtcactgaagattgcggaaaccgaggccccagcctaagaaccacaactgcctctgggaagctgatcaccgagtggtgctgtaggtcctgcacactcccgcctctgcgctatcggggagaggacggctgttggtacggtatggaaattagaccacttaaagagaaggaagagaatttggtgaactcactggttacggcggggcacggacaggtggataatttcagtttaggcgtactcggtatggccctgtttcttgaagagatgctgaggacccgcgtcggcactaaacatgctatattgctcgtggcagtgagcttcgtcacactgatcaccgggaacatgtcgtttaaggacctaggacgagttgtggtaatggtgggcgccactatggctgatgacattgggatgggagtcacatatctggccctcctggcagcgttcaaagtgcggcccacctttgccgctggccttttgctgcgtaagttaacgtccaaggagctcatgatgactaccatcggtattgttctgctttctcaaagcacaatccctgaaaccgtgctggagctaactgatgccctcgcactggggatgatggtcttgaaaatagtgagaaatatggaaaagtaccagctggctgttacaatcatggccattttatgcgtgcccaacgcagtcatcctccagaatgcctggaaagtatcatgtaccattctggctgtggttagtgtgtccccacttctgttgacatctagccagcaaaagactgactggatccctctcgcgctgaccataaaaggactaaaccccacggccattttcctgacaaccctttccaggactaataagaaacgctcatggccactcaacgaggcaatcatggctgtcggcatggtgagcatcctggccagttctttgctgaagaatgacattccgatgaccggccctttagtagccgggggactcctgacagtgtgctatgtccttactggtcggtccgctgatctggaattggagagagcaaccgacgttaagtgggaggatcaggccgaaataagcggctcgtcacccatcctctctattacgatcagtgaggacgggtccatgagcattaaaaacgaagaggaggaacagacactgaccatcctaataaggactggactgcttgtgatctctggcctctttccaattagcatccccattacagcggctgcctggtacctgtgggaggtgaagaaacagcgagccggtgtcttgtgggatgtgccttccccaccccctatggggaaggccgaattagaggacggagcttatcgcatcaaacaaaagggcatactgggctactcacagattggggcaggagtttacaaggaaggtaccttccacactatgtggcatgtaacacggggcgccgtgctcatgcacaaagggaagagaatcgagccgagttgggcggatgtcaaaaaggacctgatcagctatggaggcggttggaaacttgagggggaatggaaggagggagaagaggtgcaggttctggctttggaaccaggcaagaatcccagggccgtgcagaccaaacctggcctatttaagacgaacactgggaccattggagcagtctctctggatttctccccaggtacatcaggcagtcccatcatagacaaaaaggggaaagtggtaggactctacggcaacggtgtcgtgacccgtagcggggcctatgtttccgctattgcccaaacagagaagtctatcgaggataatcctgaaattgaggacgatatctttcgcaagcggagactgactataatggaccttcacccgggagcaggcaaaaccaagaggtacttacccgctattgtgcgagaagccatcaaacggggcctgcgcacgctcatcttggcgccaacaagagtcgtggccgcagagatggaagaggctctgagggggctccctattcggtatcagactcccgccatccgagctgagcataccggaagagaaattgttgacctgatgtgtcacgcaacattcaccatgcgccttctgtcgccagtgagggtccctaactacaatttgataatcatggatgaggcccatttcactgaccccgccagcattgctgcgcgtggttatatctcaacccgggtggaaatgggcgaggcagccgggatctttatgacagctacgccaccgggatccagagatcctttcccccagagtaacgccccaattatagacgaggaaagggagatccccgaacgctcttggaatagcggccacgagtgggtaactgattttaagggtaaaaccgtgtggttcgttccttccattaaggcagggaacgacatcgccgcttgcctacgaaagaatggcaagaaggtcattcaactgtcaagaaaaacatttgattctgaatacgtgaagacccggactaacgactgggatttcgtggtcacaaccgacatcagcgagatgggcgcgaattttaaagccgagagggtaatagatccacgccgttgtatgaagcccgtgatcctcacggacggcgaagagagagttattttagcagggcctatgccggtgactcatagttccgctgcccagcggaggggacgcatcggtcgaaaccccaagaatgaaaacgaccagtacatttatatgggcgagcccctggaaaatgatgaggactgcgcacactggaaggaggccaagatgcttctggataacatcaatacacctgaagggataattcccagcatgttcgagccagaaagagagaaagtcgacgctatcgatggagaataccggctcaggggcgaggcccgcaagacctttgtggacttgatgagaaggggtgatctgcctgtttggctcgcgtataaagtggcagccgaggggattaactacgctgaccggcgttggtgtttcgatggcatcaagaacaatcagatactggaagagaacgtcgaagtggagatctggaccaaagagggagaacgcaagaaacttaaaccccgatggctagacgccagaatttattctgatccactggctttgaaggagtttaaagagttcgcagccggcaggaagtcattaactctgaatctcatcacagagatggggcggctgcctaccttcatgacacagaaaactcgcgacgctcttgataacctggccgtactccacacggcagaagcgggaggtagagcctacaatcatgctttgtccgagctgccggagaccctagaaacactgctccttctgactttattggccaccgtgacaggcgggatttttctgttcctcatgagtggaaggggcatcggtaagatgaccctggggatgtgctgcataattactgcaagcacgcttctgtggtatgctcagatccagccccactggatcgccgcatcgattatcctcgagtttttcttgatagttctgttaattccagaacctgagaagcagcggaccccacaagacaaccagctaacatacgtcgtgatcgccattctgactgtggtcgctgcgaccatggccaatgaaatgggctttctcgagaaaacaaagaaagaccttggactgggctctatcgcaacccagcagccagagtccaacatattggatatcgacctgcgacctgctagcgcctggactctctacgccgttgcaacaacgttcgtgacccccatgctgagacattcaattgaaaatagttctgtaaacgtgtcccttactgctatcgccaatcaagcgacagtcctcatggggctgggaaagggttggccgttgagcaaaatggatattggcgtgccactgttagctatcgggtgttattcacaggttaaccctattaccctaaccgccgcactgctccttctggtggcccactacgctatcataggacccggcttgcaggcaaaggccacacgcgaggcgcagaagagggctgccgcaggtattatgaaaaatccaactgtcgacgggatcacggtaatcgatctggaccccattccttatgatccgaagtttgaaaaacaactcggccaggtgatgctgcttatattatgcgttacccaggtgctgatgatgcggacaacttgggccctctgtgaggctttgaccctggccacaggacccatcagtaccctatgggaaggcaacccagggcgtttctggaatactacgattgcagtcagcatggctaacatctttagaggatcctacctggccggcgcgggtctccttttctctattatgaagaatacaaccaacactaggcgcgggaccggaaacatcggcgagacactgggtgagaaatggaaaagccggttgaatgccctgggcaaatccgaatttcaaatatataagaagtcagggatccaggaggtggaccgaactctcgcaaaagaaggaattaagagaggcgagaccgatcaccatgctgtctctagggggagtgccaaactgcgctggttcgtggagcggaacatggttacacctgaaggaaaggtggtagacttaggctgcggtagagggggatggtcgtactattgtggcggtcttaaaaatgtgcgtgaggtcaagggcctgacgaaagggggacccggccacgaagaacctatcccaatgagcacctacgggtggaacctcgttaggctacagtccggagtggatgtctttttcattccccctgaaaaatgcgacactctgttgtgtgatatcggcgagtcttcaccaaatcccacagtggaggcaggtcggaccctgcgcgtactcaaccttgtggaaaattggctgaacaataacactcagttctgcataaaggttttgaatccgtacatgcctagcgtgattgagaaaatggaagctctgcaacgaaagtatgggggagccctcgtcagaaacccattatccaggaatagtacacatgagatgtactgggtgtctaacgccagcggcaatatcgtctcatccgtgaacatgatcagtcggatgctgattaaccgctttaccatgagacacaaaaaggcgacgtatgaacccgacgttgaccttggcagcgggaccaggaatataggaatcgagtctgagattcctaacctggatatcattggtaagcgaatcgagaaaataaagcaggagcatgaaacatcctggcactacgaccaggatcacccatataaaacttgggcttaccatggctcatatgagaccaagcagacagggagcgcatcgtctatggtaaatggagtggtccggctactcactaaaccctgggacgtgctgccgaccgttacacaaatggccatgaccgatactacgcctttcggccagcagcgtgtgtttaaggaaaaggtcgacacaagaacccaggagcccaaagagggtactaagaaattgatgaagatcaccgctgaatggctgtggaaagagctcgggaagaaaaagacaccacgcatgtgtacgagggaagagttcacccggaaggtgagaagtaacgccgcacttggagccatttttactgatgagaataaatggaagtccgctcgcgaagcggtagaggacagcaggttctgggaactggtggataaagagcgaaacttacacctggaaggcaagtgcgagacatgtgtttacaatatgatgggcaaacgggagaagaagttgggggaatttggaaaagccaagggttcaagagcaatctggtacatgtggctcggcgctaggttcctggagtttgaagccctagggttccttaacgaggaccattggttttcccgcgaaaattctctgagcggagtcgagggcgagggtctccacaaactggggtatattttgcgtgatgtgagtaagaaagaaggaggcgcaatgtacgccgacgacaccgctggctgggatactcggatcacactggaggacctcaagaacgaagagatggtgaccaatcacatggaaggggagcataagaaacttgccgaggcgattttcaagctgacatatcaaaacaaagtcgttagagtgcagaggcctactccccgcggaaccgtaatggatataatctcccgacgggaccagagaggtagcggccaagtggggacgtacggattaaatacctttacaaacatggaagcacagctgattaggcagatggagggcgaaggtgtcttcaagaatatccagcacttgactgtgaccgaggaggttgccgtgcataactggctcgctcgcgtcgggagagaacggctgtctaggatggccatctcaggagatgactgcgtggtaaaaccactagatgaccgtttcgcaaacgctcttacagccctgaatgatatgggcaagattcgaaaggacatacaacagtgggagcccagtaaaggctggaacgattggactcaggttcctttttgctcccaccatttccacgaactcatcatgaaggacgggcgcgtgctggtcgtgccatgtagaaatcaggatgagttgattggacgggctaggatcagccaaggtgccggctggtctttacgcgaaaccgcatgcctggggaaatcgtatgcgcagatgtggtcactcatgtactttcacagacgggaccttaggctggccgctaacgccatttgtagcgcagtgccgtcccattgggtccccacgagtcgaacaacctggtctatccacgctaagcatgagtggatgactacagaggacatgctaaccgtttggaatcgtgtgtggataagagaaaacccttggatggaggataaaactccagtagaaagctgggaggaaatcccctatctgggaaagcgcgaggaccagtggtgcggctccctcattggtttgacctcacgggccacatgggcaaagaatatccaggccgcgattaaccaagtgaggagtctgatcgggaatgaggaatacacggattacatgccttctatgaaaagattccgccgggaggaagaggaagctggagtcctttggtga

SEQ ID NO: 14882 - RNA, 9876 nt, synthetic construct
  misc_feature 1..9876: note = derived and/or modified CDS sequence (opt3) from DENV-2__EU482469__SS-prME
  source 1..9876: mol_type = other RNA
agcgcaggaatgatcattatgctgatacccaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacacgatcacttacaaatgcccattactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcccacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcatgggagttgtgttaccactatggccaagaataagcccacattagatttcgaactgattaaaaccgaggctaagcagcctgccacgcttaggaaatactgcatcgaagcgaagttgaccaacacaactaccgagtcccggtgtccaacacaaggagagccctctctgaaagaagaacaggacaagcgctttgtgtgcaagcacagcatggtcgatcgaggctggggtaatgggtgtggactattcggcaaaggcgggatcgtgacttgcgcaatgtttacctgcaagaaaaacatggaaggaaagattgtgcagcctgagaatctcgaatatacaatagtcgttaccccacattccggtgaggagcacgccgtgggcaacgacactgggaaacacggaatggaaatcaaggtaacgccgcagtcaagtattacagaggctgaactgaccggctacggtactgtgaccatggagtgtagccccagaacagggcttgatttcaatgaaatggtcctgttgcaaatggagaacaaagcctggctcgtgcataggcagtggtttctggacttacctctgccatggctccccggcgcagataagcaggagtctaattggatccagaaggaaacccttgttactttcaaaaaccctcacgctaagaaacaagacgtggtcgtgctgggatcccaggagggcgccatgcatacagcgttgacgggggccaccgaaatacagatgtcaagcggaaatctactgtttactggtcacctcaagtgccggctgcgtatggacaaacttcaactgaagggcatgagttattctatgtgtacagggaagttcaaagtagttaaggagattgcagagacccagcatggaacaatcgtgatccgcgtccagtacgaaggcgatggttccccatgcaaaattcccttcgagatcatggacttggaaaagagatatgtgctcgggaggctgattactgtcaacccgatagtgaccgagaaagatagccctgttaacatcgaagctgagcccccatttggcgactcgtacattatcatcggagtggagcctggccagttaaagctgaattggttcaagaaagggtcttccattggacaaatgtttgaaacgaccatgcggggtgccaagcgaatggctatactaggcgatacagcctgggacttcgggtcactcggaggcgtatttacaagtatcggtaaagcactgcaccaggtcttcggggccatttacggcgctgcgtttagcggagtgtcctggaccatgaagatccttattggcgttatcataacatggatcgggatgaactctcgcagcacttcattgagtgtgtccctggtcctcgtgggaattgtaaccctgtatcttggcgtgatggttcaggcagatagcggttgtgtcgtgtcttggaaaaataaggagctgaagtgcgggtcaggaatcttcattacggacaacgtgcacacatggaccgaacagtacaaatttcaacccgagagtccaagcaagttggcctccgctatccagaaagcccaggaagagggcatatgtggtattagatctgtcactaggctcgagaatctgatgtggaagcagatcacacccgaattaaaccatattctggcagagaatgaagttaaactaaccatcatgactggcgatatacgggggatcatgcaagccggaaagcgctcgctcagacctcagccaaccgagctgaaatatagctggaagacatggggcaaggctaaaatgctttccacggaatcatacaaccagaccttcttgattgacgggccggagactgccgagtgccccaatacaaacagggcatggaatagtctggaagtggaggattatggatttggcgtgttcaccacaaacatctggctcaagctgaaagaaaagcaggacgcgttttgtgactctaaattaatgagcgctgccattaaggataatcgtgcagtacacgccgacatgggttactggatcgagtccgctctgaacgatacttggaagatagagaaagcctcattcattgaagtcaagaattgccattggcctaaaagccacaccctttggtctaacggggtgttggagtccgaaatgatcatcccaaagaacctcgcaggacccgttagtcaacacaattatcggcctggctaccatacgcagattgctggtccatggcacctgggcaaactagagatggacttcgatttttgtgacgggacaaccgtgatcgtcactgaagattgcggaaaccgaggccccagcctgagaaccacaactgcctctgggaagctcattaccgagtggtgctgtaggtcctgcacactgccgcctcttcgctaccggggagaggacggctgttggtatggtatggaaataagaccattgaaggagaaagaagagaatctggtgaactcattagttacggcggggcatggacaggtggataatttcagtctcggcgtactgggtatggccctttttctggaagagatgttgaggacccgcgtcggcactaagcacgctatcctcctggtggcagtgagcttcgtcacactaattaccgggaacatgtcgtttaaagacctgggacgagttgtggtaatggtgggcgccactatggctgatgacatcgggatgggagtcacatacctcgccctgcttgcagcgttcaaggtgcggcccacctttgccgctggcttgctgttacgtaaactcacgtccaaggagctgatgatgactaccattggtatcgttcttctgtctcaaagcacaatacctgaaaccgtgctagagctcactgatgccctggcattggggatgatggtcctgaagatcgtgagaaatatggaaaaatatcagttagctgttacaattatggccatcctctgcgtgcccaacgcagtcattctgcagaatgcctggaaggtatcatgtaccatccttgctgtggttagtgtgtccccactgttgctcacatctagccagcagaagactgactggatacctctggcgctaaccattaagggactgaaccccacggccatcttccttacaaccctctccaggactaataaaaagcgctcatggccactgaacgaggcaatcatggctgtcggcatggtgagcattttggccagttctctgctcaaaaatgacataccgatgaccggccctctagtagccgggggactgcttacagtgtgctacgtcctgactggtcggtccgctgatttggaactcgagagagcaaccgacgttaagtgggaggatcaggccgaaatcagcggctcgtcacccattctgtctatcacgattagtgaggacgggtccatgagcatcaagaacgaagaggaggaacagacactaaccatactgatcaggactggacttctcgtgatttctggcctgtttccaatcagcattcccatcacagcggctgcctggtatttgtgggaggtgaaaaagcagcgagccggtgtcttatgggatgtgccttccccaccccctatggggaaagccgaactggaggacggagcttaccgcataaagcaaaaaggcattctcggctattcacagatcggggcaggagtttacaaggaaggtaccttccatactatgtggcacgtaacacggggcgccgtgctgatgcacaaggggaaaagaatcgagccgagttgggcggatgtcaagaaagaccttattagctacggaggcggttggaagctggagggggaatggaaagagggagaagaggtgcaggttttggctctagaaccaggcaagaatcccagggccgtgcagaccaagcctggcctgtttaaaacgaacactgggaccatcggagcagtctctctcgatttctccccaggtacatcaggcagtcccataattgacaagaaagggaaggtggtaggactgtatggcaacggtgtcgtgacccgtagcggggcctacgtttccgctatcgcccaaacagagaaaaatattgaggataaccctgaaatcgaggacgatatatttcgcaagcggagacttactattatggacttacatccgggagcaggcaagaccaaaaggtatctgcccgctatcgtgcgagaagccatcaagcggggcctccgcacgttgattctggcgccaacaagagtcgtggccgcagagatggaagaggctctcagggggctgcctatccggtaccagactcccgccattcgagctgagcacaccggaagagaaatagttgaccttatgtgtcatgcaacattcaccatgcgcctgttgtctccagtgagggtccctaattataacctaatcattatggatgaggcccacttcactgaccccgcctcgatcgctgcgcgtggttacatcagcacccgggtggaaatgggcgaggcagccgggatttttatgacagctacgccaccgggatcaagagatcctttcccccagtccaatgccccaataatcgacgaggaaagggagattcccgaacgcagttggaactctggccatgagtgggtaactgattttaaaggtaagaccgtgtggttcgttcctagcatcaaagcagggaatgacattgccgcttgcctgcgaaagaacggaaagaaagtcatccaactctccagaaagacatttgattcagaatatgtgaaaacccggactaatgactgggatttcgtggtcacaaccgacatatctgagatgggcgcgaactttaaggccgagagggtaatcgatccacgccgttgtatgaaacccgtgattttaacggacggcgaagagagagttatcctggcagggcctatgccggtgactcacagcagtgctgcccagcggaggggacgcattggtcgaaatccaaagaacgaaaatgaccagtacatctacatgggcgagccccttgaaaacgatgaggactgcgcacactggaaagaggccaagatgctgctcgataatataaacacacctgaagggattatcccctccatgttcgagccagaaagagagaaggtcgacgctattgatggagaatatcggttgaggggcgaggcccgcaaaacctttgtggacctgatgagaaggggtgatctccctgtttggctggcgtacaaggtggcagccgaggggatcaactatgctgaccggcgttggtgtttcgatggcatcaaaaataaccagatccttgaagagaatgtcgaagtggagatttggaccaaggagggagaacgcaaaaagctaaagccccgatggctggacgccagaatctacagcgatccattggctttaaaagagtttaaggagttcgcagccggcaggaaatctctgactctcaacctgattacagagatggggcggcttcctaccttcatgacacaaaagactcgcgacgctctggataatctcgccgtattgcatacggcagaagcgggaggtagagcctataaccacgctctgtcagagctaccggagaccctggaaacactccttctgttaactttgctggccaccgtgacaggcgggatctttctcttcctgatgtccggaaggggcataggtaaaatgacccttgggatgtgctgcattatcactgcaagtatcctgctctggtacgctcagattcagccccattggatcgccgcaagcataattttggagtttttcctgatcgttttactaattccagaacctgagaagcagcggacgccccaagacaatcagctgacctatgtcgtgatcgccatactcacagtggtcgctgcgactatggccaacgaaatgggctttcttgagaagaccaaaaaggacctgggattgggctcgatcgcaacacagcagccagagtctaatattctggatatcgacctccgacctgcttccgcctggaccctgtacgccgttgcaactacattcgtgacgcccatgcttagacacagcattgaaaactcaagtgtaaatgtgtctctcaccgctatcgccaaccaagcgactgtcctgatggggttgggaaaaggttggccgctgtccaagatggatattggcgtgccattactagctatcgggtgttacagccaggttaatcctataacactgaccgccgcactccttctgttggtggcccactatgctattatcggacccggcctgcaggcaaaagccacccgcgaggcgcagaagagggctgccgcaggtatcatgaagaacccaacagtcgacgggattactgtaatagatctcgaccccatcccttacgatccgaaatttgaaaagcaactgggccaggtgatgcttttaattctgtgcgttacacaggtgctcatgatgcggaccacatgggccttgtgtgaggctctgactctagccaccggacccatctcaacactgtgggaaggcaatccagggcgtttctggaacaccactattgcagtcagtatggctaatatctttagaggaagctatctcgccggcgcgggtcttctgttctccataatgaaaaacacgacaaacaccaggcgcgggactggaaataccggcgagacattgggtgagaagtggaaatctcggctgaacgccctcggcaagagcgaatttcaaatctacaaaaagtccgggattcaggaggtggaccgaactctggcaaaggaaggaatcaaaagaggcgagaccgatcatcacgctgtctcaagggggtctgccaagttacgctggttcgtggagcggaatatggttacacctgaaggaaaagtggtagaccttggctgcggtagagggggatggagttattactgtggcggtctgaagaacgtgcgtgaggtcaaaggcctcacgaaagggggacccggccatgaggaacctattccaatgtcgacctatgggtggaatctagttaggctgcagagcggagtggatgtctttttcataccccctgaaaagtgcgacactttgctgtgtgatataggcgagtcctctccaaaccccacagtggaggcaggtcggaccctccgcgtacttaatctggtggaaaactggttgaataacaatactcagttctgcattaaagttctgaacccgtacatgccttcagtgatcgagaagatggaagctctccaacgaaaatacgggggagccttagtcagaaatccactgagcaggaactccacacacgagatgtattgggtgagtaatgcctctggcaacatcgtcagctcagtgaacatgatttcccggatgcttataaatcgctttaccatgagacataagaaagcgacgtacgaacccgacgttgacctgggcagtgggaccaggaacatcggaattgagagcgagatccctaatctagatattatcggtaagcgaatagaaaagatcaaacaggagcacgaaacatcttggcactatgaccaggatcatccatacaagacttgggcttatcacggctcctacgagaccaaacagacagggtcagcaagctcgatggtaaacggagtggtccggctcctgactaagccctgggacgtgttgccgaccgttacacaaatggccatgaccgatactacgcctttcggccagcagcgtgtgtttaaagaaaaggtcgacacaagaacccaggagcccaaggagggtactaaaaagctgatgaaaattaccgctgaatggctctggaaggagcttgggaaaaagaaaacaccacgcatgtgtacgagggaagagttcaccaagaaggtgcggtctaatgccgcactgggagccatctttactgatgagaacaaatggaagagtgctagagaagcggtagaggactcccgcttctgggaattagtggataaagagaggaatctgcatttggaaggcaagtgcgagacatgtgtttataacatgatgggcaaacgagagaagaagctcggggaatttggaaaagccaagggtagccgggcaatttggtacatgtggctgggcgctagattcctagagtttgaagcccttgggttcctgaatgaggaccactggttttcaagggaaaactccctctctggagtcgagggcgagggtctgcacaaattggggtacatcctgcgcgatgtgagcaagaaagaaggaggcgcaatgtatgccgacgacaccgctggctgggatactcgtattacactcgaggaccttaagaatgaagagatggtgaccaaccatatggaaggggagcacaagaaactggccgaggcgatattcaagttaacataccaaaataaagtcgttcgggtgcagagacctactcccaggggaaccgtaatggatatcattagtcgccgagaccagcggggttccggccaagtggggacgtatggactgaacacctttacaaatatggaagcacagttgatcagacagatggagggcgaaggtgtcttcaagaacatccagcatctcactgtgaccgaggaggttgccgtgcacaactggctggctagggtcgggcgcgaaagactaagccggatggccatttctggagatgactgcgtggtaaaaccacttgatgacaggttcgcaaatgctctgacagccctcaacgatatgggcaagatacgtaaggacatccaacagtgggagccctcaaaaggctggaatgattggactcaggttcctttttgcagtcatcacttccacgaactgattatgaaggacgggcgaatcttggtggtcccatgtcgcaaccaggatgagttaattggcagagctcggatctcccaaggtgccggctggagcctgagggaaaccgcatgcctcgggaaatcttacgcgcagatgtggtcgcttatgtattttcatcgcagagacctgcggctagccgctaatgccatatgttcagcagtgccgagccactgggtgcccacgtccaggacaacctggagtatccatgctaagcacgagtggatgactacagaggacatgctgaccgtctggaaccgagtttggattcgtgaaaatccttggatggaggataaaactccagtggaatcttgggaggaaatcccctacctcggaaagagagaggaccagtggtgcggcagcttgattggtctgacctcccgcgccacatgggcaaagaacatccaggccgcgataaatcaagtacggtcacttattgggaacgaggaatatacggattacatgcctagtatgaaaaggttcagacgcgaggaagaggaagctggagtgctgtggtga

SEQ ID NO: 14883 - RNA, 9876 nt, synthetic construct
  misc_feature 1..9876: note = derived and/or modified CDS sequence (opt3) from DENV-2__EU482470__SS-prME
  source 1..9876: mol_type = other RNA
agcgccggaatgatcattatgctgatacccaccgtgatggctttccacctcaccactagaaacggggagcctcatatgatcgtcggcattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggggcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagcgatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactgccgagtgccccaatacaaacagagcatggaatagtctggaagtggaggattacggatttggcgtgttcaccacaaacatctggctcaagctgaaagaaaagcaggacgcgttttgtgactctaagttaatgagcgctgccattaaagataatagggcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaaactcattaccgagtggtgctgtagatcctgcacactgccgcctcttaggtatcgcggagaggacggctgttggtacggtatggaaatacggccattgaaggagaaagaagagaatctggtgaactcattagttacggcggggcacggacaggtggataatttcagtctcggcgtactgggtatggccctttttctggaagagatgttgagaaccagggtcggcactaagcatgctatcctcctggtggcagtgagcttcgtcacactaattaccgggaacatgtcgtttaaagacctgggacgcgttgtggtaatggtgggcgccactatggctgatgacatcgggatgggagtcacatatctcgccctgcttgcagcgttcaaggtgcgacccacctttgccgctggcttgctgttacggaagctcacgtccaaagagctgatgatgactaccattggtatcgttcttctgtctcaaagcacaatacctgaaaccgtgctagagctcactgatgccctggcattggggatgatggtcctgaagatcgtgcgtaatatggaaaaataccagttagctgttacaattatgaccatcctctgcgtgcccaacgccgtcattctgcagaatgcatggaaggtatcatgtacaatccttgccgtggttagtgtgtccccactgttgctcacttctagcagacagaaaaccgactggatacctctggctctaacgattaagggactgaaccccacagcgatcttccttaccactctctccaggaccaataaaaagcgctcatggccactgaacgaggccatcatggcagtcggcatggtgagcattttggctagttctctgttaaagaatgacataccgatgacaggccctctcgtagccgggggactgcttactgtgtgctatgtcctgaccggtcggtccgccgatttggaactcgagagagctacggacgttaaatgggaggatcaagcagaaatcagcggctcgtcacccattctgtctatcacaattagtgaggacgggtccatgagcatcaagaacgaagaggaggaacagaccctaactatactgatcaggacaggacttctcgtgatttctggcctgtttccaatcagcattcccatcaccgccgcggcttggtacttgtgggaggtgaaaaagcagcgagccggtgtcttatgggatgtgccttccccaccccctatggggaaagcagaactggaggacggagcctatcgcataaagcagaagggcattctcggctactcacaaatcggggctggagtttacaaagaaggtactttccacacaatgtggcatgtaacccggggcgcagtgctgatgcacaaggggaaaagaatcgagccgagttgggccgatgtcaagaaagaccttattagctatggaggcggttggaagctggagggggaatggaaggagggagaagaggtgcaggttttggcgctagaaccaggcaaaaatcccagggctgtgcagacgaagcctggcctgtttaaaactaacaccgggacaatcggagccgtctctctcgatttctccccaggtacctcaggcagtcccataattgacaagaaagggaaggtggtaggactgtacggcaacggtgtcgtgacacgtagcggggcatatgtttccgccatcgctcagactgagaagtctattgaggataatcctgaaatcgaggacgatatatttcgcaaacggagacttaccattatggacttacacccgggagccggcaagacgaaaaggtacctgcccgcaatcgtgcgagaagctatcaagcggggcctccgcacattgattctggccccaactagagtcgtggcggccgagatggaagaggcactcagggggctgcctatccggtatcaaacccccgctattcgagccgagcatacaggaagagaaatagttgaccttatgtgtcacgctaccttcactatgcgcctgttgtcgccagtgagggtccctaactacaatctaatcattatggatgaggcacatttcaccgaccccgccagcatcgccgctcgtggttatatctcaacacgggtggaaatgggcgaggcggcagggatttttatgacggccactccaccgggatccagagatcctttcccccagagtaacgctccaataatcgacgaggaaagggagattcccgaacgctcttggaatagcggccacgagtgggtaaccgattttaaaggtaagacagtgtggttcgttccttccatcaaggccgggaacgacattgcagcctgcctgcggaaaaatggaaagaaagtcatccagctctcaagaaagacctttgattctgaatacgtgaaaactagaacaaacgactgggatttcgtggtcaccacggacataagcgagatgggcgctaattttaaggcggagagggtaatcgatccacgccgttgtatgaaacccgtgattttaactgacggcgaagagagagttatcctggccgggcctatgccggtgacacatagttccgcagctcaacggaggggacgcattggtcgaaacccaaagaatgaaaacgaccagtacatctatatgggcgagccccttgaaaatgatgaggactgcgcccactggaaggaggcaaaaatgctgctcgataacataaatacccctgaagggattatccccagcatgttcgagccagaaagagagaaggtcgacgccattgatggagaataccggttgaggggcgaggctcgcaaaacctttgtggacctgatgagaaggggtgatctccctgtttggctggcctataaggtggcggcagaggggatcaactacgccgaccggcgttggtgtttcgatggcatcaaaaacaatcagatccttgaagagaacgtcgaagtggagatttggactaaggagggagaacgcaagaaactaaagccccgatggctggacgctagaatctattctgatccattggccttaaaagagtttaaggagttcgctgcaggcaggaaatcactgacactcaatctgattaccgagatggggcggcttcctacattcatgactcagaagacgcgcgacgccctggataacctcgctgtattgcacaccgccgaagcaggaggtagagcgtacaatcatgccctgtccgagctaccggagacactggaaactctccttctgttaaccttgctggctacagtgaccggcgggatctttctcttcctgatgagtggaaggggcataggtaagatgactcttgggatgtgctgcattatcacggccagcatcctgctctggtatgcacaaattcagccccactggatcgctgcctcgataattttggagtttttcctgatcgttttactaattccagaacctgagaaacagcggacaccccaggacaaccaactgacatacgtcgtgatcgcaatactcactgtggtcgccgctaccatggcgaatgaaatgggctttcttgagaagactaaaaaggacctgggattgggctctatcgccacccagcagccagagtccaacattctggatatcgacctccgacctgcaagcgcttggactctgtacgccgttgccacaacgttcgtgacccccatgcttagacattcaattgaaaatagttctgtaaacgtgtccctcactgcaatcgctaatcaggccacagtcctgatggggttgggaaaaggttggccgctgagcaagatggatattggcgtgccattactagcgatcgggtgttattcacaagttaaccctataaccctgaccgctgccctccttctgttggtggcacactacgccattatcggacccggcctgcaggctaaggcaacacgcgaggcccagaaaagggcggctgccggtatcatgaagaatccaactgtcgacgggattacggtaatagatctcgaccccatcccttatgatccgaaatttgaaaagcagctgggccaagtgatgcttttaattctgtgcgttacccaggtgctcatgatgcggacaacttgggcattgtgtgaggccctgaccctagctacaggacccatcagtaccctgtgggaaggcaacccagggcgtttctggaatactacgattgccgtcagcatggcaaacatctttagaggatcctacctcgctggcgccggtcttctgttctctataatgaaaaatacaaccaacactaggcgcgggaccggaaacatgggcgagacattgggtgagaagtggaaaagccggctgaatgcgctcggcaagtccgaatttcagatctataagaaatcagggattcaagaggtggaccgaactctggccaaggaaggaatcaaaagaggcgagaccgatcaccatgcagtctctagggggagtgctaagttacgctggttcgtggagcggaacatggttacacctgaaggaaaagtggtagaccttggctgcggtagagggggatggtcgtactattgtggcggtctgaagaatgtgcgtgaggtcaagggcctcacgaaagggggacccggccacgaagaacctattccaatgagcacctacgggtggaacctagttaggctgcagtccggagtggatgtctttttcataccccctgaaaagtgcgacactttgctgtgtgatataggcgagtcttcaccaaatcccacagtggaggccggtcggaccctccgcgtacttaacctggtggaaaattggttgaacaataacactcagttctgcattaaagttctgaatccgtacatgcctagcgtgatcgagaagatggaagcactccagcgaaaatatgggggagctttagtcagaaacccactgtccaggaatagtacacatgagatgtactgggtgtctaacgccagcggcaatatcgtctcatccgtgaacatgattagtcggatgcttataaaccgctttaccatgagacacaagaaggccacgtatgaacccgacgttgacctgggcagcgggaccaggaatatcggaattgagtctgagatccctaacctagatattatcggtaaacgaatagaaaagatcaaacaagagcatgaaacatcctggcactacgaccaggatcacccatataagacttgggcgtaccatggctcatatgagaccaaacagacagggagcgcttcgtctatggtaaatggagtggtccggctcctgactaagccctgggacgtgttgccgaccgttacacagatggcaatgaccgatactacgcctttcggccaacagcgtgtgtttaaggaaaaagtcgacacaagaacccaggagcccaaggagggtactaaaaagctgatgaaaattaccgccgaatggctctggaaggagcttgggaaaaagaagacaccacgcatgtgtacgagggaagagttcacccggaaagtgagaagtaacgctgccctgggagcaatctttactgatgagaataagtggaaatccgcccgcgaagctgtagaggacagcggcttctgggaattagtggataaggagaggaacctgcacttggaaggcaaatgcgagacatgtgtttacaatatgatggggaagcgagagaagaaactcggagaatttggtaaggcgaaaggctcacgggccatttggtacatgtggctgggggcaagattcctagagtttgaagctcttggattcctgaacgaggaccattggttttccagggaaaattctctcagcggcgtcgagggtgaggggctgcacaagttgggatatatcctgcgcgatgtgagtaaaaaggaaggcggcgccatgtacgcagacgacaccgccgggtgggatactcgtattacactcgaggaccttaagaacgaagagatggtgaccaatcacatggaaggagagcataaaaagctggctgaggccatattcaaattaacatatcagaacaaggtcgttcgggtgcaaagacctactcccaggggtaccgtaatggatatcatttcccgccgagaccagcggggcagcggacaggtgggaacgtacggcctgaatacctttacaaacatggaagcgcaattgatcagacagatggagggtgaaggggtcttcaaaaatatccagcacctcactgtgaccgaggaggttgcagtgcagaactggctggccagggtcggacgcgaaagactatctcggatggctatttcaggcgatgactgcgtggtaaagccacttgatgacaggttcgccaacgcactgacagctctcaatgatatgggcaagatacgtaaagacatccaacagtgggagcccagtaaggggtggaacgattggactcaggttcctttttgctcccatcacttccatgaactgattatgaaagacggacgagtgttggtcgtgccatgtcgcaatcaggatgagttaatcggtagagcccggattagccaaggcgctgggtggtctctgagggaaaccgcctgcctcggaaagtcgtatgcacagatgtggtcacttatgtactttcaccgcagagacctgcggctagcggccaacgctatctgtagcgccgtgccgtcccactgggtccccacgagtaggacaacctggtctatacatgcaaaacacgagtggatgactacagaggacatgctgaccgtttggaatcgagtgtggatccgtgaaaacccttggatggaggataagactccagtagaaagctgggaggaaattccctatctcggcaagagagaggaccagtggtgcggttccttgatcgggctgacctcacgcgctacatgggccaaaaatattcaggcagccatcaaccaagtgcggagtcttataggaaatgaggaatacacggattacatgccttctatgaagaggttcagacgcgaggaagaggaagcgggcgtcctgtggtga

SEQ ID NO: 14884 - RNA, 9876 nt, synthetic construct
  misc_feature 1..9876: note = derived and/or modified CDS sequence (opt3) from DENV-2__EU482471__SS-prME
  source 1..9876: mol_type = other RNA
agcgccggcatgataattatgctgatacccaccgtgatggctttccacctcactactagaaatggggagcctcatatgatcgtcggtattcaagaaaagggaaaatcccttctgtttaagacggaggacggcgttaatatgtgcaccttgatggcaatggatttaggggaactgtgtgaggacactatcacttacaaatgcccattactcaggcaaaacgaaccggaggatattgactgttggtgcaattctacctcaacatgggtgacctatggaacttgtacgaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcattcagtgggcaacgacactgggaaacacggaatggaaatcaaggtaacgccgcagagtagcattacagaggccgaactgaccggctatggtactgtgaccatggagtgttctcccagaacagggcttgatttcaatgaaatggtcctgttgcaaatggagaacaaggcttggctcgtgcacaggcagtggtttctggacttacctctgccatggctccccggcgccgataagcaggagtccaattggatccagaaggaaacccttgttactttcaaaaaccctcatgcaaagaaacaagacgtggtcgtgctgggatcacaggagggcgctatgcacacagccttgacgggggcgaccgaaatacagatgagcagtggaaatctactgtttactggtcatctcaagtgccggctgcgtatggacaaacttcaactgaagggcatgtcttactccatgtgtacagggaagttcaaagtagttaaggagattgccgagacccagcacggaacaatcgtgatccgcgtccagtatgaaggcgatggtagcccatgcaaaattcccttcgagatcatggacttggaaaagagatacgtgctcgggaggctgattactgtcaacccgatagtgaccgagaaagattcgcctgttaacatcgaagcagagcccccatttggcgactcttacattatcatcggagtggagcctggccagttaaagctgaattggttcaagaaagggtcctcaattggacaaatgtttgaaacgaccatgcggggtgctaagcgaatggccatactaggcgatacagcttgggacttcgggagtctcggaggcgtatttactagcatcggtaaagccctgcatcaggtcttcggggcaatttatggcgccgctttttccggagtgtcttggaccatgaagatccttattggcgttatcataacatggatcgggatgaacagccgctcaacaagtttgtccgtgagcctggtcctcgtgggaattgtaaccctgtaccttggcgtgatggttcaggcggattctggttgtgtcgtgtcatggaaaaataaggagctgaagtgcgggagtggaatcttcattacggacaacgtgcacacatggaccgaacagtataaatttcaacccgagagcccatccaagttggcatctgccatccagaaagctcaggaagagggcatatgtggtattagatcggtcactaggctcgagaatctgatgtggaagcagatcacacccgaattaaaccacattctggccgagaatgaagttaaactaaccatcatgactggcgatatacgggggatcatgcaagcaggaaagcgcagcctcagacctcagccaaccgagctgaaatactcctggaagacatggggcaaggccaaaatgctttcaacggaaagttataaccagaccttcttgattgacgggccggagactgctgagtgccccaatacaaacagggcctggaactctctggaagtggaggattacggatttggcgtgttcaccacaaacatctggctcaagctgaaagaaaagcaggacgcattttgtgacagcaaattaatgtccgcggctattaaggataatcgtgccgtacatgcagacatgggttattggatcgagtcagccctgaacgatacttggaagatagagaaagctagcttcattgaagtcaagaattgccactggcctaaatctcataccctttggtccaacggggtgttggagagtgaaatgatcatcccaaagaacctcgccggacccgttagccaacacaattaccggcctggctaccacacgcagattgcaggtccatggcatctgggcaaactagagatggacttcgatttttgtgacgggacaaccgtgatcgtcactgaagattgcggaaaccgaggcccctctctgagaaccacaactgcttccgggaagctcattaccgagtggtgctgtaggtcatgcacactgccgcctcttcgctatcggggagaggacggctgttggtacggtatggaaataagaccattgaaggagaaagaagagaatctggtgaacagtttagttacggccgggcacggacaggtggataatttcagcctcggcgtactgggtatggcgctttttctggaagagatgttgaggacccgcgtcggcactaagcatgccatcctcctggtggctgtgtcgttcgtcacactaattaccgggaacatgtcctttaaagacctgggacgagttgtggtaatggtgggcgcaactatggccgatgacatcgggatgggagtcacatatctcgctctgcttgccgcattcaaggtgcggcccacctttgcggccggcttgctgttacgtaaactcacgtctaaggagctgatgatgactaccattggtatcgttcttctgagccaatcaacaatacctgaaaccgtgctagagctcactgatgctctggccttggggatgatggtcctgaagatcgtgagaaatatggaaaaataccagttagcagttacaattatggctatcctctgcgtgcccaacgccgtcattctgcagaatgcatggaaggtaagttgtaccatccttgccgtggtttccgtgtctccactgttgctcacaagctcccagcagaaaactgactggatacctctggctctaaccattaagggactgaaccccacggcgatcttccttacaaccctctcaaggactaataaaaagcgcagctggccactgaacgaggccatcatggcagtcggcatggtgagtattttggcttcttccctgctcaaaaatgacataccgatgaccggccctctagtagccgggggactgcttacagtgtgctatgtcctgactggtcggagcgccgatttggaactcgagagagctaccaacgttaagtgggaggaccaggcagaaatctcgggctcatctcccattctgagtatcacgatttccgaggatgggagcatgtctatcaagaatgaagaggaggaacagacactaaccatactgatcaggactggacttctcgtgattagcggcctgtttccaatctccattcccatcacagccgcggcttggtacttgtgggaggtgaaaaagcagcgagccggtgtcttatgggacgtgccttcaccaccccctatggggaaagcagaactggaggatggagcctatcgcataaagcaaaaaggcattctcggctacagtcagatcggggctggagtttacaaggaaggtaccttccacactatgtggcatgtaacacggggcgcagtgctgatgcacaaggggaaaagaatcgagccgagctgggccgacgtcaagaaagatcttatttcttatggaggcggttggaagctggagggggaatggaaagagggagaagaggtgcaggttttggcgctagaaccaggcaagaaccccagggctgtgcagaccaagcctggcctgtttaaaacgaacactgggaccatcggagccgtctccctcgacttctcaccaggtacaagtggcagccccataattgataagaaagggaaggtggtaggactgtacggcaatggtgtcgtgacccgttccggggcatatgtttctgccatcgctcaaacagagaaatcgattgaggacaaccctgaaatcgaggatgacatatttcgcaagcggagacttactattatggatttacacccgggagccggcaagaccaaaaggtacctgcccgcaatcgtgcgagaagctatcaagcggggcctccgcacgttgattctggccccaacaagagtcgtggcggccgagatggaagaggcactcagggggctgcctatccggtatcagactcccgctattcgagccgagcataccggaagagaaatagttgaccttatgtgtcacgctacattcaccatgcgcctgttgagcccagtgagggtccctaattacaacctaatcattatggacgaggcacatttcactgatcccgcctcaatcgccgctcgtggttatatctccacccgggtggaaatgggcgaggcggcagggatttttatgacagccacgccaccgggaagtagagaccctttcccccagtctaatgctccaataatcgatgaggaaagggagattcccgaacgcagctggaactccggccacgagtgggtaactgactttaaaggtaagaccgtgtggttcgttccttcaatcaaagccgggaatgatattgcagcctgcctgcgaaagaacggaaagaaagtcatccaactctctagaaagacatttgacagcgaatacgtgaaaacccggactaatgattgggacttcgtggtcacaaccgatataagtgagatgggcgctaactttaaggcggagagggtaatcgacccacgccgttgtatgaaacccgtgattttaacggatggcgaagagagagttatcctggccgggcctatgccggtgactcattccagcgcagctcagcggaggggacgcattggtcgaaatccaaagaacgaaaatgaccagtacatctatatgggcgagccccttgaaaacgacgaggattgcgcccactggaaagaggcaaagatgctgctcgacaatataaacacacctgaagggattatcccctctatgttcgagccagaaagagagaaggtcgatgccattgacggagaataccggttgaggggcgaggctcgcaaaacctttgtggatctgatgagaaggggtgacctccctgtttggctggcctataaggtggcggcagaggggatcaactacgccgatcggcgttggtgtttcgacggcatcaaaaataaccagatccttgaagagaatgtcgaagtggagatttggaccaaggagggagaacgcaaaaagctaaagccccgatggctggatgctagaatctattcagacccattggccttaaaagagtttaaggagttcgctgcaggcaggaaatccctgactctcaacctgattacagagatggggcggcttcctaccttcatgacacaaaagactcgcgatgccctggacaatctcgctgtattgcacacggccgaagcaggaggtagagcgtacaaccatgccctgagtgagctaccggagaccctggaaacactccttctgttaactttgctggctaccgtgacaggcgggatctttctcttcctgatgagcggaaggggcataggtaaaatgacccttgggatgtgctgcattatcactgcctcgatcctgctctggtatgcacagattcagccccactggatcgctgcctctataattttggagtttttcctgatcgttttactaattccagaacctgagaagcagcggacgccccaagataatcagctgacctacgtcgtgatcgcaatactcacagtggtcgccgctactatggcgaacgaaatgggctttcttgagaagaccaaaaaggacctgggattgggctccatcgccacacagcagccagagagcaatattctggacatcgatctccgacctgcatcagcttggaccctgtacgccgttgccactacattcgtgacgcccatgcttagacatagtattgaaaactcttccgtaaatgtgagcctcaccgcaatcgctaaccaagccactgtcctgatggggttgggaaaaggttggccgctgtcaaagatggacattggcgtgccattactagcgatcgggtgttatagtcaggttaatcctataacactgaccgctgccctccttctgttggtggcacactacgccattatcggacccggcctgcaggctaaagcaacccgcgaggcccagaagagggcggctgccggtatcatgaagaacccaacagtcgatgggattactgtaatagacctcgatcccatcccttatgacccgaaatttgaaaagcaactgggccaggtgatgcttttaattctgtgcgttacacaggtgctcatgatgcggaccacatgggcattgtgtgaggccctgactctagctaccggacccatcagcacactgtgggaaggcaatccagggcgtttctggaacaccactattgccgtctccatggcaaatatctttagaggatcttacctcgctggcgccggtcttctgttcagcataatgaaaaacacgacaaacaccaggcgcgggactggaaatatcggcgagaccttgggtgagaagtggaaatcccggctgaacgcgctcggcaagtcagaatttcaaatttataaaaagtctgggatccaggaggtggatcgaacactggccaaggaaggaattaaaagaggcgagactgaccaccatgcagtcagtagggggtcggctaagttacgctggttcgtggagcggaatatggttacccctgaaggaaaagtggtagatcttggctgcggtagagggggatggagctactattgtggcggtctgaagaacgtgcgtgaggtcaaaggcctcacaaaagggggacccggccacgaggaacctatcccaatgtccacgtacgggtggaatctagttaggctgcagtctggagtggacgtctttttcataccccctgaaaagtgcgataccttgctgtgtgacattggcgagtcaagcccaaaccccactgtggaggccggtcggacactccgcgtacttaatctggtggaaaactggttgaataacaatacccagttctgcatcaaagttctgaacccgtacatgccttccgtgatcgagaagatggaagcactccaacgaaaatatgggggagctttagtcagaaatccactgagtaggaactctactcatgagatgtactgggtgagcaatgcctcaggcaacattgtctccagtgtgaacatgataagccggatgcttatcaatcgctttacaatgagacacaagaaagccacctatgaacccgatgttgacctgggctctgggacgaggaacattggaatcgagtccgagattcctaatctagacatcataggtaagcgaatcgaaaagattaaacaggagcatgaaacctcatggcactacgatcaggaccacccatataagacatgggcgtaccatggcagctatgagactaaacagaccgggtcggcttctagtatggtaaacggagtggtccggctcctgacaaagccctgggatgtgttgccgactgttacccaaatggcaatgacagacaccactcctttcggccagcagcgtgtgtttaaagaaaaggtcgatacgagaacacaggagcccaaggagggtaccaaaaagctgatgaaaatcactgccgaatggctctggaaggagcttgggaaaaagaaaaccccacgcatgtgtacaagggaagagttcacgcggaaggtgagatccaatgctgccctgggagcaatttttaccgacgagaacaagtggaaaagcgcccgcgaagctgtagaggattcaaggttctgggaattagtggacaaggagcgaaatctgcacttggaaggcaaatgcgagacttgtgtttacaacatgatgggcaagcgggagaaaaagctcggggaatttggaaaggcgaaaggttccagagccatctggtacatgtggctgggcgcaaggttcctagagtttgaagctcttgggttcctgaatgaggatcattggttttctcgcgaaaacagcctcagtggagtcgagggcgagggtctgcacaagttggggtatattctgcgtgacgtgtccaaaaaggaaggaggcgccatgtacgcagatgacacagccggctgggacacccggataactctcgaggatcttaaaaatgaagagatggtgacaaaccacatggaaggggagcataagaagctggctgaggccatcttcaaattaacctatcaaaataaggtcgttagagtgcagaggcctacaccccgcggaactgtaatggacattatcagccgacgggatcagagaggttctggccaagtggggacctacggactgaacacgtttaccaatatggaagcgcagttgatcaggcagatggagggcgaaggtgtcttcaaaaacattcagcacctcacagtgactgaggaggttgcagtgcataactggctggcccgcgtcgggagagaacggctatcaaggatggctataagtggagacgattgcgtggtaaagccacttgacgatcgtttcgccaatgcactgaccgctctcaacgacatgggcaaaatccgaaaggatattcaacagtgggagccctccaagggctggaatgactggacacaggttcctttttgcagccaccatttccacgaactgatcatgaaagatgggcgcattttggtggtcccatgtagaaaccaggacgagttaatcggacgggccaggatatctcaaggtgctggctggtcgctgcgcgaaactgcctgcctcgggaagtcatatgcacagatgtggagccttatgtactttcacagacgggatctgaggctagcggccaatgctatctgttccgccgtgccgagtcattgggtgcccacctctcgaacgacatggagcattcacgcaaaacatgagtggatgaccactgaggacatgctgacagtctggaaccgtgtttggatcagagaaaatccttggatggaggacaagaccccagtggaatcctgggaggaaattccctatctcggaaaacgcgaggatcagtggtgcggctcattgatcggtctgacaagtcgggctacctgggccaagaacatacaggcagccattaatcaagtaaggtctcttatcgggaacgaggaatacacagactacatgcctagcatgaagagattccgccgggaggaagaggaagcgggagtgctgtggtga

SEQ ID NO: 14885 - RNA, 9876 nt, synthetic construct
  misc_feature 1..9876: note = derived and/or modified CDS sequence (opt3) from DENV-2__EU482472__SS-prME
  source 1..9876: mol_type = other RNA
agcgcaggaatgatcattatgctgataccaaccgtgatggctttccacctcactactagaaacggggaacctcatatgatcgtcggcattcaggaaaagggtaaatcccttctgtttaagacggaggacggagttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatatacgggggatcatgcaagccggaaaacgctcgctcagacctcagccaaccgagctgaagtacagctggaagacatggggcaaagctaagatgctttccacggaatcatataaccagaccttcttgattgacgggccggagactgccgagtgccccaatacaaacagggcatggaatagtctggaagtggaggattacggatttggcgtgttcaccacaaacatctggctcaaactgaaggaaaaacaggacgcgttttgtgactctaagttaatgagcgctgccattaaggataatcgtgcagtacatgccgacatgggttattggatggagtccgctctgaacgatacttggaaaatcgagaaggcctcattcatagaagtcaaaaattgccactggcctaagagccataccctttggtctaacggggtgttggagtccgaaatgattatccccaagaacctcgcaggacccgttagtcaacacaattaccggcctggctaccacacgcagatcgctggtccatggcatctgggcaagctagagatggacttcgatttttgtgacgggacaaccgtgattgtcactgaagattgcggaaaccgaggccccagcctgagaaccacaactgcctctgggaagctcatcaccgagtggtgctgtaggtcctgcacactgccgcctcttcgctatcggggagaggacggctgttggtacggtatggaaattagaccattgaaagagaaggaagagaatctggtgaactcattagttacggcggggcacggacaggtggataatttcagtctcggcgtactgggtatggccctttttctggaagagatgttgaggacccgcgtcggcactaaacatgctatactcctggtggcagtgagcttcgtcacactaatcaccgggaacatgtcgtttaaggacctgggacgagttgtggtaatggtgggcgccactatggctgatgacattgggatgggagtcacatatctcgccctgcttgcagcgttcaaagtgcggcccacctttgccgctggcttgctgttacgtaagctcacgtccaaggagctgatgatgactaccatcggtattgttcttctgtctcaaagcacaatccctgaaaccgtgctagagctcactgatgccctggcattggggatgatggtcctgaaaatagtgagaaatatggaaaagtaccagttagctgttacaatcatggccattctctgcgtgcccaacgcagtcatcctgcagaatgcctggaaagtatcatgtaccattcttgctgtggttagtgtgtccccactgttgctcacatctagccagcaaaagactgactggatccctctggcgctaaccataaaaggactgaaccccacggccattttccttacaaccctctccaggactaataagaaacgctcatggccactgaacgaggcaatcatggctgtcggcatggtgagcatcttggccagttctctgttaaagaatgacattccgatgaccggccctctcgtagccgggggactgcttacagtgtgctatgtcctgactggtcggtccgctgatttggaactcgagagagcaaccgacgttaagtgggaggatcaggccgaaataagcggctcgtcacccatcctgtctattacgatcagtgaggacgggtccatgagcattaaaaacgaagaggaggaacagacactaaccatcctgataaggactggacttctcgtgatctctggcctgtttccaattagcatccccattacagcggctgcctggtacttgtgggaggtgaagaaacagcgagccggtgtcttatgggatgtgccttccccaccccctatggggaaggccgaactggaggacggagcttatcgcatcaaacaaaagggcatactcggctactcacagattggggcaggagtttacaaggaaggtaccttccacactatgtggcatgtaacacggggcgccgtgctgatgcacaaagggaagagaatcgagccgagttgggcggatgtcaaaaaggaccttatcagctatggaggcggttggaaactggagggggaatggaaggagggagaagaggtgcaggttttggctctagaaccaggcaagaatcccagggccgtgcagaccaaacctggcctgtttaagacgaacactgggattatcggagcagtctctctcgatttctccccaggtacctcaggcagtcccataattgacaaaaaggggaaagtggtaggactgtacggcaacggtgtcgtgacacgtagcggggcctatgtttccgctatcgcccaaaccgagaagtctattgaggataatcctgaaatcgaggacgatatatttcgcaagcggagacttacaattatggacttacacccgggagcaggcaaaactaagaggtacctgcccgctatcgtgcgagaagccatcaaacggggcctccgcaccttgattctggcgccaacgagagtcgtggccgcagagatggaagaggctctcagggggctgcctatccggtatcagacacccgccattcgagctgagcatactggaagagaaatagttgaccttatgtgtcacgcaaccttcacaatgcgcctgttgtcgccagtgagggtccctaactacaatctaatcattatggatgaggcccatttcaccgaccccgccagcatcgctgcgcgtggttatatctcaactcgggtggaaatgggcgaggcagccgggatttttatgaccgctacaccaccgggatccagagatcctttcccccagagtaacgccccaataatcgacgaggaaagggagattcccgaacgctcttggaatagcggccacgagtgggtaacggattttaagggtaaaactgtgtggttcgttccttccatcaaggcagggaacgacattgccgcttgcctgcgaaagaatggcaagaaggtcatccaactctcaagaaaaacctttgattctgaatacgtgaagacacggaccaacgactgggatttcgtggtcactacagacataagcgagatgggcgcgaattttaaagccgagagggtaatcgatccacgccgttgtatgaagcccgtgattttaaccgacggcgaagagagagttatcctggcagggcctatgccggtgacgcatagttccgctgcccagcggaggggacgcattggtcgaaaccccaaaaatgaaaacgaccagtacatctatatgggcgagccccttgaaaatgatgaggactgcgcacactggaaggaggccaagatgctgctcgataacataaatactcctgaagggattatccccagcatgttcgagccagaaagagagaaagtcgacgctattgatggagaataccggttgaggggcgaggcccgcaagacatttgtggacctgatgagaaggggtgatctccctgtttggctggcgtataaagtggcagccgaggggatcaactacgctgaccggcgttggtgtttcgatggcataaagaacaatcagatccttgaagagaacgtcgaagtggagatttggaccaaagagggagaacgcaagaagctaaaaccccgatggctggacgccagaatctattctgatccattggctttaaaggagtttaaagagttcgcagccggcaggaagtcactgaccctcaatctgattactgagatggggcggcttcctacattcatgacccagaaaactcgcgacgctctggataacctcgccgtattgcacactgcagaagcgggaggtagagcctacaatcatgctctgtccgagctaccggagacgctggaaaccctccttctgttaacattgctggccactgtgaccggcgggatctttctcttcctgatgagtggaaggggcataggtaagatgacacttgggatgtgctgcattatcaccgcaagcatcctgctctggtatgctcaaattcagccccactggatcgccgcatcgataattttggagtttttcctgatcgttttactaattccagaacctgagaagcagcggactccccaagacaaccagctgacgtacgtcgtgatcgccatactcaccgtggtcgctgcgacaatggccaatgaaatgggctttcttgagaaaactaagaaagacctgggattgggctctatcgcaacccagcagccagagtccaacattctggatatcgacctccgacctgctagcgcctggacactgtacgccgttgcaaccactttcgtgacacccatgcttagacattcaattgaaaatagttctgtaaacgtgtccctcacggctatcgccaatcaagcgaccgtcctgatggggttgggaaagggttggccgctgagcaaaatggatattggcgtgccattactagctatcgggtgttattcacaggttaaccctataactctgacagccgcactccttctgttggtggcccactacgctattatcggacccggcctgcaggcaaaggccacccgcgaggcgcagaagagggctgccgcaggtatcatgaaaaatccaaccgtcgacgggattacagtaatagatctcgaccccatcccttatgatccgaagtttgaaaaacaactgggccaggtgatgcttttaattctgtgcgttactcaggtgctcatgatgcggacgacctgggccttgtgtgaggctctgacactagccactggacccatcagtaccctgtgggaaggcaacccagggcgtttctggaatacaaccattgcagtcagcatggctaacatctttagaggatcctacctcgccggcgcgggtcttctgttctctataatgaagaatactacgaacacaaggcgcgggaccggaaacatcggcgagactttgggtgagaaatggaaaagccggctgaatgccctcggcaaatccgaatttcaaatttataagaagtcagggatccaggaggtggaccgaaccctggcaaaagaaggaattaagagaggcgagacagatcaccatgctgtctctagggggagtgccaaattacgctggttcgtggagcggaacatggttactcctgaaggaaaggtggtagaccttggctgcggtagagggggatggtcgtactattgtggcggtctgaaaaatgtgcgtgaggtcaagggcctcaccaaagggggacccggccacgaagaacctatcccaatgagcacatacgggtggaacctagttaggctgcagtccggagtggatgtctttttcataccccctgaaaaatgcgacacgttgctgtgtgatattggcgagtcttcaccaaatcccaccgtggaggcaggtcggactctccgcgtacttaacctggtggaaaattggttgaacaataacacacagttctgcatcaaggttctgaatccgtacatgcctagcgtgatcgagaaaatggaagctctccaacgaaagtatgggggagccttagtcagaaacccactgtccaggaatagtacccatgagatgtactgggtgtctaacgccagcggcaatattgtctcatccgtgaacatgataagtcggatgcttatcaaccgctttactatgagacacaaaaaggcgacatatgaacccgacgttgacctgggcagcgggaccaggaatattggaatcgagtctgagattcctaacctagatatcataggtaagcgaatcgagaaaattaagcaggagcatgaaacgtcctggcactacgaccaggatcacccatataaaacctgggcttaccatggctcatatgagacaaagcagactgggagcgcatcgtctatggtaaatggagtggtccggctcctgaccaaaccctgggacgtgttgccgacagttactcaaatggccatgaccgatacaacccctttcggccagcagcgtgtgtttaaggaaaaggtcgacactagaacgcaggagcccaaagagggtacaaagaaactgatgaagatcaccgctgaatggctctggaaagagcttgggaagaaaaagactccacgcatgtgtaccagggaagagttcacacggaaggtgagaagtaacgccgcactgggagccatttttacggatgagaataaatggaagtccgctcgcgaagcggtagaggacagcaggttctgggaattagtggataaagagcgaaacctgcacttggaaggcaagtgcgagacctgtgtttacaatatgatgggcaaacgggagaagaagctcggggaatttggaaaagccaagggttcaagagcaatctggtacatgtggctgggcgctaggttcctagagtttgaagcccttgggttcctgaacgaggaccattggttttcccgcgaaaattctctcagcggagtcgagggcgagggtctgcacaaattggggtatattctgcgtgatgtgagtaagaaagaaggaggcgcaatgtacgccgacgacactgctggctgggatacacggataaccctcgaggaccttaagaacgaagagatggtgactaatcacatggaaggggagcataagaaactggccgaggcgatcttcaagttaacatatcaaaacaaagtcgttagagtgcagaggcctaccccacgcggaacagtaatggatattatctcccgacgggaccagagaggtagcggccaagtggggacttacggactgaatacctttacgaacatggaagcacagttgatcaggcagatggagggcgaaggtgtcttcaagaatattcagcacctcaccgtgacagaggaggttgccgtgcataactggctggctcgcgtcgggagagaacggctatctaggatggccatatcaggagatgactgcgtggtaaaaccacttgatgaccgtttcgcaaacgctctgactgccctcaatgatatgggcaagatccgaaaggacattcaacagtgggagcccagtaaaggctggaacgattggacccaggttcctttttgctcccaccatttccacgaactgatcatgaaggacgggcgcgtgttggtcgtgccatgtagaaatcaggatgagttaattggacgggctaggatcagccaaggtgccggctggtctctgcgcgaaacagcatgcctcgggaaatcgtatgcgcagatgtggtcacttatgtactttcacagacgggacctgaggctagccgctaacgccatatgtagcgcagtgccgtcccattgggtccccacaagtcgaaccacgtggtctatccacgctaagcatgagtggatgacaaccgaggacatgctgactgtttggaatcgtgtgtggattagagaaaacccttggatggaggataaaacaccagtagaaagctgggaggaaatcccctatctcggaaagcgcgaggaccagtggtgcggctccttgattggtctgacctcacgggccacttgggcaaagaatatccaggccgcgataaaccaagtgaggagtcttattgggaatgaggaatacaccgattacatgccttctatgaaaagattccgccgggaggaagaggaagctggagtcctgtggtga

SEQ ID NO: 14886 - RNA, 9876 nt, synthetic construct
  misc_feature 1..9876: note = derived and/or modified CDS sequence (opt3) from DENV-2__EU482473__SS-prME
  source 1..9876: mol_type = other RNA
agcgccggcatgatcattatgctgatacccaccgtgatggctttccacctcacaactagaaacggggagcctcatatgatcgtcggaattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagagcaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccaattaaagctgaattggttcaagaaagggtcttccattggacagatgtttgaaacgaccatgcggggtgccaagcgaatggctatactaggcgatacagcctgggacttcgggtcactcggaggcgtatttactagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacaatataaatttcagcccgagagtccaagcaagttggcctccgctatccagaaagcccaggaagagggcatatgtggtattagatctgtcactaggctcgagaatctgatgtggaagcaaatcacacccgaattaaaccacattctggcagagaatgaagttaaactaaccatcatgactggcgatataaaggggatcatgcaggccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaagacgcgttttgtgactctaagttaatgagcgctgccattaaggataatagggcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatcccaaaaaacctcgcaggacccgttagtcagcacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaagctcattaccgagtggtgctgtagatcctgcacactgccgcctcttaggtatcgcggagaggacggctgttggtacggtatggaaatacggccattgaaagagaaggaagagaatctggtgaactcattagttacggcggggcacggacaagtggataatttcagtctcggcgtactgggtatggccctttttctggaagagatgttgagaaccagggtcggcactaaacatgctatcctcctggtggcagtgagcttcgtcacactaattaccgggaacatgtcgtttaaggacctgggacgcgttgtggtaatggtgggcgccactatggctgatgacatcgggatgggagtcacatatctcgccctgcttgcagcgttcaaagtgcgacccacctttgccgctggcttgctgttacggaagctcacgtccaaggagctgatgatgactaccattggtatcgttcttctgtctcagagcacaatacctgaaaccgtgctagagctcactgatgccctggcattggggatgatggtcctgaaaatcgtgcgtaatatggaaaagtaccagttagctgttacaattatggccatcctctgcgtgcccaacgcagtcattctgcagaatgcctggaaagtatcatgtaccatccttgctgtggttagtgtgtccccactgttgctcacatctagccaacagaagactgactggatacctctggcgctaaccattaaaggactgaaccccacggccatcttccttacaaccctctccagaactaataagaaaaggtcatggccactgaacgaggcaatcatggctgtcggcatggtgagcattttggccagttctctgttaaagaatgacataccgatgaccggccctctcgtagccgggggactgcttacagtgtgctatgtcctgactggtcgctccgctgatttggaactcgagcgggcaaccgacgttaagtgggaggatcaggccgaaatcagcggctcgtcacccattctgtctatcacgattagtgaggacgggtccatgagcatcaaaaacgaagaggaggaacagacactaaccatactgatcagaactggacttctcgtgatttctggcctgtttccaatcagcattcccatcacagcggctgcctggtacttgtgggaggtgaagaaacaaagggcaggtgtcttatgggatgtgccttccccaccccctatggggaaggccgaactggaggacggagcttatcgaataaaacagaagggcattctcggctactcacagatcggggcaggagtttacaaggaaggtaccttccacactatgtggcatgtaacacgcggcgccgtgctgatgcacaaagggaagcggatcgagccgagttgggcggatgtcaaaaaggaccttattagctatggaggcggttggaaactggagggggaatggaaggagggagaagaggtgcaggttttggctctagaaccaggcaagaatcccagagccgtgcaaaccaaacctggcctgtttaagacgaacactgggaccatcggagcagtctctctcgatttctccccaggtacatcaggcagtcccataattgacaggaaagggaaggtggtaggactgtacggcaacggtgtcgtgacccgtagcggggcctatgtttccgctatcgcccagacagagaaatctattgaggataatcctgaaatcgaggacgatatatttcgcaagcggagacttactattatggacttacacccgggagcaggcaagaccaaaaggtacctgcccgctatcgtgcgagaagccatcaagcggggcctccgcacgttgattctggcgccaacaagagtcgtggccgcagagatggaagaggctctcagggggctgcctatccggtatcagactcccgccattcgagctgagcataccggaagagaaatagttgaccttatgtgtcacgcaacattcaccatgcgcctgttgtcgccagtgagggtccctaactacaatctaatcattatggatgaggcccatttcactgaccccgccagcatcgctgcgcgtggttatatctcaacccgggtggaaatgggcgaggcagccgggatttttatgacagctacgccaccgggatccagagatcctttcccccaaagtaacgccccaataatcgacgaggaaagggagattcccgaacgctcttggaatagcggccacgagtgggtaactgattttaaaggtaagaccgtgtggttcgttccttccatcaaagcagggaacgacattgccgcttgcctgcgaaagaatggaaagaaagtcatccagctctcaagaaagacatttgattctgaatacgtgaaaacccggactaacgactgggatttcgtggtcacaaccgacataagcgagatgggcgcgaattttaaggccgagagggtaatcgatccacgccgttgtatgaaacccgtgattttaacggacggcgaagagagagttatcctggcagggcctatgccggtgactcatagttccgctgcccagcggaggggacgcattggtcgaaacccaaagaatgaaaacgaccagtacatctatatgggcgagccccttgaaaatgatgaggactgcgcacactggaaagaggccaagatgctgctcgataacataaatacacctgaagggattatccccagcatgttcgagccagaaagagagaaggtcgacgctattgatggagaataccggttgaggggcgaggcccgcaaaacctttgtggacctgatgagaaggggtgatctccctgtttggctggcgtataaggtggcagccgaggggatcaactacgctgaccggcgttggtgtttcgatggcataaaaaacaatcaaatccttgaagagaacgtcgaagtggagatttggaccaaggagggagaacgcaaaaagctaaagccccgatggctggacgccagaatctattctgatccattggctttaaaagagtttaaggaattcgcagccggcaggaaatcactgactctcaatctgattacagagatggggcggcttcctaccttcatgacacagaagactcgcgacgctctggataacctcgccgtattgcacacggcagaagcgggaggtagagcctacaatcatgctctgtccgagctaccggagaccctggaaacactccttctgttaactttgctggccaccgtgacaggcgggatctttctcttcctgatgagtggaaggggcataggtaaaatgacccttgggatgtgctgcattatcactgcaagcatcctgctctggtatgctcagattcagccccactggatcgccgcatcgataattttggagtttttcctgatcgttttactaattccagaacctgagaagcaacggacgccccaggacaaccagctgacctacgtcgtgatcgccatactcacagtggtcgctgcgactatggccaatgaaatgggctttcttgagaagaccaaaaaggacctgggattgggctctatcgcaacacagcaaccagagtccaacattctggatatcgacctccgacctgctagcgcctggaccctgtacgccgttgcaactacattcgtgacgcccatgcttagacattcaattgaaaatagttctgtaaacgtgtccctcaccgctatcgccaatcaggcgactgtcctgatggggttgggaaaaggttggccgctgagcaagatggatattggcgtgccattactagctatcgggtgttattcacaggttaaccctataacactgaccgccgcactccttctgttggtggcccactacgctattatcggacccggcctgcaggcaaaagccacccgcgaggcgcaaaagagggctgccgcaggtatcatgaagaatccaacagtcgacgggattactgtaatagatctcgaccccatcccttatgatccgaaatttgaaaagcagctgggccaggtgatgcttttaattctgtgcgttacgcaagtgctcatgatgcggaccacatgggccttgtgtgaggctctgactctagccaccggacccatcagtacactgtgggaaggcaacccagggcgtttctggaataccactattgcagtcagcatggctaacatctttagaggatcctacctcgccggcgcgggtcttctgttctctataatgaaaaatacgacaaacaccaggcgcgggactggaaacatgggcgagaccttgggtgagaagtggaaaagccggctgaatgccctcggcaagtccgaatttcagatctataaaaagtcagggattcaggaggtggaccgaacactggcaaaggaaggaatcaaaagaggcgagactgatcaccatgctgtctctagggggagtgccaagttacgctggttcgtggagcggaacatggttacccctgaaggaaaagtggtagaccttggctgcggtagagggggatggtcgtactattgtggcggtctgaagaatgtgcgtgaggtcaaaggcctcacaaaggggggacccggccacgaagagcctattccaatgagcacgtacgggtggaacctagttaggctgcagtccggagtggatgtctttttcatcccccctgaaaagtgcgacaccttgctgtgtgatataggcgagtcttcaccaaatcccactgtggaggcaggtcggacactccgcgtacttaacctggtggaaaattggttgaacaataacacccaattctgcattaaagttctgaatccgtacatgcctagcgtgatcgagaagatggaagctctccagcgaaaatatgggggagccttagtcagaaacccactgtccaggaatagtactcatgagatgtactgggtgtctaacgccagcggcaatatcgtctcatccgtgaacatgattagtcggatgcttataaaccgctttacaatgagacacaagaaagcgacctatgaacccgacgttgacctgggcagcgggacgaggaatatcggaattgagtctgagacccctaacctagatatcattggtaagcgaatcgaaaagataaaacaggagcatgaaacatcctggcactacgaccaggatcacccatataagacttgggcttaccatggctcatatgagaccaaacaaacagggagcgcatcgtctatggtaaatggagtggtccggctcctgactaagccctgggacgtgttgccgaccgttacacagatggccatgaccgatactacgcctttcggccagcagcgtgtgtttaaagaaaaggtcgacacaagaacccaagagcccaaggagggtactaaaaagctgatgaaaatcaccgctgaatggctctggaaggagcttgggaaaaagaaaacaccacgcatgtgtacgagggaagagttcacccggaaggtgagaagtaacgccgcactgggagccatttttactgatgagaataagtggaaatccgctcgcgaagcggtagaggacagcaggttctgggaattagtggataaggagcgaaacctgcacttggaaggcaaatgcgagacatgtgtttacaatatgatgggcaagcgggagaaaaagctcggggaatttggaaaggccaaaggttcaagagcaatctggtacatgtggctgggcgctaggttcctagagtttgaagcccttgggttcctgaacgaggaccattggttttcccgcgaaaattctctcagcggagtcgagggcgagggtctgcacaagttggggtatattctgcgtgatgtgagtaaaaaggaaggaggcgcaatgtacgccgacgacaccgctggctgggatactcggatcacactcgaggaccttaaaaacgaagagatggtgaccaatcacatggaaggggagcataagaagctggccgaggcgattttcaaattaacatatcagaacaaggtcgttagagtgcagaggcctactccccgcggaaccgtaatggatataatctcccgacgggaccaaagaggtagcggccaggtggggacgtacggactgaatacctttacaaacatggaagcacagttgattaggcagatggagggcgaaggtgtcttcaaaaatatccaacacctcactgtgaccgaggaggttgccgtgcagaactggctggctcgcgtcgggagagaacggctatctaggatggccatctcaggagatgactgcgtggtaaagccacttgatgaccgtttcgcaaacgctctgacagccctcaatgatatgggcaaaattcgaaaggacatacagcagtgggagcccagtaagggctggaacgattggactcaagttcctttttgctcccatcacttccatgaactgatcatgaaagacgggcgcgtgttggtcgtgccatgtagaaatcaggatgagttaattggacgggctaggatcagccagggtgccggctggtctctgcgcgaaaccgcatgcctcgggaagtcgtatgcgcagatgtggtcacttatgtactttcacagacgggacctgaggctagccgctaacgccatttgtagcgcagtgccgtcccactgggtccccacgagtcgaacaacctggtctatccatgctaaacacgagtggatgactacagaggacatgctgaccgtttggaatcgtgtgtggataagagaaaacccttggatggaggataagactccagtagaaagctgggaggaaatcccctatctcggaaaacgcgaggaccaatggtgcggctccttgattggtctgacctcacgggccacatgggcaaagaatatccaggtggccattaaccaggtcaggagtcttatcgggaatgaggaatacacggattacatgccttctatgaagagattccgccgggaggaagaggaagcgggagtgctgtggtga

SEQ ID NO: 14887 - RNA, 9876 nt, synthetic construct
  misc_feature 1..9876: note = derived and/or modified CDS sequence (opt3) from DENV-2__EU482474__SS-prME
  source 1..9876: mol_type = other RNA
agcgcaggaatgataattatgctgataccaaccgtgatggctttccacctcactactagaaacggggaacctcatatgatcgtaggtattcaagaaaagggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccacatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctatcaacattgaagctgagcccccatttggcgactcgtacatcatcattggagttgagcctggccagttaaagctgaattggttcaaaaaggggtcttccataggacaaatgtttgaaacgaccatgcggggtgccaaacgaatggctatcctaggcgatacagcctgggacttcgggtcactcggaggcgtgtttacaagtattggtaaggcactgcatcaggtattcggggccatctatggcgctgcgtttagcggagtctcctggaccatgaaaattcttatcggcgtgataatcacatggattgggatgaactctcgcagcacttcattgagtgtttccctggtgctcgtcggaatcgtgaccctgtaccttggcgtaatggtgcaggcagatagcggttgtgttgtctcttggaagaataaggagctgaaatgcgggtcaggaattttcatcacggacaacgtgcacacatggaccgaacagtataagtttcaacccgagagtccaagcaaattggcctccgctatacagaaggcccaggaagagggcatttgtggtatcagatctgtgactaggctcgagaatctgatgtggaaacagattacacccgaattaaaccacatcctggcagagaatgaagtcaagctaaccataatgactggcgatatcaaagggattatgcaagccggaaagcggtcgctccgccctcagccaaccgagctgaagtacagctggaaaacatggggcaaggctaaaatgctttccacggaatcacataaccagaccttcttgatcgacgggccggagactgccgagtgccccaatacaaacagagcatggaatagtctggaagttgaggattatggatttggcgtgttcaccacaaacatttggctcaggctgaaggaaaaacaggacgcgttttgtgactctaagttaatgagcgctgccatcaaggataatcgtgcagtgcacgccgacatgggttactggatagagtccgctctgaacgatacttggaaaattgagaaggcctcattcatcgaagtcaagaattgccattggcctaagagccacaccctttggtctaacggggtcttggagtccgaaatgatcattcccaagaacctcgcaggacccgtgagtcaacacaattatcggcctggctaccatacgcagatcgctggtccatggcacctgggcaagctagagatggacttcgatttttgtgacgggacaaccgttattgtgactgaagattgcggaaaccgaggccccagcctgagaaccacaactgcctctgggaagctcataaccgagtggtgctgtaggtcctgcacactgccgcctcttcgctaccggggagaggacggctgttggtatggtatggaaatcagaccattgaaagagaaggaagagaatctggtcaactcattagtgacggcggggcatggacaggttgataatttcagtctcggcgtgctgggtatggccctttttctggaagagatgttgaggacccgcgtaggcactaaacacgctattctcctggtcgcagtgagcttcgtgacactaatcaccgggaacatgtcgtttaaggacctgggacgagtcgttgtgatggtaggcgccactatggctgatgacattgggatgggagtgacatacctcgccctgcttgcagcgttcaaagtccggcccacctttgccgctggcttgctgttacgtaagctcacgtccaaggagctgatgatgactaccatcggtatagtgcttctgtctcaaagcacaatccctgaaaccgttctagagctcactgatgccctggcattggggatgatggtgctgaaaattgtcagaaatatggaaaagtatcagttagctgtgacaatcatggccattctctgcgttcccaacgcagtgatcctgcagaatgcctggaaagtctcatgtaccatacttgctgtagtgagtgtttccccactgttgctcacatctagccagcaaaagactgactggattcctctggcgctaaccatcaaaggactgaaccccacggccatcttccttacaaccctctccaggactaataagaaacgctcatggccactgaacgaggcaattatggctgtgggcatggtcagcatattggccagttctctgttaaagaatgacatcccgatgaccggccctctcgtggccgggggactgcttacagtatgctacgtgctgactggtcggtccgctgatttggaactcgagagagcaaccgacgtcaagtgggaggatcaggccgaaattagcggctcgtcacccatcctgtctattacgatcagtgaggacgggtccatgagcatcaaaaacgaagaggaggaacagacactaaccatcctgattaggactggacttctcgttatctctggcctgtttccaattagcatccccataacagcggctgcctggtatttgtgggaggtgaagaaacagcgagccggtgtgttatgggatgtcccttccccaccccctatggggaaggccgaactggaggacggagcttaccgcattaaacaaaagggcatcctcggctattcacagatcggggcaggagtgtacaaggaaggtaccttccatactatgtggcacgttacacggggcgccgtactgatgcacaaagggaagagaattgagccgagttgggcggatgtgaaaaaggaccttatcagctacggaggcggttggaaactggagggggaatggaaggagggagaagaggtccaggtgttggctctagaaccaggcaagaatcccagggccgttcagaccaaacctggcctgtttaagacgaacactgggaccataggagcagtgtctctcgatttctccccaggtacatcaggcagtcccattatcgacaaaaaggggaaagtcgtgggactgtatggcaacggtgtagtcacccgtagcggggcctacgtgtccgctattgcccaaacagagaagtctatcgaggataatcctgaaatagaggacgatatttttcgcaagcggagacttactatcatggacttacatccgggagcaggcaaaaccaagaggtatctgcccgctatcgttcgagaagccattaaacggggcctccgcacgttgatcctggcgccaacaagagtggtcgccgcagagatggaagaggctctcagggggctgcctattcggtaccagactcccgccatacgagctgagcacaccggaagagaaatcgtggaccttatgtgtcatgcaacattcaccatgcgcctgttgtcgccagttagggtgcctaactataatctaattatcatggatgaggcccacttcactgaccccgccagcatcgctgcgcgtggttacatttcaacccgggtcgaaatgggcgaggcagccgggatatttatgacagctacgccaccgggatccagagatcctttcccccagagtaacgccccaatcattgacgaggaaagggagatccccgaacgctcttggaatagcggccatgagtgggtgactgattttaagggtaaaaccgtatggttcgtgccttccattaaggcagggaacgacatcgccgcttgcctgcgaaagaatggcaaaaaggttatacaactctcaagaaaaacatttgattctgaatatgtcaagacccggactaacgactgggatttcgtggtgacaaccgacatcagcgagatgggcgcgaattttaaagccgagagggtcattgatccacgccgttgtatgaagcccgtaatcttaacggacggcgaagagagagtgattctggcagggcctatgccggttactcacagttccgctgcccagcggaggggacgcatcggtcgaaaccccaaaaatgaaaacgaccagtacatatacatgggcgagccccttgaaaatgatgaggactgcgcacactggaaggaggccaagatgctgctcgataacattaatacacctgaagggatcattcccagcatgttcgagccagaaagagagaaagtggacgctgtcgatggagaatatcggttgaggggcgaggcccgcaagacctttgtggacctgatgagaaggggtgatctccctgtttggctggcgtacaaagtggcagccgaggggatcaactatgctgaccggcgttggtgtttcgatggcataaagaacaatcagatccttgaagagaacgtcgaagtggagatttggaccaaagagggagaacgcaagaagctaaaaccccgatggctggacgccagaatctactctgatccattggctttaaaggagtttaaagagttcgcagccggcaggaagtcactgactctcaatctgattacagagatggggcggcttcctaccttcatgacacagaaaactcgcgacgctctggataacctcgccgtattgcatacggcagaagcgggaggtagagcctataatcacgctctgtccgagctaccggagaccctggaaacactccttctgttaactttgctggccaccgtgacaggcgggatctttctcttcctgatgagtggaaggggcataggtaagatgacccttgggatgtgctgcattgttactgcaagcatcctgctctggtacgctcagatccagccccattggattgccgcatcgatcatattggagtttttcctgattgtcttactaatcccagaacctgagaagcagcggacgccccaagacaaccagctgacctatgtggtgattgccatcctcacagtcgttgctgcgactatggccaatgaaatgggctttcttgagaaaaccaagaaagacctgggattgggctctatagcaacacagcagccagagtccaacatcctggatattgacctccgacctgctagcgcctggaccctgtacgccgtggcaactacattcgtaacgcccatgcttagacactcaatcgaaaatagttctgtgaacgtctccctcaccgctattgccaatcaagcgactgtgctgatggggttgggaaagggttggccgctgagcaaaatggatatcggcgttccattactagctattgggtgttactcacaggtgaaccctatcacactgaccgccgcactccttctgttggtcgcccactatgctataattggacccggcctgcaggcaaaggccacccgcgaggcgcagaagagggctgccgcaggtatcatgaaaaatccaacagtagacgggatcactgtgattgatctcgaccccataccttacgatccgaagtttgaaaaacaactgggccaggttatgcttttaatcctgtgcgtgacgcaggtcctcatgatgcggaccacatgggccttgtgtgaggctctgactctagccaccggacccattagtacactgtgggaaggcaacccagggcgtttctggaataccactatcgcagtgagcatggctaacatttttagaggatcctatctcgccggcgcgggtcttctgttctctatcatgaagaatacgacaaacaccaggcgcgggactggaaacatgggcgagaccttgggtgagaaatggaaaagccggctgaatgccctcggcaaatccgaatttcaaatatacaagaagtcagggatccaggaggtcgaccgaacactggcaaaagaaggaattaagagaggcgagactgatcatcacgctgtgtctagggggagtgccaaattacgctggttcgttgagcggaacatggtgacccctgaaggaaaggtagtggaccttggctgcggtagagggggatggtcgtattactgtggcggtctgaaaaatgtccgtgaggttaagggcctcacaaaagggggacccggccatgaagaacctatcccaatgagcacgtatgggtggaacctagtgaggctgcagtccggagtcgatgtgtttttcattccccctgaaaaatgcgacaccttgctgtgtgatatcggcgagtcttcaccaaatcccactgtagaggcaggtcggacactccgcgtgcttaacctggttgaaaattggttgaacaataacacccagttctgcataaaggtgctgaatccgtacatgcctagcgtcattgagaaaatggaagctctccaacgaaagtacgggggagccttagtgagaaacccactgtccaggaatagtactcacgagatgtattgggtctctaacgccagcggcaatatcgtgtcatccgttaacatgatcagtcggatgcttattaaccgctttacaatgagacataaaaaggcgacctacgaacccgacgtagacctgggcagcgggacgaggaatataggaatcgagtctgagattcctaacctagatatcattggtaagcgaatcgagaaaataaagcaggagcacgaaacctcctggcactatgaccaggatcatccatacaaaacatgggcttatcacggctcatacgagactaagcagaccgggagcgcatcgtctatggtgaatggagtcgtgcggctcctgacaaaaccctgggacgttttgccgactgtgacccaaatggccatgacagataccactcctttcggccagcagcgtgtctttaaggaaaaggtggacacgagaacacaggagcccaaagagggtaccaagaaactgatgaagatcactgctgaatggctctggaaagagcttgggaagaaaaagaccccacgcatgtgtacaagggaagagttcacgcggaaggtaagaagtaacgccgcactgggagccatttttaccgatgagaataaatggaagtccgctcgcgaagcggtggaggacagcaggttctgggaattagttgataaagagcgaaacctgcatttggaaggcaagtgcgagacttgtgtctataatatgatgggcaaacgggagaagaagctcggggaatttggaaaagccaagggttcaagagcaatctggtacatgtggctgggcgctaggttcctagagtttgaagcccttgggttcctgaacgaggaccactggttttcccgcgaaaattctctcagcggagtggagggcgagggtctgcacaaattggggtacattctgcgtgatgtgagtaagaaagaaggaggcgcaatgtatgccgacgacacagctggctgggatacccggatcactctcgaggaccttaagaacgaagagatggtcacaaatcatatggaaggggagcacaagaaactggccgaggcgattttcaagttaacctaccaaaacaaagttgtgagagtacagaggcctacaccccgcggaactgtgatggatataatctcccgacgggaccagagaggtagcggccaagtcgggacctatggactgaatacgtttaccaacatggaagcacagttgattaggcagatggagggcgaaggtgtgttcaagaatatccagcatctcacagttactgaggaggtggccgtccaaaactggctggctcgcgtggggagagaacggctatctaggatggccatctcaggagatgactgcgtagttaaaccacttgatgaccgtttcgcaaacgctctgaccgccctcaatgatatgggcaagattcgaaaggacatacagcagtgggagcccagtaaaggctggaacgattggacacaggtgcctttttgctcccaccatttccacgaactgatcatgaaggacgggcgcgtcttggtggtgccatgtagaaatcaagatgagttaattggacgggctaggatcagccagggtgccggctggtctctgcgcgaaactgcatgcctcgggaaatcgtacgcgcagatgtggtcacttatgtattttcacagacgggacctgaggctagccgctaacgccatttgtagcgcagtcccgtcccattgggttcccaccagtcgaacgacatggtctatccacgctaagcatgagtggatgaccactgaggacatgctgacagtgtggaatcgtgtatggataagagaaaacccttggatggaggataaaaccccagtggaaagctgggaggaaatcccctacctcggaaagcgcgaggaccagtggtgcggctccttgattggtctgacttcacgggccacctgggcaaagaatatccaagccgcgattaaccaggtcaggagtcttatcgggaatgaggaatatacagattacatgccttctatgaaaagattccgccgggaggaagaggaagctggagtgctgtggtga

SEQ ID NO: 14888 - RNA, 9876 nt, synthetic construct
  misc_feature 1..9876: note = derived and/or modified CDS sequence (opt3) from DENV-2__EU482475__SS-prME
  source 1..9876: mol_type = other RNA
agcgcaggcatgatcattatgctgatacccaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactgccgagtgccccaatacaaacagagcatggaatagtctggaagtggaggattacggatttggcgtgttcaccacaaacatctggctcaagctgaaagaaaagcaggacgcgttttgtgactctaagttaatgagcgctgccattaaagataatagggcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaaactcattaccgagtggtgctgtagatcctgcacactgccgcctcttaggtatcgcggagaggacggctgttggtacggtatggaaatacggccattgaaggagaaagaagagaatctggtgaactcattagttacggcggggcacggacaggtggataatttcagtctcggcgtactgggtatggccctttttctggaagagatgttgagaaccagggtcggcactaagcatgctatcctcctggtggcagtgagcttcgtcacactaattaccgggaacatgtcgtttaaagacctgggacgcgttgtggtaatggtgggcgccactatggctgatgacatcgggatgggagtcacatatctcgccctgcttgcagcgttcaaggtgcgacccacctttgccgctggcttgctgttacggaagctcacgtccaaagagctgatgatgactaccattggtatcgttcttctgtctcaaagcacaatacctgaaaccgtgctagagctcactgatgccctggcattggggatgatggtcctgaagatcgtgcgtaatatggaaaaataccagttagctgttacaattatggccatcctctgcgtgcccaacgcagtcattctgcagaatgcctggaaggtatcatgtaccatccttgctgtggttagtgtgtccccactgttgctcacatctagccagcagaagactgactggatacctctggcgctaaccattaagggactgaaccccacggccatcttccttacaaccctctccagaactaataaaaagaggtcatggccactgaacgaggcaatcatggctgtcggcatggtgagcattttggccagttctctgttaaagaatgacataccgatgaccggccctctcgtagccgggggactgcttacagtgtgctatgtcctgactggtcgctccgctgatttggaactcgagcgggcaaccgacgttaaatgggaggatcaggccgaaatcagcggctcgtcacccattctgtctatcacgattagtgaggacgggtccatgagcatcaagaacgaagaggaggaacagacactaaccatactgatcagaactggacttctcgtgatttctggcctgtttccaatcagcattcccatcacagcggctgcctggtacttgtgggaggtgaaaaagcagagggccggtgtcttatgggatgtgccttccccaccccctatggggaaagccgaactggaggacggagcttatcgaataaagcaaaagggcattctcggctactcacagatcggggcaggagtttacaaagaaggtaccttccacactatgtggcatgtaacacgcggcgccgtgctgatgcacaaggggaaacggatcgagccgagttgggcggatgtcaagaaagaccttattagctatggaggcggttggaagctggagggggaatggaaggagggagaagaggtgcaggttttggctctagaaccaggcaaaaatcccagagccgtgcagaccaagcctggcctgtttaaaacgaacactgggaccatcggagcagtctctctcgatttctccccaggtacatcaggcagtcccataattgacaagaaagggaaggtggtaggactgtacggcaacggtgtcgtgaccaggagcggggcctatgtttccgctatcgcccaaacagagaagtctattgaggataatcctgaaatcgaggacgatatatttcgtaaacgccggcttactattatggacttacacccgggagcaggcaagaccaaaagatacctgcccgctatcgtgagggaagccatcaagcgaggcctccggacgttgattctggcgccaacacgcgtcgtggccgcagagatggaagaggctctcagagggctgcctatcaggtatcagactcccgccattcgggctgagcataccggacgagaaatagttgaccttatgtgtcacgcaacattcaccatgagactgttgtcgccagtgcgcgtccctaactacaatctaatcattatggatgaggcccatttcactgaccccgccagcatcgctgcgaggggttatatctcaacccgtgtggaaatgggcgaggcagccgggatttttatgacagctacgccaccgggatcccgggatcctttcccccagagtaacgccccaataatcgacgaggaaagagagattcccgaaaggtcttggaatagcggccacgagtgggtaactgattttaaaggtaagaccgtgtggttcgttccttccatcaaggcagggaacgacattgccgcttgcctgcgcaaaaatggaaagaaagtcatccaactctcacgaaagacatttgattctgaatacgtgaaaaccagaactaacgactgggatttcgtggtcacaaccgacataagcgagatgggcgcgaattttaaggccgagcgggtaatcgatccaaggcgctgtatgaaacccgtgattttaacggacggcgaagaacgtgttatcctggcagggcctatgccggtgactcatagttccgctgcccagagacggggaaggattggtcgcaacccaaagaatgaaaacgaccagtacatctatatgggcgagccccttgaaaatgatgaggactgcgcacactggaaggaggccaaaatgctgctcgataacataaatacacctgaagggattatccccagcatgttcgagccagaacgagagaaggtcgacgctattgatggagaatacagattgcggggcgaggccaggaaaacctttgtggacctgatgcgcagaggtgatctccctgtttggctggcgtataaggtggcagccgaggggatcaactacgtcgacaggcggtggtgtttcgatggcatcaaaaacaatcagatccttgaagagaacgtggaagtagagatttggaccaaggagggagaacgtaagaaactaaagccccgctggctggacgctcgaatctattctgatccattggccttaaaagagtttaaggagttcgctgcaggcagaaaatcactgactctcaatctgattacagagatggggaggcttcctaccttcatgacacaaaagactcgggacgccctggataacctcgctgtgttgcacacggccgaagcaggaggtcgcgcgtacaatcatgccctgtccgagctaccggagaccctggaaacactccttctgttaactttgctggctaccgttacaggcgggatctttctcttcctgatgagtggaagaggcataggtaagatgacccttgggatgtgctgcattatcactgccagcatcctgctctggtatgcacagattcagccccactggatcgctgcctcgataattttggagtttttcctgatcgtcttactaattccagaacctgagaaacagaggacgccccaagacaaccagctgacctacgtggtgatcgcaatactcacagtcgttgccgctactatggcgaatgaaatgggctttcttgagaagaccaaaaaggacctgggattgggctctatcgccacacagcagccagagtccaacattctggatatcgacctccggcctgcaagcgcttggaccctgtacgccgtggccactacattcgtaacgcccatgcttcgacattcaattgaaaatagttctgtgaacgtctccctcaccgcaatcgctaatcaagccactgtgctgatggggttgggaaaaggttggccgctgagcaagatggatattggcgttccattactagcgatcgggtgttattcacaggtgaaccctataacactgaccgctgccctccttctgttggtcgcacactacgccattatcggacccggcctgcaggctaaggcaaccagagaggcccagaaacgcgcggctgccggtatcatgaagaatccaacagtagacgggattactgtgatagatctcgaccccatcccttatgatccgaaatttgaaaagcaactgggccaggttatgcttttaattctgtgcgtgacgcaggtcctcatgatgaggaccacatgggcattgtgtgaggccctgactctagctaccggacccatcagtacactgtgggaaggcaacccagggcggttctggaataccactattgccgtgagcatggcaaacatctttcgtggatcctacctcgctggcgccggtcttctgttctctataatgaaaaatacgacaaacaccagaagggggactggaaacatgggcgagaccttgggtgagaagtggaaaagccgcctgaatgcgctcggcaagtccgaatttcaaatctataagcggtcagggattcaggaggtcgaccgaacactggccaaagaaggaatcaagagaggcgagactgatcaccatgcagtgtctagggggagtgctaaattacgctggttcgttgagcggaacatggtgacccctgaaggaaaggtagtggaccttggctgcggtagagggggatggtcgtactattgtggcggtctgaaaaatgtccgtgaggttaagggcctcacaaaagggggacccggccacgaagaacctattccaatgagcacgtacgggtggaacctagtgaggctgcagtccggagtcgatgtgtttttcataccccctgaaaaatgcgacaccttgctgtgtgatataggcgagtcttcaccaaatcccactgtagaggccggtcggacactccgcgtgcttaacctggttgaaaattggttgaacaataacacccagttctgcattaaggtgctgaatccgtacatgcctagcgtcatcgagaaaatggaagcactccaacgaaagtatgggggagctttagtgagaaacccactgtccaggaatagtactcatgagatgtactgggtctctaacgccagcggcaatatcgtgtcatccgttaacatgattagtcggatgcttataaaccgctttacaatgagacacaaaaaggccacctatgaacccgacgtagacctgggcagcgggacgaggaatatcggaattgagtctgagatccctaacctagatattatcggtaagcgaatagagaaaatcaagcaggagcatgaaacctcctggcactacgaccaggatcacccatataaaacatgggcgtaccatggctcatatgagactaagcagaccgggagcgcttcgtctatggtgaatggagtcgtgcggctcctgacaaaaccctgggacgttttgccgactgtgacccaaatggcaatgacagataccactcctttcggccagcagcgtgtctttaaggaaaaggtggacacgagaacacaggagcccaaagagggtaccaagaaactgatgaagattactgccgaatggctctggaaagagcttgggaagaaaaagaccccacgcatgtgtacaagggaagagttcacgcggaaggtaagaagtaacgctgccctgggagcaatctttaccgatgagaataaatggaagtccgcccgcgaagctgtggaggacagcaggttctgggaattagttgataaagagcgaaacctgcacttggaaggcaagtgcgagacttgtgtctacaatatgatgggcaaacgggagaagaagctcggggaatttggaaaagcgaagggttcaagagccatttggtacatgtggctgggcgcaaggttcctagagtttgaagctcttgggttcctgaacgaggaccattggttttcccgcgaaaattctctcagcggagtggagggcgagggtctgcacaaattggggtatatcctgcgtgatgtgagtaagaaagaaggaggcgccatgtacgcagacgacacagccggctgggatacccggattactctcgaggaccttaagaacgaagagatggtcacaaatcacatgaagggggaacataaaaagctggctgaggccatattcaaattaacctatcaaaacaaggttgtgagagtacagaggcctacaccccgcggaactgtgatggatatcatttcccgacgggaccagagaggtagcggccaagtcgggacctacggactgaatacgtttaccaacatggaggcgcagttgatcaggcagatggaaggcgagggtgtgttcaaaaatatccagcacctcacagttactgaagaggtggcagtccaaaactggctggcccgcgtggggagagagcggctatctaggatggctatttcaggagatgactgcgtagttaagccacttgatgaccgtttcgccaacgcactgaccgctctcaatgatatgggcaagatacgaaaagacatccagcagtgggaacccagtaagggctggaacgattggacacaggtgcctttttgctcccatcacttccatgagctgattatgaaagacgggcgcgtcttggtggtgccatgtagaaatcaagatgaattaatcggacgggccaggattagccagggtgctggctggtctctgcgcgagactgcctgcctcgggaagtcgtatgcacagatgtggtcacttatgtactttcacagacgggacctgaggctagcggccaacgctatctgtagcgccgtcccgtcccactgggttcccaccagtcgaacgacatggtctatacatgcaaaacacgaatggatgaccactgaggacatgctgacagtgtggaatcgtgtatggatcagagagaacccttggatggaagataagaccccagtggagagctgggaagagattccctatctcggaaagcgcgaagaccagtggtgcggctccttgatcggtctgacttcacgggctacctgggccaaaaatattcaagcagccatcaaccaggtcaggagtcttatagggaatgaggagtacacagattacatgccttctatgaagagattccgccgggaagaggaagaggcgggagtgctgtggtga

SEQ ID NO: 14889 - RNA, 9876 nt, synthetic construct
  misc_feature 1..9876: note = derived and/or modified CDS sequence (opt3) from DENV-2__EU482541__SS-prME
  source 1..9876: mol_type = other RNA
agcgccggaatgataattatgctgatacccaccgtgatggctttccacctcaccactagaaacggggagcctcatatgatcgtcggcattcaggaaaagggtaaatcccttctgtttaagacggaggacggcgttaatatgtgcaccttgatggcaatggatttaggggaactgtgtgaggacacaatcacttacaaatgcccattactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaatggaaatcaaggtaacgccgcagtcaagtattacagaggctgaactgaccggctatggtactgtgaccatggagtgtagccccagaacagggcttgatttcaatgaaatggtcctgttgcaaatggagaacaaagcctggctcgtgcacaggcagtggtttctggacttacctctgccatggctccccggcgcagataagcaggagtctaattggatccagaaggaaacccttgttactttcaaaaaccctcatgctaagaaacaagacgtggtcgtgctgggatcccaggagggcgccatgcacacagcgttgacgggggccaccgaaatacagatgtcaagcggaaatctactgtttactggtcatctcaagtgccggctgcgtatggacaaacttcaactgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccagttaaagctgaattggttcaagaaagggtcttccattggacaaatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacagtataaatttcaacccgagagtccaagcaagttggcctccgctatccagaaagcccaggaagagggcatatgtggtattagatctgtcactaggctcgagaatctgatgtggaagcagatcacacccgaattaaaccacattctggcagagaatgaagttaaactaaccatcatgactggcgatatacgggggatcatgcaagccggaaagcgctcgctcagacctcagccagctgagctgaaatacagctggaagacctggggcaaggccaaaatgctttccacagaatcatataaccagacgttcttgattgacgggccggagaccgcagagtgccccaatactaacagggcgtggaatagtctggaagtggaggattacggatttggcgtgttcacaaccaacatctggctcaagctgaaagaaaagcaggacgctttttgtgactctaaattaatgagcgccgcaattaaggataatcgtgccgtacatgctgacatgggttattggatcgagtccgccctgaacgatacatggaagatagagaaagcatcattcattgaagtcaagaattgccactggcctaaaagccatactctttggtctaacggggtgttggagtccgaaatgatcatcccaaagaacctcgctggacccgttagtcaacacaattaccggcctggctaccacacccagattgccggtccatggcatctgggcaaactagagatggacttcgatttttgtgacgggacgacagtgatcgtcaccgaagattgcggaaaccgaggccccagcctgagaactaccacagcgtctgggaagctcattactgagtggtgctgtaggtcctgcaccctgccgcctcttcgctatcggggagaggacggctgttggtacggtatggaaataagaccattgaaggagaaagaagagaatctggtgaactcattagttacagccgggcacggacaggtggataatttcagtctcggcgtactgggtatggctctttttctggaagagatgttgaggacgcgcgtcggcaccaagcatgcaatcctcctggtggccgtgagcttcgtcactctaattacagggaacatgtcgtttaaagacctgggacgagttgtggtaatggtgggcgctaccatggccgatgacatcgggatgggagtcacttatctcgcactgcttgcggccttcaaggtgcggcccacatttgctgccggcttgctgttacgtaaactcacctccaaggagctgatgatgacgactattggtatcgttcttctgtctcaaagcaccatacctgaaacagtgctagagctcaccgatgcactggctttggggatgatggtcctgaagatcgtgagaaatatggaaaaataccagttagccgttactattatggcaatcctctgcgtgcccaacgccgtcattctgcagaatgcttggaaggtatcatgtacaatccttgcggtggttagtgtgtccccactgttgctcacctctagccagcaaaagactgactggatacctctggccctaactattaagggactgaaccccaccgcaatcttccttacgacactctccaggaccaataaaaagcgctcatggccactgaacgaggctatcatggccgtcggcatggtgagcattttggccagttctctgctcaaaaatgacataccgatgactggccctctagtagctgggggactgcttaccgtgtgctatgtcctgacaggtcggtccgcagatttggaactcgagagagccactgacgttaagtgggaggatcaggcggaaatcagcggctcgtcacccattctgtctatcaccattagtgaggacgggtccatgagcatcaagaacgaagaggaggaacagacgctaacaatactgatcaggaccggacttctcgtgatttctggcctgtttccaatcagcattcccatcactgctgccgcatggtacttgtgggaggtgaaaaagcagcgagccggtgtcttatgggatgtgccttccccaccccctatggggaaagctgaactggaggacggagcatatcgcataaagcaaaaaggcattctcggctactcacagatcggggccggagtttacaaggaaggtacattccacaccatgtggcatgtaactcggggcgcggtgctgatgcacaaggggaaaagaatcgagccgagttgggctgatgtcaagaaagaccttattagctatggaggcggttggaagctggagggggaatggaaagagggagaagaggtgcaggttttggccctagaaccaggcaagaatcccagggcagtgcagacaaagcctggcctgtttaaaaccaacacggggactatcggagccgtctctctcgatttctccccaggtacctcaggcagtcccataattgacaagaaagggaaggtggtaggactgtacggcaacggtgtcgtgacacgtagcggggcttatgtttccgccatcgcacaaaccgagaaatctattgaggataatcctgaaatcgaggacgatatatttcgcaagcggagacttacaattatggacttacacccgggagctggcaagactaaaaggtacctgcccgccatcgtgcgagaagcgatcaagcggggcctccgcaccttgattctggccccaacgagagtcgtggcagctgagatggaagaggccctcagggggctgcctatccggtatcagacacccgctattcgagcagagcatactggaagagaaatagttgaccttatgtgtcacgccaccttcacaatgcgcctgttgtcgccagtgagggtccctaactacaatctaatcattatggatgaggcccatttcaccgaccccgctagcatcgcggcacgtggttatatctcaactcgggtggaaatgggcgaggccgctgggatttttatgaccgccacaccaccgggatccagagatcctttcccccagagtaacgcaccaataatcgacgaggaaagggagattcccgaacgctcttggaatagcggccacgagtgggtaacggattttaaaggtaagactgtgtggttcgttccttccatcaaagccgggaacgacattgctgcgtgcctgcgaaagaatggaaagaaagtcatccaactctcaagaaagacctttgattctgaatacgtgaaaacacggaccaacgactgggatttcgtggtcactacagacataagcgagatgggcgccaattttaaggcagagagggtaatcgatccacgccgttgtatgaaacccgtgattttaaccgacggcgaagagagagttatcctggctgggcctatgccggtgacgcatagttccgccgcacagcggaggggacgcattggtcgaaacccaaagaatgaaaacgaccagtacatctatatgggcgagccccttgaaaatgatgaggactgcgcccactggaaagaggctaagatgctgctcgataacataaatactcctgaagggattatccccagcatgttcgagccagaaagagagaaggtcgacgccattgatggagaataccggttgaggggcgaggcgcgcaaaacatttgtggacctgatgagaaggggtgatctccctgtttggctggcatataaggtggccgctgaggggatcaactacgccgaccggcgttggtgtttcgatggcatcaaaaacaatcagatccttgaagagaacgtcgaagtggagatttggaccaaggagggagaacgcaaaaagctaaagccccgatggctggacgctagaatctattctgatccattggcattaaaagagtttaaggagttcgccgctggcaggaaatcactgaccctcaatctgattactgagatggggcggcttcctacattcatgacccaaaagacacgcgacgccctggataacctcgcagtattgcacactgcggaagccggaggtagagcttacaatcatgccctgtccgagctaccggagacgctggaaaccctccttctgttaacattgctggcaactgtgaccggcgggatctttctcttcctgatgagtggaaggggcataggtaaaatgacacttgggatgtgctgcattatcaccgctagcatcctgctctggtatgcccagattcagccccactggatcgcagcctcgataattttggagtttttcctgatcgttttactaattccagaacctgagaagcagcggactccccaagacaaccagctgacgtacgtcgtgatcgctatactcaccgtggtcgcggccacaatggcaaatgaaatgggctttcttgagaagactaaaaaggacctgggattgggctctatcgctacccagcagccagagtccaacattctggatatcgacctccgacctgccagcgcctggacactgtacgcagttgctaccactttcgtgacacccatgcttagacattcaattgaaaatagttctgtaaacgtgtccctcacggccatcgcgaatcaagctaccgtcctgatggggttgggaaaaggttggccgctgagcaagatggatattggcgtgccattactagccatcgggtgttattcacaggttaaccctataactctgacagcagccctccttctgttggtggctcactacgcaattatcggacccggcctgcaggccaaagcgacccgcgaggctcagaagagggccgcagccggtatcatgaagaatccaaccgtcgacgggattacagtaatagatctcgaccccatcccttatgatccgaaatttgaaaagcaactgggccaggtgatgcttttaattctgtgcgttactcaggtgctcatgatgcggacgacctgggctttgtgtgaggccctgacactagcaactggacccatcagtaccctgtgggaaggcaacccagggcgtttctggaatacaaccattgctgtcagcatggccaacatctttagaggatcctacctcgcgggcgccggtcttctgttctctataatgaaaaatactacgaacacaaggcgcgggaccggaaacatcggcgagactttgggtgagaagtggaaaagccggctgaatgcactcggcaagtccgaatttcaaatttataaaaagtcagggatccaggaggtggaccgaaccctggctaaggaaggaattaaaagaggcgagacagatcaccatgccgtctctagggggagtgcaaagttacgctggttcgtggagcggaacatggttactcctgaaggaaaagtggtagaccttggctgcggtagagggggatggtcgtactattgtggcggtctgaagaatgtgcgtgaggtcaaaggcctcaccaaagggggacccggccacgaggaacctatcccaatgagcacatacgggtggaacctagttaggctgcagtccggagtggatgtctttttcataccccctgaaaagtgcgacacgttgctgtgtgatattggcgagtcttcaccaaatcccaccgtggaggctggtcggactctccgcgtacttaacctggtggaaaattggttgaacaataacacacagttctgcatcaaagttctgaatccgtacatgcctagcgtgatcgagaagatggaagccctccaacgaaaatatgggggagccttagtcagaaacccactgtccaggaatagtacccatgagatgtactgggtgtctaacgcgagcggcaatattgtctcatccgtgaacatgataagtcggatgcttatcaaccgctttactatgagacacaagaaagctacatatgaacccgacgttgacctgggcagcgggaccaggaatattggaatcgagtctgagattcctaacctagatatcataggtaagcgaatcgaaaagattaaacaggagcatgaaacgtcctggcactacgaccaggatcacccatataagacctgggcataccatggctcatatgagacaaaacagactgggagcgcctcgtctatggtaaatggagtggtccggctcctgaccaagccctgggacgtgttgccgacagttactcaaatggctatgaccgatacaacccctttcggccagcagcgtgtgtttaaagaaaaggtcgacactagaacgcaggagcccaaggagggtactaaaaagctgatgaaaatcaccgccgaatggctctggaaggagcttgggaaaaagaaaactccacgcatgtgtaccagggaagagttcacacggaaggtgagaagtaacgcagccctgggagctatttttacggatgagaataagtggaaatccgcgcgcgaagccgtagaggacagcaggttctgggaattagtggataaggagcgaaacctgcacttggaaggcaaatgcgagacctgtgtttacaatatgatgggcaagcgggagaaaaagctcggggaatttggaaaggcaaaaggttcaagagctatctggtacatgtggctgggcgccaggttcctagagtttgaagcacttgggttcctgaacgaggaccattggttttcccgcgaaaattctctcagcggagtcgagggcgagggtctgcacaagttggggtatattctgcgtgatgtgagtaaaaaggaaggaggcgccatgtacgctgacgacactgccggctgggatacacggataaccctcgaggaccttaaaaacgaagagatggtgactaatcacatggaaggggagcataagaagctggcggaggcaatcttcaaattaacatatcaaaacaaggtcgttagagtgcagaggcctacaccccgcggaacagtaatggatattatctcccgacgggaccagagaggtagcggccaagtggggacttacggactgaatacctttacgaacatggaagcccagttgatcaggcagatggagggcgaaggtgtcttcaaaaatattcagcgcctcaccgtgacagaggaggttgctgtgcacaactggctggccagagtcgggcgggaaaggctatctcgtatggcaatatcaggagatgactgcgtggtaaagccacttgatgaccgattcgctaacgccctgactgctctcaatgatatgggcaaaatccgcaaggacattcaacagtgggagcccagtaagggctggaacgattggacccaggttcctttttgctcccatcacttccatgaactgatcatgaaagacgggagaattttggtggtcccatgtcggaatcaggatgagttaatcggaagggcccgcataagccaaggtgcaggctggtctctgagagaaacagcgtgcctcgggaagtcgtatgcccagatgtggtcacttatgtactttcaccggagggacctgcgactagctgccaacgcaatctgtagcgctgtgccgtcccactgggtgcccacaagtcgtaccacgtggtctattcatgccaaacacgagtggatgacaaccgaggacatgctgactgtctggaatagagtttggatccgcgaaaacccttggatggaggataagacaccagtggaaagctgggaggaaattccctatctcggaaaacgggaggaccagtggtgcggctccttgatcggtctgacctcaagggcaacttgggccaagaatatacaggcggctattaaccaagtaagaagtcttatcgggaatgaggaatacaccgattacatgccttctatgaagcgcttccggagggaggaagaggaagccggagtgctgtggtga

SEQ ID NO: 14890 - RNA, 9876 nt, synthetic construct
  misc_feature 1..9876: note = derived and/or modified CDS sequence (opt3) from DENV-2__EU482542__SS-prME
  source 1..9876: mol_type = other RNA
agcgccggcatgatcattatgctgatacccaccgtgatggctttccacctcacaactagaaacggggagcctcatatgatcgtcggaattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagagcaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggacaggaaatcaaggtaacgccgcaatcaagtattacagaggctgaactgaccggctatggtactgtgaccatggagtgtagccccagaacagggcttgatttcaatgaaatggtcctgttgcagatggagaacaaagcctggctcgtgcacaggcagtggtttctggacttacctctgccatggctccccggcgcagataagcaggagtctaattggatccaaaaggaaacccttgttactttcaaaaaccctcatgctaagaaacaggacgtggtcgtgctgggatcccaggagggcgccatgcacacagcgttgacgggggccaccgaaatacaaatgtcaagcggaaatctactgtttactggtcatctcaagtgccggctgcgtatggacaaacttcagctgaagggcatgagttactctatgtgtacagggaagttcaaagtagttaaggagattgcagagacccagcacggaacaatcgtgatccgcgtccagtatgaaggcgatggttccccatgcaaagtgcccttcgagattatggacttggaaaagagatacgtcctcgggaggctgatcactgtgaacccgattgttaccgagaaagatagccctgtgaacatagaagctgagcccccatttggcgactcgtacatcattatcggagtagagcctggccaattaaagctgaattggttcaagaaagggtcttccatcggacagatgtttgaaacgaccatgcggggtgccaagcgaatggctattctaggcgatacagcctgggacttcgggtcactcggaggcgtctttactagtataggtaaagcactgcatcaggtgttcggggccatctatggcgctgcgtttagcggagtttcctggaccatgaagattcttatcggcgtgattatcacatggatagggatgaactctcgcagcacttcattgagtgtctccctggtgctcgtaggaatcgtgaccctgtaccttggcgttatggtccaggcagatagcggttgtgtggtgtcttggaaaaataaggagctgaagtgcgggtcaggaattttcatcacggacaacgtccacacatggaccgaacaatataaatttcagcccgagagtccaagcaagttggcctccgctattcagaaagcccaggaagagggcacttgtggtatcagatctgttacaaggctcgagaatctgatgtggaagcaaataacccccgaattaaaccacattctggcagagaatgaagtgaaactaactatcatgaccggcgatattaaggggatcatgcaggccggaaaacggtcgctccgccctcagccaacagagctgaagtacagctggaagacgtggggcaaagctaagatgctttccaccgaatcatataaccagactttcttgatagacgggccggagacagccgagtgccccaataccaacagagcatggaatagtctggaagtggaggattacggatttggcgtattcacaactaacatctggctcaaactgaaggaaaaacaagacgcgttttgtgactctaagttaatgagcgctgccattaaggataatagggcagtccatgccgacatgggttattggatcgagtccgctctgaacgatacctggaaaattgagaaggcctcattcatcgaagtgaaaaattgccactggcctaagagccatacgctttggtctaacggggttttggagtccgaaatgataattccaaaaaacctcgcaggacccgtgagtcagcacaattaccgtcctggctaccacacacagatcgctggtccatggcatctgggcaagctagagatggacttcgatttttgtgacgggaccactgtcatcgtgaccgaagattgcggaaaccggggccccagcctgcgaacaactaccgcctctgggaagctcattacagagtggtgctgtagatcctgcacgctgccgcctcttaggtatcgcggagaggacggctgttggtacggtatggaaatccggccattgaaagagaaggaagagaatctggttaactcattagtgaccgcggggcacggacaagtagataatttcagtctcggcgtcctgggtatggccctttttctggaagagatgttgaaaactagagtgggcacaaagcatgctattctcctggtggcagtcagcttcgttaccctaataactgggaacatgtcgtttaaagacctgggaagggtggtagtgatggtcggcgccacaatggctgatgacatcgggatgggagtgacctatctcgccctgcttgcagcgttcaaggttcgccccacgtttgccgctggcttgctgttacgaaagctcacttccaaagagctgatgatgaccacaattggtatcgtgcttctgtctcagagcaccattcctgaaactgtcctagagctcacagatgccctggcattggggatgatggtgctgaagatcgttcggaatatggaaaaataccagttagctgtgaccataatggccatcctctgcgtccccaacgcagtaattctgcagaatgcctggaaggtgtcatgtacaatccttgctgttgtgagtgtctccccactgttgctcacttctagccaacagaaaaccgactggattcctctggcgctaacgatcaagggactgaaccccacagccatattccttaccactctctcccgtaccaataaaaagagatcatggccactgaacgaggcaattatggctgtgggcatggtaagcatcttggccagttctctgttaaagaatgacatcccgatgacaggccctctcgtggccgggggactgcttactgtctgctatgttctgaccggtaggtccgctgatttggaactcgagcgcgcaacggacgtgaaatgggaggatcaggccgaaattagcggctcgtcacccatactgtctatcacaattagtgaggacgggtccatgagcatcaagaacgaagaggaggaacagaccctaactattctgatccggacaggacttctcgtgatatctggcctgtttccaatcagcattcccatcaccgcggctgcctggtacttgtgggaggtcaaaaagcaaagagcaggtgtgttatgggatgttccttccccaccccctatggggaaagccgaactggaggacggagcttataggattaagcagaagggcatcctcggctactcacagataggggcaggagtatacaaagaaggtactttccacacaatgtggcatgtgacccgaggcgccgtcctgatgcacaaggggaaacgcattgagccgagttgggcggatgtgaagaaagaccttatcagctatggaggcggttggaagctggagggggaatggaaggagggagaagaggttcaggtgttggctctagaaccaggcaaaaatccccgggccgtccaaacgaagcctggcctgtttaaaactaacaccgggacaatcggagcagtgtctctcgatttctccccaggtacctcaggcagtcccattatcgacaagaaagggaaggtagtcggactgtacggcaacggtgtggttacaagaagcggggcctatgtgtccgctatagcccagactgagaagtctattgaggataatcctgaaatcgaggacgatatttttaggaaacgtcgccttaccatcatggacttacacccgggagcaggcaagacgaaacggtacctgcccgctatagtcagagaagccattaagaggggcctccgaacattgatcctggcgccaactcgggtggttgccgcagagatggaagaggctctccgcgggctgcctatcagatatcagacccccgccattagggctgagcatacaggacgggaaatcgtggaccttatgtgtcacgcaaccttcactatgcgactgttgtcgccagtcagagtgcctaactacaatctaattataatggatgaggcccatttcaccgaccccgccagcatcgctgcgcgcggttatatttcaacaagggtagaaatgggcgaggcagccgggatctttatgacggctactccaccgggatcccgtgatcctttcccccaaagtaacgccccaatcattgacgaggaacgggagatacccgaaagatcttggaatagcggccacgagtgggtgaccgattttaaaggtaagacagtttggttcgtcccttccatcaaggcagggaacgacattgccgcttgcctgaggaaaaatggaaagaaagtgatccagctctcacgcaagacctttgattctgaatacgtgaaaactcgaacaaacgactgggatttcgtcgtaaccacggacattagcgagatgggcgcgaattttaaggccgagagagtgatcgatccacggaggtgtatgaaacccgttatattaactgacggcgaagagcgcgtgatcctggcagggcctatgccggtcacacatagttccgctgcccagcgtagaggacggattggtaggaacccaaagaatgaaaacgaccagtacatctatatgggcgagccccttgaaaatgatgaggactgcgcacactggaaggaggccaaaatgctgctcgataacattaatacccctgaagggatcatacccagcatgttcgagccagaacgcgagaaggtggacgctattgatggagaataccgattgagaggcgaggcccggaaaacctttgttgacctgatgaggcgcggtgatctccctgtgtggctggcgtataaggtcgcagccgaggggatcaactacgctgacagaaggtggtgtttcgatggcattaaaaacaatcaaatccttgaagagaacgtggaagtagagatatggactaaggagggagaacggaagaaactaaagccccgttggctggacgcccgcatctattctgatccattggctttaaaagagtttaaggaattcgcagccggccgaaaatcactgacactcaatctgattaccgagatggggagacttcctacattcatgactcagaagacgagggacgctctggataacctcgccgtgttgcacaccgcagaagcgggaggtcgggcctacaatcatgctctgtccgagctaccggagacactggaaactctccttctgttaaccttgctggccacagttaccggcgggatctttctcttcctgatgagtggaaagggcattggtaaaatgactcttgggatgtgctgcatcataacggcaagcattctgctctggtatgctcagatccagccccactggatcgccgcatcgattatcttggagtttttcctgatagtcttactaattccagaacctgagaagcaacgcaccccccaggacaaccagctgacatacgtggtgatcgccattctcactgtcgttgctgcgaccatggccaatgaaatgggctttcttgagaaaacaaagaaagacctgggattgggctctatcgcaacccagcaaccagagtccaacatactggatatcgacctcagacctgctagcgcctggactctgtacgccgtggcaacaacgttcgtaacccccatgcttaggcattcaattgaaaatagttctgtgaacgtctccctcactgctatcgccaatcaggcgacagtgctgatggggttgggaaagggttggccgctgagcaagatggatattggcgttccattactagctatcgggtgttattcacaggtgaaccctattaccctgaccgccgcactccttctgttggtcgcccactacgctatcataggacccggcctgcaggcaaaagccacacgggaggcgcaaaagcgagctgccgcaggtattatgaaaaatccaactgtagacgggatcacggtgatcgatctcgaccccattccttatgatccgaagtttgaaaaacagctgggccaggttatgcttttaatactgtgcgtgacccaagtcctcatgatgagaacaacttgggccttgtgtgaggctctgaccctagccacaggacccatcagtaccctgtgggaaggcaacccagggcgcttctggaatactacgattgcagtgagcatggctaacatctttaggggatcctacctcgccggcgcgggtcttctgttctctattatgaagaatacaaccaacactcggcgtgggaccggaaacatgggcgagacattgggtgagaaatggaagagcagactgaatgccctcggcaagtccgaatttcagatctataaaaagtcagggatacaggaggtcgacaggactctggcaaaagaaggaatcaagcgcggcgagaccgatcaccatgctgtgtctcgggggagtgccaaattacgatggttcgttgagagaaacatggtgacacctgaaggaaaggtagtggaccttggctgcggtagggggggatggtcgtactattgtggcggtctgaagaatgtccgcgaggttaaaggcctcacgaaggggggacccggccacgaagagcctattccaatgagcacctacgggtggaacctagtgcggctgcagtccggagtcgatgtgtttttcatcccccctgaaaaatgcgacactttgctgtgtgatattggcgagtcttcaccaaatcccacagtagaggcaggtagaaccctccgtgtgcttaacctggttgaaaattggttgaacaataacactcaattctgcatcaaggtgctgaatccgtacatgcctagcgtcatagagaaaatggaagctctccagaggaagtatgggggagccttagtgcggaacccactgtcccgcaatagtacacatgagatgtactgggtctctaacgccagcggcaatattgtgtcatccgttaacatgatcagtcgaatgcttatcaacagatttaccatgaggcacaagaaagcgacgtatgaacccgacgtagacctgggcagcgggacccggaatattggaatagagtctgagatccctaacctagatattatcggtaagcgcattgaaaaaatcaagcaggagcatgaaacatcctggcactacgaccaggatcacccatataaaacttgggcttaccatggctcatatgagaccaagcaaacagggagcgcatcgtctatggtgaatggagtcgtgagactcctgactaagccctgggacgttttgccgaccgtgacacagatggccatgaccgatactacgcctttcggccagcagagggtctttaaagaaaaggtggacacacgaacccaagagcccaaagagggtactaagaaactgatgaagataaccgctgaatggctctggaaagagcttgggaagaagaaaacaccacggatgtgtacgcgtgaagagttcaccagaaaggtacgcagtaacgccgcactgggagccatctttactgatgagaataaatggaagtccgctagggaagcggtggaggacagccggttctgggaattagttgataaagagagaaacctgcacttggaaggcaagtgcgagacatgtgtctacaatatgatgggcaagcgcgagaaaaagctcggggaatttggaaaagccaagggttcaagggcaatttggtacatgtggctgggcgctcgattcctagagtttgaagcccttgggttcctgaacgaggaccattggttttcccgggaaaattctctcagcggagtggagggcgagggtctgcacaaattggggtatatcctgagagatgtgagtaagaaggaaggaggcgcaatgtacgccgacgacaccgctggctgggatactaggattacactcgaggaccttaaaaacgaagagatggtcaccaatcacatggaaggggagcataagaaactggccgaggcgatcttcaagttaacatatcagaacaaagttgtgcgcgtacagcgtcctactccccggggaaccgtgatggatattatatccagaagggaccaacgcggtagcggccaggtcgggacgtacggactgaatacctttacaaacatggaagcacagttgatccgacagatggagggcgaaggtgtgttcaagaatattcaacacctcactgttaccgaggaggtggccgtccagaactggctggctcgggtggggagagaaaggctatctcgcatggccatctcaggagatgactgcgtagttaagccacttgatgacagattcgcaaacgctctgacagccctcaatgatatgggcaaaatccggaaggacattcagcagtgggagcccagtaaaggctggaacgattggactcaagtgcctttttgctcccatcacttccatgaactgataatgaaggacgggaggatcttggtcgtgccatgtcgtaatcaggatgagttaattggacgagctcgcatcagccagggtgccggctggtctctgagagaaaccgcatgcctcgggaaatcgtatgcgcagatgtggtcacttatgtactttcaccggagggacctgcgcctagccgctaacgccatttgtagcgcagtgccgtcccactgggtccccacgagtagaacaacctggtctatccatgctaagcacgagtggatgactacagaggacatgctgaccgtttggaatcgggtgtggataagggaaaacccttggatggaggataagactccagtagaaagctgggaggaaatcccctatctcggaaaacgagaggaccaatggtgcggctccttgattggtctgacctcacgtgccacatgggcaaagaatatccaggccgcgattaaccaggtgagaagtcttatcgggaatgaggaatacacggattacatgccttctatgaaacgcttccggagggaggaagaggaagctggagtcctgtggtga

SEQ ID NO: 14891 - RNA, 9876 nt, synthetic construct
  misc_feature 1..9876: note = derived and/or modified CDS sequence (opt3) from DENV-2__JX966380__SS-prME
  source 1..9876: mol_type = other RNA
accgccggcatgatcattatgctgatacccacagtgatggctttccacctcactacgagaaacggggagcctcatatgatcgtcagcaggcaggaaaagggaaaatcccttctgtttaagaccaaagacggtacaaatatgtgcactttgatggcaatggatttaggcgagctgtgtgaagacaccattacatacaagtgcccattcctaaaacaaaacgagccggaagatatcgactgttggtgcaattctacctcaacttgggttacatatgggacctgtacgactaccggagagcaccggcgcgagaagcgaagtgtggccctcgtaccccatgtgggcatgggtctggaaacacgtactgagacctggatgagctccgaaggggcgtggaagcacgctcagagaattgagacatggatccttaggcatcctggatttaccataatggccgcaatcctggcctacacgattggcactacacacttccagcgggtcttgatctttattctcctgaccgctatcgcaccatctatgactatgcgctgcataggcatttcgaacagagatttcgtggagggggtttcaggaggtagctgggtggacatcgtcctggaacacggcagttgtgtgacaaccatggccaaaaataagcccacgctcgattttgagttaattaaaaccgaagctaagcagcctgccacactgaggaaatattgcatcgaggcgaagcttactaacaccacaactgactcccggtgtccaacccaaggggaacccacattgaatgaggagcaggataagcgcttcgtatgcaaacattctatggttgaccgaggatggggcaacggttgtgggctgtttggaaagggcggcatcgtgacctgcgcaatgttcacttgcaaaaagaatatggaagggaaaattgtccagcctgagaacctagaatacacggtggtgataacaccacacagcggagaggaacatgccgtcggtaatgataccggcaagcacgggaaagaggttaagatcactccgcagtcctcaattaccgaggctgaactcacaggatatggcaccgtgactatggagtgtagtcccagaacaggtctggactttaacgaaatggtacttctgcaaatgaaggataaagcctggttggtgcacaggcagtggttcctcgacctgcctttaccatggctgcccggggcagacacgcagggcagcaattggatccagaaggagaccctcgtcacttttaaaaaccctcatgctaagaaacaagatgtggttgtgcttggatctcaggaaggcgccatgcacacagcgctgaccggggccacagagatacagatgtcctcaggaaatttgctattcactggtcatctgaagtgccggctccgtatggacaagctgcaacttaaaggcatgagctacagtatgtgtaccgggaagttcaaaattgtcaaggagatcgcagaaacgcagcacggaaccatcgtgattcgcgtacagtatgagggcgatggttctccatgcaaaatcccctttgaaattatggacctggagaagagacatgttttggggaggctcataacagtgaacccgatcgtcactgagaaggattcccctgtgaacattgaagctgagcccccattcggcgacagctacatcatcattggagtcgaacctggccagctgaaattagattggtttaagaaagggtcgtctataggacaaatgttcgagaccacaatgcggggtgccaagcgaatggctatcctgggcgacactgcctgggattttgggtccctaggaggcgtgttcacctcaattggtaaagcactccaccaggtttttggggccatctacggcgctgcgttcagtggagtgagctggacgatgaagattctgatcggcgtaataatcacatggattgggatgaattcccgctctaccagcctttcagtcagtttggtgctggttggaatcgtgactctctatctgggcgtcatggtgcaggcagactccggttgtgtagtgagctggaagaacaaagaacttaagtgcgggtctggaatttttgttacagataatgtccacacctggactgagcagtacaaattccaacccgagtcaccaagtaagctggccagcgctatccagaaagcccatgaagagggcatatgtggtattagatccgtgaccaggttggaaaacctcatgtggaagcagatcacatctgagctgaatcacattttatcggaaaacgaggtgaaactgacgatcatgaccggcgacataaaggggatcatgcaggtcggaaagcggagcctacgcccccaacctactgagctcagatattcctggaaaacatggggcaaggcaaaaaccctgtcaacagaacttcataatcagacttttttgattgacgggccagagaccgccgaatgcccgaacacgaatagggcttggaacagtctggaggttgaagattacggattcggcgtgtttacaaccaatatctggctccgtctgcgggagaagcaggacgtgttctgtgattctaaattaatgagcgccgcaattaaggacaaccgagcggtacacgctgatatgggttattggatcgagtccgccctgaatgacacttggaagatagaaaaagcatcattcattgaggtcaagagctgccactggcccaaatctcataccctttggtccaacggggtgttggaaagtgagatggttatccctaagaattttgccggaccagtgagccagcacaacaacagacccggctaccatacacaaactgctggtccttggcacctcggcaaactggagatggatttcgacttttgtgaagggaccacagtcgtggttacggaggattgcggaaataggggcccatctctacgcaccactacagcctccgggaagctgatcaccgaatggtgctgtcggtcatgcactctccccccgctgagatataggggagaggacggctgttggtacggtatggaaattcgccctcttaaggagaaagaggaaaacttggtgagtagcctggtaacagcagggcatggacagatcgataatttctcgttaggcattctcggtatggctctgtttcttgaggaaatgctgcgaacccgggtcggcacgaagcacgccatattgctcgtggcggtgtccttcgtcactctgatcaccgggaacatgtcttttcgtgacctaggaagagttatggtgatggtaggcgccacaatgaccgatgacattgggatgggagtgacttacctggctctcctggcagccttcaaagtcaggccaacatttaccgctggccttttgctgcgcaagttaacaagcaaagagctcatgatgactaccatcggtattgtgctgctttcacagagttccatccccgaaacgatactggagctaacagacgccctcgcactggggatgatggttttgaagatggtgcggaatatggagaagtatcaactggcggtcaccatcatggccattttatgcgtgcctaacgctgttatcctccagaatgcctggaaagtgtcttgtactattctggcagtcgtaagcgtgtccccccttctgttgacctcaagccagcagaaggctgattggatcccactcgccctgacaataaaaggactaaaccctactgcaattttcctgaccacgcttagtagaacatctaagaaaaggtcctggcccctcaatgaagccatcatggctgttggcatggtgagcatcctggcgtcgtcattgctgaagaacgacattccaatgaccggcccgttagtcgccgggggactcctgactgtgtgctacgtacttacaggtcgatctgcagatctggagttggaacgcgctaccgacgtgaaatgggatgaccaagccgagataagtggctccagccctatcctctctattactatcagcgaagatgggtccatgtcaattaagaatgaggaggaagagcagacactgaccatcctaatacggacgggactgcttgtcatcagtggcctctttcccgttagcattccaatcactgccgctgcatggtatctgtgggaagtgaagaaacagagagccggtgtgttgtgggacgtcccctctcctccacccgtggggaaggcggagttagaggatggagcttacaggattaaacagaagggcatcctgggctattcccaaataggggccggagtttacaaagaaggtaccttccacacaatgtggcatgtaacccgtggcgcagtgctcatgcacaaggggaagcgcattgagccttcatgggccgacgtcaaaaaggatctgatcagttatggaggcggttggaaacttgaaggggagtggaaggaaggagaggaggtgcaggttctggctttggaaccgggcaaaaacccacgggcagtgcagacaaagcccggcctatttagaactaataccgggacgatcggagccgtcagcctggacttctcccctggtacatctggctcgccaattgtggataagaaagggaaggtagtcggactctacggcaacggtgtggttactaggagcggggcgtacgtgtcagctatcgcccagaccgagaaatccatagaagacaatcccgagattgaagacgatatcttccgaaagcggcgcctgacaattatggaccttcatcctggagcaggcaaaaccaagagatatttaccggccatcgtcagggaggctataaagcggggcctgcgaactctcattttggcccccaccagagtggttgcagctgagatggaagaggccctgcgcgggctcccaatcaggtaccaaacacctgcgatccgtgccgaacacacgggacgggagattgtggatctgatgtgtcatgcaacttttaccatgagacttctgagtcccatcagggtcccaaactataacttgattataatggacgaagctcacttcacagatcctgcctctatcgctgcacgcggttacattagcacccgagtggagatgggcgaggccgccgggatctttatgactgctacacccccaggatccagagacccgttccctcagtcaaatgcgcccatcatggatgaagagcgggaaattccagagaggtcttggaacagcggccacgagtgggtaaccgactttaaaggtaagacggtgtggttcgttcccagtataaaaactgggaatgatatcgcagcctgcctacgcaagaacggaaaacgtgtcattcagctgtccagaaagacatttgacagcgaatatgtgaagacccggaccaatgattgggacttcgtggtcactacagacatctctgagatgggcgctaactttaaagccgaaagggtaattgatcctcgccgatgtatgaagccagtgatcctcaccgacggcgaggaaagagttatattagcagggcccatgcctgtgacacattcatccgccgctcaacggaggggacgcatcggtagaaatccgaggaacgagaatgatcagtacatttatatgggcgagccactggaaaacgacgaggattgcgcgcactggaaagaagccaagatgcttctggacaatatcaacactcccgaggggattatccctagtatgttcgaacccgagcgggagaaagtcgatgcaatagacggagaataccgtctccgcggcgaggctcgaaagacgtttgtggatttgatgagaaggggtgacctgccagtttggctcgcctacaaagtggcagccgaagggattaattatgctgatcggcgctggtgtttcgacggcaccagaaacaatcagatcctggaggaaaacgtcgaggtggagatttggacaaaggaaggagagaggaagaaacttaagcctcggtggctagatgcccgaatctacagcgaccccctggcgttgaaagaattcaaggagtttgcagccggcagaaaatcgttaactctgaacctcataaccgagatggggcgcctgccaacattcatgacccagaaggctagggacgcccttgataatctggctgtactccatactgcagaagccggaggtaaggcttataaccacgccttgtctgagctgcctgaaacgctagagaccctgctccttctgacattattggcaactgtgaccggcgggatctttctgttcctcatgtccggacggggcattggtaaaatgacactggggatgtgctgcatcattaccgcgagcatccttctgtggtacgcccaaatacagccgcactggattgctgcctcaatcatcctcgaatttttcttgattgttctgttaatccccgagccagagaagcagcgtactcctcaggacaatcaactaacatatgtcataattgcaatcctgacggtggtggctgccaccatggcaaacgaaatgggctttctcgagaaaactaagaaagatcttggactgggcaatattgccacacagcagcccgaaagtaacatcttggacatagatctgagaccagcttctgcgtggaccctctacgccgtcgcaaccacattcatcactcctatgctgaggcattccattgagaatagctcagttaacgtgagtcttacggctatcgccaatcaggccaccgtactcatggggctgggaaagggttggcccttgagcaagatggacattggcgtgccgctgttagcaatcgggtgttattcccaagtcaacccaattacactaactgctgccctgctccttctggtggcgcactacgctatcataggacctggcttgcaggccaaagcaacccgcgaagcccagaagcgggctgcagccggtattatgaaaaatcccacagttgatgggatcaccgtgatcgacctggatccaattccctacgaccctaagtttgagaaacagctcggccaagtcatgctgcttgtattatgcgtgactcaggttctgatgatgcgaacgacatgggcgctctgtgaggctttgaccctggccactggaccggtgtctaccctatgggaaggcaaccccgggagattctggaatacaactatagcagtcagcatggccaacatctttaggggatcctatctggctggcgccggtctccttttctcaattatgaagaataccacatctacgcgccgggggaccggaaacatcggcgagactctgggtgaaaagtggaaaagtagattgaatgcactgggcaagtcggagtttcagatttacaaaaagagcgggatccaagaagtggatcgtacactcgctaaagagggaataaagaggggcgagaccgaccatcacgccgtctcccgggggtctgcgaaactgcgctggttcgtggaacgaaacttagttactccagagggaaaggtggtagatcttggctgcggtagagggggatggtcatattactgtggcggtctgaagaacgtgagggaagtcaaaggcctcacaaaggggggacctggccatgaggagcccatccctatgagcacctatgggtggaatctagttcggctgcagtccggagtggacgtcttctttgtgccacccgaaaaatgcgacacgttgctgtgtgatattggcgagagttctcctaacccaaccgtagaagccggtcgcacactcagagtgcttaatctggttgagaactggttgaataacaatactcagttctgcgtgaaggtcctgaacccctacatgccgagcgtgatcgaaaggatggagaccctccagcgaaaatatgggggagcattagtccggaatcctctgtcacgtaactccacacacgagatgtactgggtgagtaatgctagcggcaacattgtttcttccgtaaatatgatctcaagaatgcttataaaccgctttactatgaggcacaagaaggccacctacgaaccagacgtggatctgggcagcgggacacggaatattggaatcgagtcggaaacccccaacctagacatcattggtaaaagaatagagaagatcaaacaagaacatgagacttcttggcactatgatcaggaccatccttacaagacgtgggcatatcacggcagttacgagacaaaacagaccgggtccgctagctcaatggtcaacggagtggttcgcctcctgactaagccatgggatgtggtccccatggtgacccagatggccatgacagacacgaccccgttcggccaacagagggtatttaaggaaaaagtggatactcgaacacaggagcctaaggaaggtaccaaaaagttgatgaaaattactgccgagtggctgtggaaggaactcgggaagaaaaagacaccccggatgtgtaccagagaggagttcacaaaaaaggttaggtccaatgcggctcttggagcaatctttactgacgaaaacaaatggaagtctgcccgcgaggctgtcgaagatagccgtttctgggagctggtggacaaagagcggaatttacacctggaaggcaagtgcgagacctgtgtgtataacatgatgggcaagagagaaaaaaagttgggggagtttggaaaagccaagggtagtagggcaatttggtacatgtggctcggcgcccgcttcctggaatttgaggctctagggttccttaatgaggaccattggttttcccgagaaaacagcctgtctggagtcgagggcgaaggtctccacaaactggggtatatcttgcgggaggtttcaaagaaggaaggaggcgcgatgtacgccgatgacacggcaggctgggataccagaataacaatcgaggacctgaaaaatgaggaaatgattactaaccatatggctggggagcacaagaaactcgccgaagcaatcttcaagcttacctaccagaataaagtggtaagggtgcaacgcccaacacctagaggaactgtcatggatattatcagtcggagggaccagcgtggttccggccaggtggggacctatggactgaacacgttcacaaatatggaggcccaattaattcgacagatggaaggcgagggtatatttaagaacatccagcatctgaccgctagcgaggaaattgccgttcaggattggttggtgcgcgtcgggagagagcggctctctaggatggcgatctcgggagacgattgcgtggtaaagcccctggacgatcgcttcgcaagagccctaactgctcttaatgacatgggcaaagttcggaaggatatccaacagtgggaaccatcaaggggctggaacgactggacacaggtgcccttttgcagccaccacttccatgagctgattatgaaagacgggcgaaccctcgtcgtgccttgtcgtaatcaggatgagctgataggaagagcccgcatctcccaaggtgcaggctggagtttgcgggaaactgcttgcttagggaagtcttacgcccagatgtggagcctgatgtattttcacaggagagacctccgccttgctgccaacgcaatttgttccgcggtgccatcacattgggtcccgaccagtcggacaacgtggtctatccacgccagccacgagtggatgaccactgaagatatgctgacagtttggaacaaagtgtggattctagagaatccctggatggaagacaagacccctgtagagtcctgggaggaaatcccatacctgggaaagagggaggatcagtggtgcggctcactcataggtttgactagccgagctacatgggccaaaaacatccagaccgcaattaatcaagtgagatctctgatcgggaacgaagagtatacggactacatgccctccatgaagcggttcaggcgcgaagaggaggaagctggagtcctttggtga

SEQ ID NO: 14892 - RNA, 9876 nt, synthetic construct
  misc_feature 1..9876: note = derived and/or modified CDS sequence (opt3) from DENV-2__JX966379__SS-prME
  source 1..9876: mol_type = other RNA
accgccggcatgatcattatgctgatacccacagtgatggctttccacctcactacgagaaacggggagcctcatatgatcgtcagcaggcaggaaaagggaaaatcccttctgtttaagaccaaagacggtacaaatatgtgcactttgatggcaatggatttaggcgagctgtgtgaagacaccattacatacaagtgcccattcctaaaacaaaacgagccggaagatatcgactgttggtgcaattctacctcaacttgggttacatatgggacctgtacgactaccggagagcaccggcgcggcaagcgaagtgtggccctcgtaccccatgtgggtatggggctggagacacgtactgaaacctggatgagctccgagggagcgtggaagcacgctcagagaattgaaacatggatccttaggcatcctggctttaccataatggccgcaatcctggcctacacgattggcactacacacttccagcgggtcttgatctttattctcctgaccgctatcgcaccatctatgactatgcgctgcatagggatttcgaacagagatttcgtggagggagtttcaggtggcagctgggtggacatcgtcctggagcacgggagttgtgtgacaaccatggccaaaaataagcccacgctcgattttgaattaattaaaaccgaggctaagcagcctgcctccctgaggaaatattgcatcgaagcgaagcttacaaacactaccacagactctcggtgtccaactcaaggagagcccaccttgaatgaagagcaggataagcgcttcgtatgcaaacatagcatggttgaccgaggctggggtaacgggtgtggactgtttggcaagggcgggatcgtgacatgcgcaatgttcacctgcaaaaagaatatggagggaaaaattgtccagcctgaaaacctagagtacactgtggtgataacgccacactccggtgaagagcatgccgtcggcaatgatacagggaagcacggaaaagaagttaagatcaccccgcagtcaagtattactgaggctgagctcaccggctatggtacagtgaccatggaatgtagccccagaactgggctggactttaacgagatggtacttctgcaaatggaagataaggcctggttggtgcacaggcagtggttcctcgacctgcctttaccatggctgcccggcgcagacacacagggatctaattggatccagaaagagacgctcgtcacctttaagaaccctcatgctaaaaagcaagatgtggttgtgcttggctcccaggaaggggccatgcacactgcgctgacaggagccaccgagatacagatgtcaagcggtaatttgctattcacaggccatctgaaatgccggctccgtatggacaagctgcaacttaaggggatgagttactctatgtgtactggaaaattcaagattgtcaaagagatcgcagaaacccagcacggcacgatcgtgattcgcgtacagtatgagggtgatgggtccccatgcaagatcccctttgaaattatggacctggagaaaagacatgttttgggcaggctcataaccgtgaacccgatcgtcacagagaaggatagccctgtgaacattgaagctgagcccccattcggagactcgtacatcatcattggcgtcgaacctgggcagctgaagttagattggtttaaaaagggatcttccataggtcaaatgttcgagactaccatgcggggcgccaaacgaatggctatcctgggggacacagcctgggattttggatcactaggcggtgtgttcactagtattgggaaggcactccaccaggtttttggcgccatctacggagctgcgttcagcggcgtgtcctggaccatgaaaattctgatcggggtaataatcacgtggattggaatgaattctcgcagcacatcacttagtgtctccttggtgctggttggcatcgtgaccctctatctgggtgtcatggtgcaggcagacagcgggtgtgtagtgtcttggaagaacaaggaacttaaatgcggatcaggcatttttgttactgataatgtccacacatggaccgagcagtacaagttccaacccgagagtccaagcaaactggcctccgctatccagaaggcccatgaagagggtatatgtggcattagatctgtgactaggttggaaaacctcatgtggaaacagatcacccccgagctgaatcacattttatcggaaaacgaggtgaagctgacaatcatgacgggggacataaaaggaatcatgcaggtcggcaagcggagcctacgccctcaaccaaccgagctcagatattcctggaagacttgggggaaagcaaagatgctgtcaacagaacttcataatcagacctttttgattgacggaccggagacagccgaatgccccaacactaatagggcttggaacagtctggaggttgaagattacggcttcggtgtgtttaccacgaatatctggctccgtctgcgggagaaacaggacgtgttctgtgattctaagttaatgagcgccgcaattaaagacaaccgagcggtacacgctgatatggggtattggatcgagtccgccctgaatgacacatggaagatagaaaaggcatcattcattgaggtcaaaagctgccactggcctaagtctcataccctttggtccaacggagtgttggaaagtgagatggttatcccaaaaaattacgccggccccgtgagccagcacaacaacagacctggttatcatactcaaaccgctggcccatggcacctcgggaagctggagatggattttgacttctgtgaaggaacaactgtcgtggttaccgaggaatgcggcaatagggggccctctctacgcacaacgaccgcctccggaaaactgatcactgagtggtgctgtcggtcatgcacactcccgcctctgagatacaggggcgaagatggttgttggtacgggatggagattcgcccacttaaggagaaggaagagaacttggtgagtagcctggtaaccgcaggacatggccagatcgacaatttttcgttaggtattctcggcatggctctgttccttgaagagatgctgcgatcccgggtcgggactaaacacgccatattgctcgtggcggtgtcttttgtcacactgatcaccggaaacatgagcttccgtgatctaggcagagttatggtgatggtaggggccacgatgactgacgatattggaatgggcgtgacctatctggctctcctggcagcctacaaggtcaggcccacatttgctgccggtcttttgctgcgcaaattaacctcaaaggaactcatgatgactacaatcgggattgtgctgcttagtcagtcctctatccctgagaccatactggagctaacagacgcactcgcgctgggaatgatggttttgaaaatggtgcggaatatggaaaagtatcaactggccgtcactatcatggctattttatgcgtgcccaacgccgttatcctccagaatgcatggaaggtgagctgtaccacgctggctgtcgtatccgtgtcaccacttctgttgacaagcagtcagcagaaagccgactggattcctctcgcactgaccatcaagggcctaaaccccactgccatattcctgaccacactttctagaacttccaaaaagaggagctggccactcaatgaggctattatggcggttggcatggtgtcgatcctggcctcatctttgctgaaaaacgatatcccgatgaccgggcctttagtcgcaggaggtctcctgacggtgtgctacgtacttacaggccgaagtgctgacctggaattggagcgcgccaccgatgtgaagtgggacgatcaagccgaaatttccgggagctctcccatactcagcatcactatttccgaggacggatcaatgagtatcaaaaatgaggaagaggaacagacactgaccattctaatccggactggcctgcttgtcataagcggtctctttccagtttctacacccatcaccgctgcagcctggtatctgtgggaggtgaagaagcagagagcgggggtgttgtgggatgtcccttccccaccccctgtgggaaaagctgagttagaagacggcgcctacaggattaagcagaaaggcatcctggggtattcacaaattggagcaggtgtttacaaggagggcacgttccacactatgtggcatgtaacccgtggggccgtgctcatgcacaaaggaaagcgcatcgaaccgagttgggctgatgtcaagaaagacctgataagctacggcggtgggtggaagcttgagggagaatggaaagagggcgaggaagtgcaggttctggcattggagccaggcaagaacccccgggccgtgcagacaaaacctgggctatttagaaccaatacaggaactattggtgcggtctccctggatttctctccaggcacctcggggagccccatcgtggacaagaagggaaaagtagtcggcctctatggtaacggggtggttacgaggtcaggagcttacgtgtccgccatcgcacagacagaaaagagtattgaggataatcctgaaatcgaggacgacatatttcgaaaacggcgcctgactattatggatcttcatccgggcgccggcaagaccaaaagatatttacccgctatcgtcagggaggccattaagcgggggctgcgaacactcatcttggcaccaaccagagtggttgctgccgaaatggaggaagcgctgcgcggactccctataaggtaccaaactcccgccattcgtgcagagcacaccggtcgggaaatcgtggacctgatgtgtcatgctacattcacgatgagacttctgtctccaatcagggtccctaactataacttgattatcatggatgaggcccacttcactgaccccgctagcattgcagcccgcggctacatatccacccgagtggagatgggggaagccgctggaatctttatgacagcgaccccaccgggctcaagagatcctttcccccagtctaatgcaccaattatggacgaggaacgggagatccccgagaggagctggaacagtggtcacgaatgggtaactgattttaaggggaaaacagtgtggttcgttccttccatcaaggccggaaatgacattgctacctgcctacgcaaaaacggcaagcgtgtcatacagctgagcagaaaaacgtttgattctgagtatgtgaagactcggacaaatgactgggatttcgtggtcaccaccgacatctcagaaatgggcgccaactttaaggcagagagggtaattgacccacgccgatgtatgaaacccgtgatcctcactgatggggaagagagagttattttagccggacctatgccggtgacacattccagtgctgcgcaacggaggggtcgcatcggcagaaatccaaggaacgagaatgaccagtacatatacatgggggaacccctggagaacgatgaagactgcgcccactggaaggaggcaaaaatgcttctggataatatcaacacccctgaaggaattatccccagcatgttcgagccagagcgggaaaaggtcgacgctattgatggcgagtatcgtctccgcggtgaagcccgaaaaacatttgtggacttgatgagaaggggggatctgcctgtttggctcgcatacaaggtggcctcggagggcatcaattatgctgaccggcgctggtgtttcgatggaactagaaacaatcagatactggaagagaacgtcgaggtggaaatttggacgaaagagggcgaaaggaagaagcttaaaccccggtggctagacgcccgaatctactctgatccactggcgttgaaggagtttaaagagttcgcagccgggagaaagtccttaaccctgaacctcattacagaaatgggacgcctgcctactttcatgacccagaaagctagggacgcccttgacaatctggctgtactccatacagcagaggccggtggcaaggcttataaccacgccttgagcgaactgccggagaccctagaaactctgctccttctgacgttattggcaaccgtgacagggggaatctttctgttcctcatgtcaggccggggtatagggaagatgactctgggcatgtgctgcatcattaccgcgagtatccttctgtggtacgcccaaattcagccccactggatcgctgcctctataattctcgagtttttcttgatcgttctgttaatcccagagcctgaaaaacagcgtacaccccaggataatcaactaacctatgtcattatcgcaatactgactgtggtggctgccacaatggcaaacgagatgggatttctcgaaaagacgaaaaaggaccttggcctggggcatattgccacccagcagccagagtccaatatcttggatattgacctgagacctgctagcgcgtggactctctacgccgtcgcaacaaccttcatcacccccatgctgaggcactcaatagaaaacagtagcgttaatgtgtcccttacagctatcgccaaccaggccactgtactcatgggactgggtaaaggctggccgttgtctaagatggatattggggtgccactgttagcaatcggatgttacagccaagtcaatcctattacgctaaccgctgccctgctccttctggtggcgcattatgctatcattggccccggtttgcaggccaaggcaacacgcgaggcccagaaacgggctgcagccgggatcatgaagaacccaactgttgacggcataaccgtgattgatctggaccccatcccttacgatccgaaatttgagaagcagctcggacaagtcatgctgcttgtattatgcgtgacacaggttctgatgatgcgaaccacttgggcgctctgtgaagctttgacgctggccacaggccccgtgtccaccctatgggaggggaatccaggaagattctggaacactaccatcgcagtctcaatggccaatatttttaggggctcttatctggctggtgccgggctccttttcagtataatgaaaaacacaacttcgacccgccggggaacaggcaatatcggtgaaacgctgggcgagaagtggaagagcagattgaacgcactggggaaatccgaatttcagatttacaagaaatctggaatccaagaggtggaccgtaccctcgctaaggagggcattaaaaggggggaaactgatcaccatgccgtctcacggggaagcgcgaagctgcgctggttcgtggagcgaaatttagttacacctgaaggcaaagtggtagaccttggttgcgggagaggaggctggtcctattactgtggtggcctgaagaacgtgagggaggtcaaggggctcaccaaaggaggccccgggcacgaggaacctatcccaatgagtacttatggatggaacctagttcggctgcagtctggcgtggatgtctttttcgtgccccctgagaagtgcgacacattgctgtgtgacataggtgaaagctcaccaaatcccaccgtagaggccgggcgcacgctcagagtgcttaacctggttgaaaattggttgaacgataatacccagttctgcgtgaaagtcctgaacccgtacatgccttccgtgatcgagaggatggagacactccagcgaaagtacggaggcgcattagtccggaatccactgagtcgtaacagcactcacgaaatgtattgggtgtctaatgcttccggcaacgttgtatcaagcgtgaatatgatttcgagaatgcttatcaaccgctttaccatgaggcataaaaaggccacatacgagcccgacgtcgatctggggtctggaactcggaatattggtatcgaaagtgagacccctaacctagacataattggcaagagaatcgaaaaaatcaagcaagagcacgaggcatcctggcattatgatcaggaccacccatacaaaacatgggcttatcacgggagctacgaaaccaagcagactggatcagcctcctctatggtgaatggcgttgtgcgcctcctgacgaaaccctgggatgtcgtgccgatggtaacacagatggccatgaccgacactacccctttcggtcaacagagggtgtttaaggagaaggttgatacacgaacgcaggaacccaaagaggggaccaagaaattgatgaagattactgcggaatggctgtggaaagagctcggaaagaagaaaacaccacggatgtgtaccagagaggaattcactaagaaagtcaggagcaacgctgcacttggcgccatatttacagacgagaacaagtggaaaagtgctcgcgaagccgtggaggataatcgtttctgggagctggtggacaaggaacggaacttacatctggagggcaaatgcgaaacctgtgtctataatatgatggggaagagagagaagaaattgggagaatttggtaaggcaaggggctcccgcgccatctggtacatgtggctcggggctcgattcctggagtttgaggcgctaggattccttaacgaagaccactggtttagccgggagaattctctgtcaggcgttgaaggtgaggggctccataaactgggatacattttgagagaagtgagtaagaaagagggcggcgccatgtatgcagatgacacagctgggtgggatactaggatcaccattgaggacctgaagaacgaagagatgatcacgaatcacatggccggagaacataagaaactcgcagaggccatattcaagcttacctaccagaacaaagtagtgcgcgtccaaagacctacaccccggggtactgtgatggatatcatttccaggcgtgaccagcgaggcagcgggcaggttgtgacctatggactgaatacatttactaacatggaagctcaattaatccgccagatggagggcgagggtattttcaagtctatccagcacctgaccgcctcggaagagattgcggtccaggattggttggcaagagtggggcgggaaaggctctcacgcatggccataagcggagacgattgcgtagttaaaccactggacgatagattcgctcgggccctaacggcacttaatgacatgggcaaggtgaggaaggatatccaacagtgggagccctcccgaggctggaacgactggacacaggtccctttttgcagtcaccatttccacgagctgattatgaaagacgggcgtaccctcgtggtgccatgtagaaatcaggatgaactgatcggacgcgctcggatctctcaaggtgccggctggagcttgagggagactgcttgcttagggaagtcctacgcccagatgtggtcactgatgtattttcatagacgcgacctccggcttgcagcgaacgccatttgtagtgctgtcccgtctcactgggttcccacaagcaggaccacttggtccatacacgcctcacatgaatggatgaccacagaggatatgctgacggtgtggaatcgagtatggatcctagaaaacccttggatggaggacaaaaccccagtggagagctgggaagagattccctacctgggaaagagagaagatcagtggtgcggctctctcatcggtttgacttcccgggcaacatgggctaaaaacattcagaccgccatcaatcaagtcaggagtctgatagggaacgaggaatatactgactacatgcctagcatgaagcgcttccgtagagaggaggaagaggcaggagtgctttggtga

SEQ ID NO: 14893 - RNA, 9876 nt, synthetic construct
  misc_feature 1..9876: note = derived and/or modified CDS sequence (opt3) from DENV-2__KP012546__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtggccccatctatgacaatgagatgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaacaccctgcgacgctgcggaagtactgcattgaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaagatcgtccagcctgaaaacctagagtatacaattgttataaccccacactccggagaagagaatgccgtgggtaacgatactggcaaacatgggaaggagatcaaagtaacgccgcagtcaagtattacagaagcagagctcaccggatacggcactgtgaccatggaatgtagccccaggacaggtctggacttcaatgagatggtccttctgcagatggaaaacaaggcttggttggtgcaccggcaatggtttctcgatctgcctttaccatggctgcccggggccgacacccagggctctaactggatccagaaagagactctcgttacattcaagaatcctcacgcgaagaaacaggatgtggtcgtgcttggatcccaagagggcgccatgcatacggcactgaccggggctactgaaatacagatgtcaagcggaaacttgctatttacaggtcacctgaagtgccgtctccgcatggacaaactgcagcttaagggcatgagttattctatgtgtaccgggaaattcaaggtagttaaggagattgccgaaacacaacatggaactatcgtgatcagagtccagtacgagggcgacggttccccatgcaaaattcccttcgagatcatggatctggaaaagaggcacgtgttggggcggctcattaccgtcaatccgatagtgacggagaaagacagccctgttaacatcgaagctgagcccccatttggcgattcgtacattatcatcggagtggaacctggccagctgaagttatcttggttcaaaaaggggtcctcaattggacagatgtttgagaccacaatgcgaggtgccaagcgcatggcaatactgggcgacactgcctgggatttcgggagtctaggaggcgtatttaccagcatcggtaaagctctccatcaagtcttcggggcgatttatggcgcagccttttccggagtgtcttggacaatgaagatcctgattggcgttgtgatcacttggatagggatgaatagcagatcaaccagtctttccgtcagcttggtgctggtaggagtggttacgctctacctgggcgtcatggtgcaggctgactctggttgtgtggtctcatggaaaaacaaggagcttaaatgcgggagtggaatcttcattacagataatgttcacacctggactgaacagtataagtttcagcccgagagcccatccaagctggcctctgcaatccaaaaagcccacgaagagggcatttgtggtatcaggtcggtgacacggttggaaaacctcatgtggaagcagataacccccgagctgaatcatattttaagcgagaacgaagtgaaactgactatcatgaccggcgacattaaggggatcatgcaggctggaaaacgctccctaagacctcagccaacagagctcaagtactcatggaaaacgtggggcaaggccaagatgctgagtaccgaacttcacaatcatactttcttgatagatgggccggagacagcagaatgccccaacaccaatagggcgtggaactctctggaggtagaggactatggatttggcgtcttcacaactaatatctggctcaaactgaaggaacgtcaagatgtgttttgtgacagcaaattaatgtccgctgccattaaggacaaccgggcagttcacgccgatatgggttactggatcgagtcagctctgaacgacacctggaaaattgaaaaggccagcttcatcgaggtgaagtcttgccactggcctaaatcccatacgctttggagtaatggggtcttggagagcgaaatgataattccaaagaacttcgcaggacccgtgtctcagcacaattatcgacctggctaccatacacagaccgctggtccatggcacctcggcagactggagatggattttgacttctgtgaagggactaccgttgtggtaacagaggattgcggaaacaggggcccctccctacgcactaccacagcctcagggaaactgatcacggaatggtgctgtcggagttgcaccctcccgcctctgagatacaggggagaggacggctgttggtatggtatggagatccgcccacttaaggaaaaagaggaaaatttggtcaacagcctggtgactgcggggcatggacagattgataatttttcgttaggcgtgctcggtatggccctgttccttgaggaaatgctgcgaacacgggtcggcaccaagcacgctatcttgctcgttgcagtgtcctttgtaactctgattacagggaacatgtctttccgtgacctaggaagagtgatggtcatggtgggcgccgctatgaccgatgacatagggatgggagttacgtacctggccctcctggcagcgtttaaggtgaggcccactttcgccgctggccttttgctgcgcaaattaaccagcaaggagctcatgatgacaaccatcggtattgtcctgctttcacaaagtactatgcctgagacaatcctggaactaaccgatgccctcgcactggggatgatggtgttgaaaattgttcggaatatggagaagtatcagctggctgtgacaatcatggccatattatgcgtccccaacgcagtaatcctccagaatgcctggaaagtgtcctgtactaccctggctgttgtgtctgtcagcccacttctgttgacgtcctcacaacagaaggcggactggattcctctcgccctgacaatcaagggactaaaccccaccgcaatttttctgactacccttagcagaacaagtaaaaagaggtcttggccactcaatgaagctatcatggccgtgggcatggtatccatactggccagctcgttgctgaaaaacgatattccgatgactggccctttagtggctgggggactcctgaccgtctgctacgttcttacgggtcgatcagcagacctggagttggaacgcgccgcggacgtgcggtgggaggagcaggctgaaatctctggcagttcccccatcctcagcattacaatatctgaggatgggagcatgtccatcaagaatgaagaggaggaacagaccctgactattctaatcagaacaggactgcttgtgatttcaggcctcttcccagtcagtatccccataaccgccgcagcctggtatctgtgggaggtgaaaaagcaaagggctggtgttttgtgggacgtacctagcccaccccctgtggggaaagcagaattagaggatggagcctaccgtatcaagcagaagggcattctgggctattctcagatcggggcgggagtctacaaagaaggtacttttcacacaatgtggcatgtgacccgcggcgctgttctcatgcacaaggggaaacggattgagccgtcctgggccgacgtgaagaaagatctgatctcatacggaggcggttggaagcttgagggggaatggaaggagggagaagaggtccaggtgctggcattggaaccaggcaaaaaccccagagccgtacaaacgaagcctggcctattcaaaactaacaccgggacaataggagctgtcagtctggactttagcccaggtacctccggctctcccattgtggataagaaagggaaggttgtgggactctatggcaatggtgtcgtgacaaggtcggggacttacgttagcgccatcgcacagaccgagaagtcaatcgaggacaaccctgaaattgaggatgacatcttccgaaaaaagcggctgacgataatggatcttcatccgggagctggcaaaacaaagcgctatttacccgccattgtgagagaagcgatcaaaaggggcctgcggactctcattttggccccaacccgagtcgtggcagctgagatggaagaggccctgagagggctccctatccgctaccagacacccgctataagggcagagcacaccggacgtgaaattgtagacctgatgtgtcatgccactttcaccatgcggcttctgtccccaatcagagtgcctaattataacttgatcattatggatgaggcccactttacagaccccgctagtatcgcggcaaggggttacatttctacgcgcgttgaaatgggcgaggccgctgggatattcatgactgccaccccaccgggaagccgagacccttttccccagtccaatgcaccaatcatggatgaggaaagagagattcccgaacggtcatggaactctggccacgagtgggtcacagacttcaagggtaagaccgtgtggtttgtgcctagcatcaaagccgggaatgatatcgctgcgtgcctaaggaagaacggaaaaaaggtcattcaactgagtcgcaaaactttcgactccgaatatataaagacacgtaccaatgattgggactttgtagtgacgactgatatcagcgagatgggcgccaacttcaaggcagagagagttattgacccacggaggtgtatgaaacccgtgatcctcacagatggcgaagagcgcgtcattttagctgggcctatgccggtgacccattcttcagccgcacagcgaagaggacgggttggtaggaatccaaagaacgaaaatgaccagtacatctacatgggcgagcccctggaaaacgatgaggactgcgcccactggaaagaggctaagatgcttctggacaatatatccacccctgaagggatcattcccagtatgtttgagccagaacgcgagaaagtggatgccatcgacggagaatatagactcaggggcgaggcgcggaagactttcgtcgatttgatgcgtcgcggtgacctgcctgtgtggctcgcataccgagtagccgctgaggggattaactatgccgatagaaggtggtgttttgacggcgtgaaaaacaatcaaatcctggaagagaacgttgaagtcgagatatggacaaaggagggagaacggaagaaacttaagccccgctggctagatgctagaatttacagcgacccactggcattgaaagagttcaaggaattcgccgctggcaggaaatcgttaaccctgaatctcatcacagagatggggcggctgcctacttttatgacgcagaaggcccgaaacgcacttgataatctggcggtgctccataccgccgaagctggaggtagagcctataaccacgcattgtctgagctgccggagacactagaaactctgctccttctgaccttattggctgccgtgacaggcgggattttcctgtttctcatgtccggaaagggcatcggtaaaatgaccctggggatgtgctgcataatcactgcaagcattcttctgtggtacgcccagatccagccccactggattgctgcgtcaatcatactcgagttctttttgattgtcctgttaatcccagaacctgagaagcaacgcacgccccaggacaatcagctaacctatgttgtgatcgccattctgacagtagtggcagctactatggccaacgaaatgggcttcctcgagaaaaccaagaaagattttggacttggcagtacaaccactcagcaaccagagtctaatatcctggacatagatttgaggcctgcctccgcatggacactgtacgctgtcgccacgaccttcattactcccatgctccggcatagcatcgaaaactcaagtgtgaatgttagcctgacagcgattgctaaccaggccaccgtgcttatggggctcggaaagggttggccgctgtccaagatggacatcggcgtcccattgctggcaatagggtgttactctcaggtaaatcctatcaccttaacagccgctctactgctccttgtggcacactatgccattatcggacccggcctgcaggcgaaagctactcgtgaggcccaaaagagagcagccgctggtattatgaaaaacccaacggttgacgggatcaccgtgattgatttggaccccatcccttacgatccgaagtttgaaaaacagctgggccaggtcatgctcctggtgctttgcgtcacacaggtgttaatgatgaggactacctgggccctgtgtgaggcactcacattggctaccggacccataagcactctgtgggaaggcaatccagggcgcttctggaacacgacaattgccgtttccatggcgaatatctttcggggatcatatctagccggcgcaggtctgctcttctctatcatgaagaacaccgctaacactcgaagagggaccggaaatacaggcgagactcttggtgagaagtggaaaaacaggctgaatgccttgggcaagagtgaatttcaaatttacaaaaagtcggggatacaggaggtggaccgcaccctggcaaaagaaggaatcaagcggggcgagacagatcatcacgctgtaagcagagggtccgccaaactccgttggttcgtggagaggaacctggtcacgcctgaaggaaaggttgtggacttaggctgcggtcgggggggatggtcttattactgtggcggtcttaagaatgtcaaagaggtgaagggcctgaccaaagggggacccggccatgaagagcctattccaatgtcaacttatgggtggaacctcgtacgcctacagagcggagtggatgttttctttacaccccctgaaaagtgcgacaccctgttgtgtgatatcggcgagtccagtccaaatcccactgtggaggccggtcgaacactgagagtcctcaaccttgtggaaaattggctgaacaataacacccaattctgcattaaagtcttgaatccgtacatgccttctgtgatcgagaagatggaagcgctgcagaggaagtacgggggagctctcgttcggaacccattaagccgcaattcaacgcacgagatgtattgggtatccaacgcaagtggcaacatagtgagctctgtcaatatgatctccagaatgctgattaacaggtttaccatgcgacacaaaaaggccacatacgaacccgacgtggatcttggctcagggactcggaatatcggaattgagagcgagacccctaacctggacatcataggtaaacgtattgaaaagatcaaacaggagcatgaaacatcgtggcactatgatcaggaccatccatacaagacttgggcttatcacggctcttacgagaccaagcaaacagggagtgcctccagcatggttaatggagtggtcagactactcaccaaaccctgggacgtgatcccgatggtaactcagatggcaatgacggatacaacccctttcggccagcagcgcgtgtttaaggaaaaagttgacactaggacccaagagcccaaggagggtacaaaaaagctgatgaagattacggccgaatggttgtggaaagagctggggaagaaaaagaccccacggatgtgtactagagaagagttcacacgcaaagtcaggtcaaacgctgcgctcggagccatatttaccgatgagaataagtggaaatccgcacgagaagctgtggaggactctggcttctgggaacttgtggataaggagcggaacctgcacttagaaggcaagtgcgagacttgtgtctataatatgatggggaaaagagagaagaaactgggagaatttggtaaggccaaaggcagcagggcaatctggtacatgtggttgggggcccgcttcctcgagtttgaagctctgggattcctaaacgaggaccattggtttagtcgtgaaaattcccttagcggcgttgagggtgaggggctgcacaagctcggatacattctgcgggatgtgtctaagaaagaaggcggcgccatgtatgcggacgatacagcagggtgggacaccagaatcacattggaggatctgaagaacgaagagatggtaactaatcatatggaaggagagcacaaaaagctcgccgaggctattttcaaacttacctaccagaacaaggtggtcagggtgcagcgccctacgccccgaggtaccgttatggacatcatatcacggagagaccagaggggcagtgggcaagtggtcacatatggactgaatactttcaccaacatggaagcccagttaatccgccagatggagggcgaaggtgtgtttaagtccattcaacagctgacagtaactgaggagatcgcagttaaaaactggttggtgagagtcgggcgggaaaggctcagccgtatggctatttctggagatgactgcgtggtgaagccactggatgaccgattcgcctcggctctaaccgcccttaatgatatgggcaaagtccgcaaggacatccagcagtgggagccctcaagaggctggaacgattggacgcaagttcctttttgcagccatcacttccacgaactgattatgaaagacgggcgggtgctcgtagtgccatgtaggaatcaggatgagctgataggacgcgcaagaatctcccagggtgcgggctggagtttgcgggaaacagcctgcttagggaagtcttacgctcagatgtggaacctgatgtattttcataggcgagacctccgtcttgccgcaaatgctatttgtagcgccgtcccgtcccactgggtgcccacctcaagaactacatggagtatccatgcaacccacgagtggatgactaccgaggatatgctgacagtttggaaccgcgtgtggatccaagaaaatccttggatggaggacaagacgccagtcgaatcttgggaggaaattccctacctaggaaaacgggaggatcagtggtgcggcagcctgataggtctcacctccagggccacttgggcgaagaacatccagacagctattaatcaggtgagatcattgatcgggaacgaggaatataccgactacatgcctagcatgaaacgcttccggagggaggaagaggaagccggagtactgtggtga

SEQ ID NO: 14894 - RNA, 9876 nt, synthetic construct
  misc_feature 1..9876: note = derived and/or modified CDS sequence (opt3) from DENV-2__KP723478__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtggccccatctatgacaatgagatgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaacaccctgcgacgctgcggaagtactgcattgaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaagatcgtccagcctgaaaacctagagtatacaattgttataaccccacactccggagaagagaatgccgtgggtaacgatactggcaaacatgggaaggagatcaaagtaacgccgcagtcaagtattacagaagcagagctcaccggatacggcactgtgaccatggaatgtagccccaggacaggtctggacttcaatgagatggtccttctgcagatggaaaacaaggcttggttggtgcaccggcaatggtttctcgatctgcctttaccatggctgcccggggccgacacccagggctctaactggatccagaaagagactctcgttacattcaagaatcctcacgcgaagaaacaggatgtggtcgtgcttggatcccaagagggcgccatgcatacggcactgaccggggctactgaaatacagatgtcaagcggaaacttgctatttacaggtcacctgaagtgccgtctccgcatggacaaactgcagcttaagggcatgagttattctatgtgtaccgggaaattcaaggtagttaaggagattgccgaaacacaacatggaactatcgtgatcagagtccagtacgagggcgacggttccccatgcaaaattcccttcgagatcatggatctggaaaagaggcacgtgttggggcggctcattaccgtcaatccgatagtgacggagaaagacagccctgttaacatcgaagctgagcccccatttggcgattcgtacattatcatcggagtggaacctggccagctgaagttatcttggttcaaaaaggggtcctcaattggacagatgtttgagaccacaatgcgaggtgccaagcgcatggcaatactgggcgacactgcctgggatttcgggagtctaggaggcgtatttaccagcatcggtaaagctctccatcaagtcttcggggcgatttatggcgcagccttttccggagtgtcttggacaatgaagatcctgattggcgttgtgatcacttggatagggatgaatagcagatcaaccagtctttccgtcagcttggtgctggtaggagtggttacgctctacctgggcgtcatggtgcaggctgactctggttgtgtggtctcatggaaaaacaaggagcttaaatgcgggagtggaatcttcattacagataatgttcacacctggactgaacagtataagtttcagcccgagagcccatccaagctggcctctgcaatccaaaaagcccacgaagagggcatttgtggtatcaggtcggtgacacggttggaaaacctcatgtggaagcagataacccccgagctgaatcatattttaagcgagaacgaagtgaaactgactatcatgaccggcgacattaaggggatcatgcaggctggaaaacgctccctaagacctcagccaacagagctcaagtactcatggaaaacgtggggcaaggccaagatgctgagtaccgaacttcacaatcatactttcttgatagatgggccggagacagcagaatgccccaacaccaatagggcgtggaactctctggaggtagaggactatggatttggcgtcttcacaactaatatctggctcaaactgaaggaacgtcaagatgtgttttgtgacagcaaattaatgtccgctgccattaaggacaaccgggcagttcacgccgatatgggttactggatcgagtcagctctgaacgacacctggaaaattgaaaaggccagcttcatcgaggtgaagtcttgccactggcctaaatcccatacgctttggagtaatggggtcttggagagcgaaatgataattccaaagaacttcgcaggacccatgtctcagcacaattatcgacctggctaccatacacagaccgctggtccatggcacctcggcagactggagatggattttgacttctgtgaagggactaccgtggttgtgacagaggattgcggaaacaggggcccctccctacgcactaccacagcctcagggaaactgatcacggaatggtgctgtcggagttgcaccctcccgcctctgagatacaggggagaggacggctgttggtatggtatggagatccgcccacttaaggaaaaagaggaaaatttggtaaacagcctggtcactgcggggcatggacagattgataatttttcgttaggcgtgctcggtatggccctgttccttgaggaaatgctgcgaacacgggtgggcaccaagcacgctatcttgctcgtcgcagtttcctttgtgactctgattacagggaacatgtctttccgtgacctaggaagagtaatggtgatggtcggcgccgctatgaccgatgacatagggatgggagtgacgtacctggccctcctggcagcgtttaaggttaggcccactttcgccgctggccttttgctgcgcaaattaaccagcaaggagctcatgatgacaaccatcggtattgtgctgctttcacaaagtactatgcctgagacaatcctggaactaaccgatgccctcgcactggggatgatggtcttgaaaattgtgcggaatatggagaagtatcagctggctgttacaatcatggccatattatgcgtgcccaacgcagtcatcctccagaatgcctggaaagtatcctgtactaccctggctgtggtttctgtgagcccacttctgttgacgtcctcacaacagaaggcggactggattcctctcgccctgacaatcaagggactaaaccccaccgcaatttttctgactacccttagcagaacaagtaaaaagaggtcttggccactcaatgaagctatcatggccgtcggcatggtgtccatactggccagctcgttgctgaaaaacgatattccgatgactggccctttagtagctgggggactcctgaccgtgtgctacgtccttacgggtcgatcagcagacctggagttggaacgcgccgcggacgttcggtgggaggagcaggctgaaatctctggcagttcccccatcctcagcattacaatatctgaggatgggagcatgtccatcaagaatgaagaggaggaacagaccctgactattctaatcagaacaggactgcttgtgatttcaggcctcttcccagtgagtacccccatcactgccgcagcctggtatctgtgggaggtcaaaaagcaaagggctggtgtgttgtgggacgttcctagcccaccccctgtagggaaagcagaattagaggatggagcctaccgtataaagcagaagggcatcctgggctattctcagattggggcgggagtgtacaaagaaggtacatttcacaccatgtggcatgtcacgcgcggcgctgtgctcatgcacaaggggaaacggatcgagccgtcctgggccgacgttaagaaagatctgatttcatacggaggcggttggaagcttgagggggaatggaaggagggagaagaggtgcaggtcctggcattggaaccaggcaaaaaccccagagccgtgcaaactaagcctggcctattcaaaaccaacacagggaccatcggagctgtaagtctggactttagcccaggtacatccggctctcccatagtcgataagaaagggaaggtggttggactctatggcaatggtgtggtcactaggtcggggacctacgtgagcgccattgcacagacggagaagtcaatcgaggacaaccctgaaatcgaggatgacattttccgaaaaaagcggctgacaatcatggatcttcatccgggagctggcaaaactaagcgctatttacccgccatagttagagaagcgattaaaaggggcctgcggaccctcatcttggccccaacacgagtggtcgcagctgagatggaagaggccctgagagggctccctattcgctaccagacccccgctatcagggcagagcacactggacgtgaaatagtggacctgatgtgtcatgccaccttcacaatgcggcttctgtccccaattagagtacctaattataacttgatcatcatggatgaggcccactttacggaccccgctagtattgcggcaaggggttacatctctactcgcgtggaaatgggcgaggccgctgggattttcatgaccgccacaccaccgggaagccgagacccttttccccagtccaatgcaccaataatggatgaggaaagagagatccccgaacggtcatggaactctggccacgagtgggttaccgacttcaagggtaagactgtctggtttgtgcctagcattaaagccgggaatgatatcgctgcgtgcctaaggaagaacggaaaaaaggtgatccaactgagtcgcaaaacattcgactccgaatatattaagacccgtacgaatgattgggactttgtcgtaactacagatataagcgagatgggcgccaacttcaaggcagagagagtgatcgacccacggaggtgtatgaaacccgttattctcaccgatggcgaagagcgcgtgatcttagctgggcctatgccggtcacccattcttcagccgcacagcgaagaggacgggtgggtaggaatccaaagaacgaaaatgaccagtacatttacatgggcgagcccctggaaaacgatgaggactgcgcccactggaaagaggctaagatgcttctggacaatatctccactcctgaagggataatccccagtatgtttgagccagaacgcgagaaagttgatgccattgacggagaatatagactcaggggcgaggcgcggaagacattcgtggatttgatgcgtcgcggtgacctgcctgtctggctcgcataccgagtggccgctgaggggatcaactatgccgatagaaggtggtgttttgacggcgtaaaaaacaatcaaattctggaagagaacgtggaagttgagatctggaccaaggagggagaacggaagaaacttaagccccgctggctagatgctagaatatacagcgacccactggcattgaaagagttcaaggaattcgccgctggcaggaaatcgttaacactgaatctcattactgagatggggcggctgcctacgtttatgacccagaaggcccgaaacgcacttgataatctggcggtcctccatacagccgaagctggaggtagagcctataaccacgcattgtctgagctgccggagactctagaaaccctgctccttctgacattattggctgccgtgaccggcgggatcttcctgtttctcatgtccggaaagggcattggtaaaatgactctggggatgtgctgcatcataacggcaagcatccttctgtggtacgcccagattcagccccactggatcgctgcgtcaattatcctcgagttctttttgatagtgctgttaattccagaacctgagaagcaacgcaccccccaggacaatcagctaacatatgtcgttatcgccatcctgactgtggtagcagctaccatggccaacgaaatgggcttcctcgagaaaacaaagaaagattttggacttggcagtaccactacacagcaaccagagtctaatattctggacatcgatttgaggcctgcctccgcatggacgctgtacgctgtggccaccactttcataacacccatgctccggcatagcattgaaaactcaagtgtcaatgtgagcctgaccgcgatcgctaaccaggccaccgttcttatggggctcggaaagggttggccgctgtccaagatggacattggcgtgccattgctggcaatcgggtgttactctcaggtcaatcctataacattaactgccgctctactgctccttgtagcacactatgccatcattggacccggcctgcaggcgaaagctacgcgtgaggcccaaaagagagcagccgctggtatcatgaaaaacccaaccgtggacgggattacagttatcgatttggaccccattccttacgatccgaagtttgaaaaacagctgggccaggtgatgctcctggtcctttgcgtgactcaggtcttaatgatgaggaccacatgggccctgtgtgaggcactcaccttggctactggacccatcagcacgctgtgggaaggcaatccagggcgcttctggaacacaaccatagccgtgtccatggcgaatatttttcggggatcatatctagccggcgcaggtctgctcttctctatcatgaagaacactgctaacacccgaagagggacaggaaatactggcgagacccttggtgagaagtggaaaaacaggctgaatgccttgggcaagagtgaatttcaaatctacaaaaagtcggggattcaggaggttgaccgcacactggcaaaagaaggaataaagcggggcgagacggatcatcacgctgtgagcagagggtccgccaaactccgttggttcgtagagaggaacctggtgacccctgaaggaaaggtcgttgacttaggctgcggtcgggggggatggtcttattactgtggcggtcttaagaatgtgaaagaggtcaagggcctgactaaagggggacccggccatgaagagcctatcccaatgtcaacatatgggtggaacctcgtgcgcctacagagcggagtagatgtgttctttaccccccctgaaaagtgcgacactctgttgtgtgatattggcgagtccagtccaaatcccacagttgaggccggtcgaaccctgagagtgctcaaccttgtcgaaaattggctgaacaataacacgcaattctgcatcaaagtgttgaatccgtacatgccttctgtcattgagaagatggaagcgctgcagaggaagtacgggggagctctcgtgcggaacccattaagccgcaattcaacccacgagatgtattgggtttccaacgcaagtggcaacatcgtaagctctgtgaatatgatatccagaatgctgatcaacaggtttacaatgcgacacaaaaaggccacttacgaacccgacgtcgatcttggctcagggacccggaatattggaatcgagagcgagacacctaacctggacattatcggtaaacgtatagaaaagattaaacaggagcatgaaacttcgtggcactatgatcaggaccatccatacaagacctgggcttatcacggctcttacgagacaaagcaaaccgggagtgcctccagcatggtgaatggagttgtgagactactcactaaaccctgggacgtcatcccgatggtgacgcagatggcaatgacagataccactcctttcggccagcagcgcgtatttaaggaaaaagtggacaccaggacacaagagcccaaggagggtacgaaaaagctgatgaagatcaccgccgaatggttgtggaaagagctggggaagaaaaagactccacggatgtgtacaagagaagagttcacccgcaaagttaggtcaaacgctgcgctcggagccatttttactgatgagaataagtggaaatccgcacgagaagctgtcgaggactctggcttctgggaacttgtggataaggagcggaacctgcacttagaaggcaagtgcgagacatgtgtgtataatatgatggggaaaagagagaagaaactgggagaatttggtaaggccaaaggcagcagggcaatatggtacatgtggttgggggcccgcttcctcgagtttgaagctctgggattcctaaacgaggaccattggtttagtcgtgaaaattcccttagcggcgtcgagggtgaggggctgcacaagctcggatacatcctgcgggatgtttctaagaaagaaggcggcgccatgtatgcggacgataccgcagggtgggacacaagaattactttggaggatctgaagaacgaagagatggtgaccaatcatatggaaggagagcacaaaaagctcgccgaggctatcttcaaacttacgtaccagaacaaggtagtgagggtccagcgccctaccccccgaggtacagtgatggacattatctcacggagagaccagaggggcagtgggcaagttgtgacttatggactgaataccttcacaaacatggaagcccagttaatacgccagatggagggcgaaggtgtctttaagtccatccaacagctgactgtgaccgaggagattgcagtaaaaaactggttggttagagtggggcgggaaaggctcagccgtatggctatctctggagatgactgcgtcgtgaagccactggatgaccgattcgcctcggctctaacggcccttaatgatatgggcaaagtgcgcaaggacattcagcagtgggagccctcaagaggctggaacgattggacacaagtccctttttgcagccatcacttccacgaactgatcatgaaagacgggcgggttctcgtggtaccatgtaggaatcaggatgagctgattggacgcgcaagaatatcccagggtgcgggctggagtttgcgggaaaccgcctgcttagggaagtcttacgctcagatgtggaacctgatgtattttcataggcgagacctccgtcttgccgcaaatgctatctgtagcgccgtgccgtcccactgggtccccacttcaagaacaacctggagtattcatgcaactcacgagtggatgaccacagaggatatgctgacggtgtggaaccgcgtttggatccaagaaaatccttggatggaggacaagaccccagtggaatcttgggaggaaatcccctacctaggaaaacgggaggatcagtggtgcggcagcctgattggtctcacttccagggccacatgggcgaagaacatacagaccgctatcaatcaggtcagatcattgattgggaacgaggaatatactgactacatgcctagcatgaaacgcttccggagggaggaagaggaagccggagtgctgtggtga

SEQ ID NO: 14895 - RNA, 9876 nt, synthetic construct
  misc_feature 1..9876: note = derived and/or modified CDS sequence (opt3) from DENV-2__KP723479__SS-prME
  source 1..9876: mol_type = other RNA
accgcaggaatcattataatgatgatccccaccgtgatggctttccacctgactacgcgaaacggggagcctcatatgattgtcagcaggcaggaaaagggaaaatccctcctttttaagaccgagaatggtgttaacatgtgcaccctgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtggccccatctatgacaatgcggtgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaacaccctgcgacgctgcggaagtactgcattgaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaagatcgtccagcctgaaaacctagagtatacaattgttataaccccacactccggagaagagaatgccgtgggtaacgatactggcaaacatgggaaggagatcaaagtaacgccgcagtcaagtattacagaagcagagctcaccggatacggcactgtgaccatggaatgtagccccaggacaggtctggacttcaatgagatggtccttctgcagatggaaaacaaggcttggttggtgcaccggcaatggtttctcgatctgcctttaccatggctgcccggggccgacacccagggctctaactggatccagaaagagactctcgttacattcaagaatcctcacgcgaagaaacaggatgtggtcgtgcttggatcccaagagggcgccatgcatacggcactgaccggggctactgaaatacagatgtcaagcggaaacttgctatttacaggtcacctgaagtgccgtctccgcatggacaaactgcagcttaagggcatgagttattctatgtgtaccgggaaattcaaggtagttaaggagattgccgaaacacaacatggaactatcgtgatcagagtccagtacgagggcgacggttccccatgcaaaattcccttcgagatcatggatctggaaaagaggcacgtgttggggcggctcattaccgtcaatccgatagtgacggagaaagacagccctgttaacatcgaagctgagcccccatttggcgattcgtacattatcatcggagtggaacctggccagctgaagttatcttggttcaaaaaggggtcctcaattggacagatgtttgagaccacaatgcgaggtgccaagcgcatggcaatactgggcgacactgcctgggatttcgggagtctaggaggcgtatttaccagcatcggtaaagctctccatcaagtcttcggggcgatttatggcgcagccttttccggagtgtcttggacaatgaagatcctgattggcgttgtgatcacttggatagggatgaatagcagatcaaccagtctttccgtcagcttggtgctggtaggagtggttacgctctacctgggcgtcatggtgcaggctgactctggttgtgtggtctcatggaaaaacaaggagcttaaatgcgggagtggaatcttcattacagataatgttcacacctggactgaacagtataagtttcagcccgagagcccatccaagctggcctctgcaatccaaaaagcccacgaagagggcatttgtggtatcaggtcggtgacacggttggaaaacctcatgtggaagcagataacccccgagctgaatcatattttaagcgagaacgaagtgaaactgactatcatgaccggcgacattaaggggatcatgcaggctggaaaacgctccctaagacctcagccaacagagctcaagtactcatggaaagcctggggcaaggcaaagatgctgagtacggaacttcacaatcataccttcttgatagatgggccggagactgcggaatgccccaacacaaatagggcttggaactctctggaggtagaggactatggatttggcgtcttcaccacaaatatctggctcaaaatgaaggaacgtcaagatgtgttttgtgacagcaaactgatgtccgccgcaattaaggactcacgggccgttcacgctgatatgggttactggatcgagagcgccttaaacgacacttggaaaattgaaaaggcatctttcatcgaggtgaagtcctgccactggcctaaaagtcataccctgtggagcaacggggtccttgagtctgaaatgataattccaaagaatttcgctggacccgtgtcccagcacaactatcgacctggctaccatacgcagacagccggtccatggcacttgggcagactcgagatggattttgacttctgtgaagggaccactgttgtggtaaccgaggattgcggaaataggggcccctcactgcgcacaactaccgcgagtgggaaactaatcacagaatggtgctgtcggagctgcacgctgccgcctctcagatacaggggagaggacggctgttggtatggtatggagatccgcccactgaaggaaaaagaggaaaaccttgtcaattcgttggtgaccgccgggcatggacagattgataacttttccctgggcgtgttaggtatggctctcttcctggaggaaatgcttcgaactcgggtcggcacaaagcacgcaatcctgttggttgccgtgtcttttgtaaccctcattactgggaatatgagcttccgtgacctgggaagagtgatggtcatggtgggcgctacaatgaccgatgacatagggatgggagttacgtacctagccctgctcgcagcgtttaaggtgaggcccactttcgccgctggcctgcttttgcgcaaactgacctcaaaggagttaatgatgacaaccatcggtattgtcctcctgagtcaagccactatccctgagacaattcttgaactgaccgatgcactagctctcgggatgatggtgctgaaaatcgttcggaacatggagaagtatcagttggccgtgacaataatggcaatcctgtgcgtccccaatgccgtaattttacagaacgcttggaaagtgtcctgtactaccctcgcggttgtgtctgtcagcccactgcttctgacgtcctcacaacagaaggccgactggatccctttggcactcacaattaagggactgaatcccaccgctatctttctaactaccctgagcagaacaaacaaaaagaggagttggccacttaatgaagccataatggccgtgggcatggtatctattctcgcttccagcctgttgaaaaacgatatcccgatgactggccctctggtggcagggggattactcaccgtctgctacgttctgacgggtcgatcggccgaccttgagctggaacgcgcggctgacgtgcggtgggaggagcaggccgaaatctcaggctctagtcccattttgtccataacaatcagcgaggatgggtctatgagcattaagaatgaagaggaggaacagaccctcactatcctgattagaacaggactactggtggtctccggccttttcccagtgtcaacccccatcactgcagccgcttggtatctctgggaggttaaaaagcaaagggccggtgtactgtgggacgtgcctagtccaccccctgtcgggaaagccgaattggaggatggagcgtaccgtataaagcagaagggcatcttaggctatagccagattggggctggagtgtacaaagaaggtacatttcacaccatgtggcatgttacgcgcggcgccgtgctgatgcacaaggggaaacggatcgagccgtcttgggcagacgtcaagaaagatctcatttcctacggaggcggttggaagctggagggggaatggaaggagggagaagaggtgcaggtacttgccctggaaccaggcaaaaaccccagagctgtccaaactaagcctggcttgttcaaaaccaacacagggaccatcggagccgtgtcactagactttagtccaggtacaagcggctcccccatagttgataagaaagggaaggtggtcggactgtatggcaatggtgtggttactaggtctgggacctacgtgtcggcaattgctcagacggaaaagagcatcgaggacaaccctgaaatcgaggatgacattttccggaaaaagagactcacaatcatggatctgcatccgggagccggcaaaactaagcgctatcttcccgcgatagtcagagaagccattaaaaggggcttacggaccctgatcctcgcaccaacacgagtggtagctgccgagatggaagaggctttgagagggctgcctattcgctaccagacccccgcaatcagggccgagcacactggacgtgaaatagtggacctcatgtgtcatgccaccttcacaatgcggctgctttcaccaattagagttcctaattataacctgatcatcatggatgaggctcactttacggaccccgcgtccattgcagccaggggttacatcagtactcgcgtcgaaatgggcgaggctgccgggattttcatgaccgcaacaccaccgggatctcgagacccttttccccagagcaatgccccaataatggatgaggaaagagagatccccgaacggtcctggaactcaggccacgagtgggtgaccgacttcaagggtaagactgtgtggtttgtcccttctattaaagctgggaatgatatcgcggcctgcttgaggaagaacggcaaaaaggtaatccaactaagccgcaaaacattcgacagtgaatatattaagacccgtacgaatgattgggactttgtggttactacagatatatccgagatgggcgcaaacttcaaggctgagagagtgatcgacccacggaggtgtatgaaacccgtcattctgaccgatggcgaggaacgcgtgatcctcgccgggcctatgccggttacccatagctctgcagcccagcgaagaggacgggtgggtaggaatccaaagaacgaaaatgaccagtacatttacatgggcgagcccttagaaaacgatgaggactgcgctcactggaaagaggccaagatgctgcttgacaatatcaacactcctgaagggataatcccctcaatgtttgagccagaacgcgagaaagtcgatgcgattgacggagaatatagactgaggggcgaggcacggaagacattcgtggatctcatgcgtcgcggtgacttgcctgtatggctggcctaccgagtggctgccgaggggatcaactatgctgatagaaggtggtgttttgacggcgttaaaaataaccaaattctcgaagagaatgtcgaagtggagatctggaccaaggagggagaacggaagaaactgaagccccgctggcttgatgcaagaatatactccgacccactagccctgaaagagttcaaggagttcgctgccggcaggaaaagtttgacattaaacctgattactgagatggggcggctccctacgtttatgacccagaaggcacgaaatgcgctggataaccttgccgtgctgcatacagctgaagccggaggtagagcatataatcacgctctcagcgagttgccggagactctggaaaccctactgctccttacactgttagccaccgtcactggcgggatcttcttgtttctgatgtcgggaaagggcattggtaaaatgacgctcgggatgtgctgcatcataaccgcatctatcctgctttggtacgcccagattcagccccactggatcgctgcgtccattatcctggagttctttctcatagttttgctgattccagaacctgagaagcaacgcacaccccaggacaaccagttaacttatgtggtaatcgccatcctaaccgtggtcgcagctacaatggccaatgaaatgggcttcctggagaaaaccaagaaagattttggactcggcagcattactacacagcaaccagagaacaatatccttgacatagatctgaggcctgcctcagcatggacgttgtacgctgtggccaccactttcattacacccatgctgcggcatagtatcgaaaactcttccgttaatgtgagcctcaccgcgattgctaaccaggccaccgtcctgatggggcttggaaagggttggccgctctcaaagatggacatcggcgtaccactgttggcaatagggtgttacagtcaggtgaatcctatcacactgactgccgctttactactgctcgttgcacactatgccattatcggacccggccttcaggcgaaagctacgcgtgaggcccaaaagagagcagccgctggtattatgaaaaacccaaccgtggacgggatcacagtcattgatctggaccccatcccttacgatccgaagtttgaaaaacagttgggccaggtgatgctgctcgtcctgtgcgtgactcaggttcttatgatgaggaccacatgggccttatgtgaggcactgaccctcgctactggacccataagcacgttgtgggaaggcaatccagggcgcttctggaacacaaccattgccgtgtccatggcgaacatctttcggggatcttatctggccggcgcaggtctactgttcagcatcatgaagaatactgctaacacccgaagagggacaggaaatactggcgagaccctcggtgagaagtggaaaaacaggcttaatgccctgggcaagtccgaatttcaaatttacaaaaagtcagggatacaggaggtagaccgcacattggcaaaagaaggaatcaagcggggcgagacggatcatcacgctgtgtctagagggagtgccaaactgcgttggttcgtcgagaggaacctcgttacccctgaaggaaaggtggtcgacctgggctgcggtagaggcgggtggtcgtattactgtgggggtttaaagaatgtgaaagaggtaaagggccttactaaagggggacccggccatgaggaacctattccaatgagcacatatgggtggaacctggtgcgcctccagtccggagttgatgtgttctttacaccccctgaaaagtgcgacactctactgtgtgatatcggcgagtcttcaccaaatcccacagtcgaggccggtcgaaccttgagagtgctgaacctcgtcgaaaattggcttaacaataacacgcaattctgcattaaagtgctgaatccgtacatgcctagcgttatcgagaagatggaagcgttgcagaggaagtacgggggagctctggtacggaacccactctcccgcaacagtacccacgagatgtattgggtgtctaatgcaagcggcaacatagtctcatccgtgaatatgatcagtagaatgttaattaacaggtttacaatgcgacacaaaaaggccacttacgaacccgacgttgatctgggcagcgggacccggaatatcggaattgagtctgagacacctaaccttgacatcataggtaaacgtattgaaaagatcaaacaggagcatgaaacttcctggcactatgatcaggaccatccatacaagacctgggcttatcacggctcatacgagacaaagcaaaccgggagcgcctcgtctatggtgaatggagtcgtgagactgctaactaaaccctgggacgtaatcccgatggtgacgcagatggcaatgacagataccactcctttcggccagcagcgcgtttttaaggaaaaagtcgacaccaggacacaagagcccaaggagggtacgaaaaagctcatgaagattaccgccgaatggctgtggaaagagttggggaagaaaaagactccacggatgtgtacaagagaagagttcacccgcaaagtgaggagtaacgctgcgctgggagccatatttactgatgagaataagtggaaatccgcacgagaagctgtggaggacagcggcttctgggaactcgtcgataaggagcggaaccttcacctggaaggcaagtgcgagacatgtgtttataatatgatggggaaaagagagaagaaattaggagaatttggtaaggccaaaggctcaagggcaatctggtacatgtggctgggggcccgcttcttggagtttgaagctctcggattcctgaacgaggaccattggttttcccgtgaaaattctctaagcggcgtggagggtgaggggcttcacaagctgggatacattctccgggatgtaagtaagaaagaaggcggcgccatgtatgcggacgataccgcagggtgggacacaagaatcactctggaggatttgaagaacgaagagatggtgaccaatcatatggaaggagagcacaaaaagctggccgaggctattttcaaactcacgtaccagaacaaggtcgtgagggttcagcgccctacaccccgaggtacagtgatggacatcatatcccggagagaccagaggggcagcgggcaagtcgtgacttatggacttaacaccttcacaaatatggaagcccagctgatccgccagatggagggcgaaggtgtatttaagtctattcaacagttaactgttaccgaggagatcgcagtgaaaaactggctggtcagagtggggcgggaaaggttgtcacgtatggctattagtggagatgactgcgtggtcaagccactcgatgaccgattcgcctccgctctgacggccctaaatgatatgggcaaagttcgcaaggacatccagcagtgggagcccagcagaggctggaacgattggacacaagtgcctttttgctctcatcacttccacgaacttattatgaaagacgggcgggtactggtggtcccatgtaggaatcaggatgagctcataggacgcgcaagaatctcgcagggtgcgggctggtcactgcgggaaaccgcctgcttgggaaagagctacgctcagatgtggtccttaatgtattttcataggcgagacctgcgtctcgccgcaaacgctatttgtagtgccgtgccgtctcactgggttcccactagcagaacaacctggtccatccatgcaactcacgagtggatgaccacagaggatatgcttacggtgtggaatcgcgtctggatccaagaaaacccttggatggaggacaagaccccagtggaatcatgggaggaaattccctacctgggaaaacgggaggatcagtggtgcggcagtctaataggtctgacttctagggccacatgggcgaagaatatccagaccgctattaaccaggtaagaagcctcatcgggaatgaggaatatactgactacatgccttccatgaaacgcttccggagggaggaagaggaagccggagttttgtggtga

SEQ ID NO: 14896 - RNA, 9876 nt, synthetic construct
  misc_feature 1..9876: note = derived and/or modified CDS sequence (opt3) from DENV-2__KT187554__SS-prME
  source 1..9876: mol_type = other RNA
acagccggaatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactcggaccgaaacatggatgagctccgagggggcttggaagcacgcccagaggatcgagacttgggtgcttcggcatcctggattcaccattatggcagccatcctggcttacacaattggcaccacgtattttcagcgcgttttgatcttcattctcctgactgcagtggccccatctatgacaatgagatgcatcggcatatcgaacagggactttgtcgaaggggtgtcaggaggtagctgggttgatattgttctggagcacggcagttgtgtgaccactatggctaaaaataagcccacactcgacttcgaattaatcaagaccgaggccaaacaccctgcgacgctgcggaagtactgcattgaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaagatcgtccagcctgaaaacctagagtatacaattgttataaccccacactccggagaagagaatgccgtgggtaacgatactggcaaacatgggaaggagatcaaagtaacgccgcagtcaagtattacagaagcagagctcaccggatacggcactgtgaccatggaatgtagccccaggacaggtctggacttcaatgagatggtccttctgcagatggaaaacaaggcttggttggtgcaccggcaatggtttctcgatctgcctttaccatggctgcccggggccgacacccagggctctaactggatccagaaagagactctcgttacattcaagaatcctcacgcgaagaaacaggatgtggtcgtgcttggatcccaagagggcgccatgcatacggcactgaccggggctactgaaatacagatgtcaagcggaaacttgctatttacaggtcacctgaagtgccgtctccgcatggacaaactgcagcttaagggcatgagttattctatgtgtaccgggaaattcaaggtagttaaggagattgccgaaacacaacatggaactatcgtgatcagagtccagtacgagggcgacggttccccatgcaaaattcccttcgagatcatggatctggaaaagaggcacgtgttggggcggctcattaccgtcaatccgatagtgacggagaaagacagccctgttaacatcgaagctgagcccccatttggcgattcgtacattatcatcggagtggaacctggccagctgaagttatcttggttcaaaaaggggtcctcaattggacagatgtttgagaccacaatgcgaggtgccaagcgcatggcaatactgggcgacactgcctgggatttcgggagtctaggaggcgtatttaccagcatcggtaaagctctccatcaagtcttcggggcgatttatggcgcagccttttccggagtgtcttggacaatgaagatcctgattggcgttgtgatcacttggatagggatgaatagcagatcaaccagtctttccgtcagcttggtgctggtaggagtggttacgctctacctgggcgtcatggtgcaggctgactctggttgtgtggtctcatggaaaaacaaggagcttaaatgcgggagtggaatcttcattacagataatgttcacacctggactgaacagtataagtttcagcccgagagcccatccaagctggcctctgcaatccaaaaagcccacgaagagggcatttgtggtatcaggtcggtgacacggttggaaaacctcatgtggaagcagataacccccgagctgaatcatattttaagcgagaacgaagtgaaactgactatcatgaccggcgacattaaggggatcatgcaggctggaaaacgctccctaagacctcagccaacagagctcaagtactcatggaaaacgtggggcaaggccaagatgctgagtaccgaacttcacaatcatactttcttgatagatgggccggagacagcagaatgccccaacaccaatagggcgtggaactctctggaggtagaggactatggatttggcgtcttcacaactaatatctggctcaaactgaaggaacgtcaagatgtgttttgtgacagcaaattaatgtccgctgccattaaggacaaccgggcagttcacgccgatatgggttactggatcgagtcagctctgaacgacacctggaaaattgaaaaggccagcttcatcgaggtgaagtcttgccactggcctaaatcccatacgctttggagtaatggggtcttggagagcgaaatgataattccaaagaacttcgcaggacccgtgtctcagcacaattatcgacctggctaccatacacagaccgctggtccatggcacctcggcagactggagatggattttgacttctgtgaagggactaccgttgtggtaacagaggattgcggaaacaggggcccctccctacgcactaccacagcctcagggaaactgatcacggaatggtgctgtcggagttgcaccctcccgcctctgagatacaggggagaggacggctgttggtatggtatggagatccgcccacttaaggaaaaagaggaaaatttggtcaacagcctggtgactgcggggcatggacagattgataatttttcgttaggcgtgctcggtatggccctgttccttgaggaaatgctgcgaacacgggtcggcaccaagcacgctatcttgctcgttgcagtgtcctttgtaactctgattacagggaacatgtctttccgtgacctaggaagagtgatggtcatggtgggcgccgctatgaccgatgacatagggatgggagttacgtacctggccctcctggcagcgtttaaggtgaggcccactttcgccgctggccttttgctgcgcaaattaaccagcaaggagctcatgatgacaaccatcggtattgtcctgctttcacaaagtactatgcctgagacaatcctggaactaaccgatgccctcgcactggggatgatggtgttgaaaattgttcggaatatggagaagtatcagctggctgtgacaatcatggccatattatgcgtccccaacgcagtaatcctccagaatgcctggaaagtgtcctgtactaccctggctgttgtgtctgtcagcccactttttctgacgtcctcacaacagaaggcggactggattcctttggccctcacaatcaagggactgaaccccaccgcaattttcctaactaccctgagcagaacaagtaaaaagaggtcttggccacttaatgaagctatcatggccgtgggcatggtatccatactcgccagctcgctgttgaaaaacgatattccgatgactggccctctggtggctgggggattactcaccgtctgctacgttctgacgggtcgatcagcagaccttgagctggaacgcgccgcggacgtgcggtgggaggagcaggctgaaatctctggcagttcccccatcttgagcattacaatatctgaggatgggagcatgtccatcaagaatgaagaggaggaacagaccctcactattctgatcagaacaggactactggtgatttcaggcctttttccagtcagtatccccataaccgccgcagcctggtatctctgggaggtgaaaaagcaaagggctggtgttctgtgggacgtacctagcccaccccctgtggggaaagcagaattggaggatggagcctaccgtatcaagcagaagggcattttaggctattctcagatcggggcgggagtctacaaagaaggtactttccacacaatgtggcatgtgacccgcggcgctgttctgatgcacaaggggaaacggattgagccgtcctgggccgacgtgaagaaagatctcatctcatacggaggcggttggaagctggagggggaatggaaggagggagaagaggtccaggtgcttgcactggaaccaggcaaaaaccccagagccgtacaaacgaagcctggcttgtttaaaactaacaccgggacaataggagctgtcagtctagacttcagcccaggtacctccggctctcccattgtggataagaaagggaaggttgtgggactgtatggcaatggtgtcgtgacaaggtcggggacttacgttagcgccatcgcacagaccgagaagtcaatcgaggacaaccctgaaattgaggatgacatcttccggaaaaagagactcacgataatggatctgcatccgggagctggcaaaacaaagcgctatcttcccgccattgtgagagaagcgatcaaaaggggcttacggactctgattctcgccccaacccgagtcgtggcagctgagatggaagaggccttgagagggctgcctatccgctaccagacacccgctataagggcagagcacaccggacgtgaaattgtagacctcatgtgtcatgccacttttaccatgcggctgctttccccaatcagagtgcctaattataacctgatcattatggatgaggcccacttcacagaccccgctagtatcgcggcaaggggttacatttctacgcgcgttgaaatgggcgaggccgctgggatatttatgactgccaccccaccgggaagccgagaccctttcccccagtccaatgcaccaatcatggatgaggaaagagagattcccgaacggtcatggaactctggccacgagtgggtcacagactttaagggtaagaccgtgtggttcgtgcctagcatcaaagccgggaatgatatcgctgcgtgcttgaggaagaacggcaaaaaggtcattcaactaagtcgcaaaacttttgactccgaatatataaagacacgtaccaatgattgggacttcgtagtgacgactgatatcagcgagatgggcgccaactttaaggcagagagagttattgacccacggaggtgtatgaaacccgtgatcctgacagatggcgaagaacgcgtcattctcgctgggcctatgccggtgacccattcttcagccgcacagcgaagaggacgggttggtaggaatccaaagaacgaaaatgaccagtacatctacatgggcgagcccttagaaaacgatgaggactgcgcccactggaaagaggctaagatgctgcttgacaatatatccacccctgaagggatcattcccagtatgttcgagccagaacgcgagaaagtggatgccatcgacggagaatatagactgaggggcgaggcgcggaagacttttgtcgatctcatgcgtcgcggtgacttgcctgtgtggctggcataccgagtagccgctgaggggattaactatgccgatagaaggtggtgtttcgacggcgtgaaaaacaatcaaatcctcgaagagaacgttgaagtcgagatatggacaaaggagggagaacggaagaaactgaagccccgctggcttgatgctagaatttacagcgacccactagcactgaaagagttcaaggaatttgccgctggcaggaaatcgttgaccttaaatctgatcacagagatggggcggctccctactttcatgacgcagaaggcccgaaacgcactggataatcttgcggtgctgcataccgccgaagctggaggtagagcctataaccacgcactctctgagttgccggagacactggaaactctactgctccttaccctgttagctgccgtgacaggcgggatatttttgttcctgatgtccggaaagggcatcggtaaaatgaccctcgggatgtgctgcataatcactgcaagcattctgctttggtacgcccagatccagccccactggattgctgcgtcaatcatactggagtttttcctcattgtcttgctgatcccagaacctgagaagcaacgcacgccccaggacaatcagttaacctatgttgtgatcgccattctaacagtagtggcagctactatggccaacgaaatgggctttctggagaaaaccaagaaagatttcggactcggcagtacaaccactcagcaaccagagtctaatatccttgacatagatctgaggcctgcctccgcatggacattgtacgctgtcgccacgacctttattactcccatgctgcggcatagcatcgaaaactcaagtgtgaatgttagcctcacagcgattgctaaccaggccaccgtgctgatggggcttggaaagggttggccgctctccaagatggacatcggcgtcccactgttggcaatagggtgttactctcaggtaaatcctatcaccctgacagccgctttactactgctcgtggcacactatgccattatcggacccggccttcaggcgaaagctactcgtgaggcccaaaagagagcagccgctggtattatgaaaaacccaacggttgacgggatcaccgtgattgatctggaccccatcccttacgatccgaagttcgaaaaacagttgggccaggtcatgctgctcgtgctgtgcgtcacacaggtgcttatgatgaggactacctgggccttatgtgaggcactgacactcgctaccggacccataagcactttgtgggaaggcaatccagggcgcttttggaacacgacaattgccgtttccatggcgaatatcttccggggatcatatctggccggcgcaggtctactgttttctatcatgaagaacaccgctaacactcgaagagggaccggaaatacaggcgagactctcggtgagaagtggaaaaacaggcttaatgccctgggcaagagtgagttccaaatttacaaaaagtcggggatacaggaggtggaccgcaccttggcaaaagaaggaatcaagcggggcgagacagatcatcacgctgtaagcagagggtccgccaaactgcgttggttcgtggagaggaacctcgtcacgcctgaaggaaaggttgtggacctgggctgcggtagagggggatggtcttattactgtggcggtttaaagaatgtcaaagaggtgaagggccttaccaaagggggacccggccatgaagaacctattccaatgtcaacttatgggtggaacctggtacgcctccagagcggagtggatgtatttttcacaccccctgaaaagtgcgacaccctactgtgtgatatcggcgagtccagtccaaatcccactgtggaggccggtcgaacattgagagtcctgaacctcgtggaaaattggcttaacaataacacccaattttgcattaaagtcctgaatccgtacatgccttctgtgatcgagaagatggaagcgttgcagaggaagtacgggggagctctggttcggaacccactcagccgcaattcaacgcacgagatgtattgggtatccaacgcaagtggcaacatagtgagctctgtcaatatgatctccagaatgttaattaacaggttcaccatgcgacacaaaaaggccacatacgaacccgacgtggatctgggctcagggactcggaatatcggaattgagagcgagacccctaaccttgacatcataggtaaacgtattgaaaagatcaaacaggagcatgaaacatcgtggcactatgatcaggaccatccatacaagacttgggcttatcacggctcttacgagaccaagcaaacagggagtgcctccagcatggttaatggagtggtcagactgctaaccaaaccctgggacgtgatcccgatggtaactcagatggcaatgacggatacaaccccttttggccagcagcgcgtgttcaaggaaaaagttgacactaggacccaagagcccaaggagggtaccaaaaagctcatgaagattacggccgaatggctgtggaaagagttggggaagaaaaagaccccacggatgtgtactagagaagagtttacacgcaaagtcaggtcaaacgctgcgctgggagccatattcaccgatgagaataagtggaaatccgcacgagaagctgtggaggactctggcttttgggaactcgtggataaggagcggaaccttcacctggaaggcaagtgcgagacttgtgtctataatatgatggggaaaagagagaagaaattaggagagttcggtaaggccaaaggcagcagggcaatctggtacatgtggctgggggcccgctttttggagttcgaagctctcggatttctgaacgaggaccattggttcagtcgtgaaaattccctaagcggcgttgagggtgaggggcttcacaagctgggatacattctccgggatgtgtctaagagagaaggcggcgccatgtatgcggacgatacagcagggtgggacaccaggatcacactggaggatttgaaaaacgaagagatggtaactaatcatatggaaggagagcacaagaaactggccgaggctattttcaagctcacctaccagaacaaagtggtccgcgtgcagcgacctacgccccggggtaccgttatggacatcatatcaagaagggaccagcgcggcagtgggcaagtggtcacatatggacttaatacttttaccaacatggaagcccagctgatcagacagatggagggcgaaggtgtgttcaagtccattcaacagttaacagtaactgaggagatcgcagttaagaactggctggtgcgggtcgggagggaacgtttgagccgaatggctatttctggagatgactgcgtggtgaaaccactcgatgaccgctttgcctcggctctgaccgccctaaatgatatgggcaaggtcagaaaagacatccagcagtgggagccctcacggggctggaacgattggacgcaagttcctttctgcagccatcactttcacgaacttattatgaaggacgggagggtgctggtagtgccatgtcgcaatcaggatgagctcataggacgagcacggatctcccagggtgcgggctggagtctgagggaaacagcctgcttggggaaatcttacgctcagatgtggaacttaatgtatttccatcgacgtgacctgagactcgccgcaaatgctatttgtagcgccgtcccgtcccactgggtgcccacctcacgcactacatggagtatccatgcaacccacgagtggatgactaccgaggatatgcttacagtttggaaccgggtgtggatccaagaaaatccttggatggaggacaagacgccagtcgaatcttgggaggaaattccctacctgggaaagagggaggatcagtggtgcggcagcctaataggtctgacctccagagccacttgggcgaaaaacatccagacagctattaatcaggtgcgctcactcatcgggaacgaggaatataccgactacatgcctagcatgaagcggtttaggcgagaggaagaggaagccggagtattgtggtga

SEQ ID NO: 14897 - RNA, 9876 nt, synthetic construct
  misc_feature 1..9876: note = derived and/or modified CDS sequence (opt3) from DENV-2__KT187557__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtggccccatctatgacaatgagatgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaacaccctgcgacgctgcggaagtactgcattgaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaagatcgtccagcctgaaaacctagagtatacaattgttataaccccacactccggagaagagaatgccgtgggtaacgatactggcaaacatgggaaggagatcaaagtaacgccgcagtcaagtattacagaagcagagctcaccggatacggcactgtgaccatggaatgtagccccaggacaggtctggacttcaatgagatggtccttctgcagatggaaaacaaggcttggttggtgcaccggcaatggtttctcgatctgcctttaccatggctgcccggggccgacacccagggctctaactggatccagaaagagactctcgttacattcaagaatcctcacgcgaagaaacaggatgtggtcgtgcttggatcccaagagggcgccatgcatacggcactgaccggggctactgaaatacagatgtcaagcggaaacttgctatttacaggtcacctgaagtgccgtctccgcatggacaaactgcagcttaagggcatgagttattctatgtgtaccgggaaattcaaggtagttaaggagattgccgaaacacaacatggaactatcgtgatcagagtccagtacgagggcgacggttccccatgcaaaattcccttcgagatcatggatctggaaaagaggcacgtgttggggcggctcattaccgtcaatccgatagtgacggagaaagacagccctgttaacatcgaagctgagcccccatttggcgattcgtacattatcatcggagtggaacctggccagctgaagttatcttggttcaaaaaggggtcctcaattggacagatgtttgagaccacaatgcgaggtgccaagcgcatggcaatactgggcgacactgcctgggatttcgggagtctaggaggcgtatttaccagcatcggtaaagctctccatcaagtcttcggggcgatttatggcgcagccttttccggagtgtcttggacaatgaagatcctgattggcgttgtgatcacttggatagggatgaatagcagatcaaccagtctttccgtcagcttggtgctggtaggagtggttacgctctacctgggcgtcatggtgcaggctgactctggttgtgtggtctcatggaaaaacaaggagcttaaatgcgggagtggaatcttcattacagataatgttcacacctggactgaacagtataagtttcagcccgagagcccatccaagctggcctctgcaatccaaaaagcccacgaagagggcatttgtggtatcaggtcggtgacacggttggaaaacctcatgtggaagcagataacccccgagctgaatcatattttaagcgagaacgaagtgaaactgactatcatgaccggcgacattaaggggatcatgcaggctggaaaacgctccctaagacctcagccaacagagctcaagtactcatggaaaacgtggggcaaggccaagatgctgagtaccgaacttcacaatcatactttcttgatagatgggccggagacagcagaatgccccaacaccaatagggcgtggaactctctggaggtagaggactatggatttggcgtcttcacaactaatatctggctcaaactgaaggaacgtcaagatgtgttttgtgacagcaaattaatgtccgctgccattaaggacaaccgggcagttcacgccgatatgggttactggatcgagtcagctctgaacgacacctggaaaattgaaaaggccagcttcatcgaggtgaagtcttgccactggcctaaatcccatacgctttggagtaatggggtcttggagagcgaaatgataattccaaagaacttcgcaggacccatgtctcagcacaattatcgacctggctaccatacacagaccgctggtccatggcacctcggcagactggagatggattttgacttctgtgaagggactaccgtggttgtgacagaggattgcggaaacaggggcccctccctacgcactaccacagcctcagggaaactgatcacggaatggtgctgtcggagttgcaccctcccgcctctgagatacaggggagaggacggctgttggtatggtatggagatccgcccacttaaggaaaaagaggaaaatttggtaaacagcctggtcactgcggggcatggacagattgataatttttcgttaggcgtgctcggtatggccctgttccttgaggaaatgctgcgaacacgggtgggcaccaagcacgctatcttgctcgtcgcagtttcctttgtgactctgattacagggaacatgtctttccgtgacctaggaagagtaatggtgatggtcggcgccgctatgaccgatgacatagggatgggagtgacgtacctggccctcctggcagcgtttaaggttaggcccactttcgccgctggccttttgctgcgcaaattaaccagcaaggagctcatgatgacaaccatcggtattgtgctgctttcacaaagtactatgcctgagacaatcctggaactaaccgatgccctcgcactggggatgatggtcttgaaaattgtgcggaatatggagaagtatcagctggctgttacaatcatggccatattatgcgtgcccaacgcagtcatcctccagaatgcctggaaagtatcctgtactaccctggctgtggtttctgtgagcccacttctgttgacgtcctcacaacagaaggcggactggattcctctcgccctgacaatcaagggactaaaccccaccgcaatttttctgactacccttagcagaacaagtaaaaagaggtcttggccactcaatgaagctatcatggccgtcggcatggtgtccatactggccagctcgttgctgaaaaacgatattccgatgactggccctttagtagctgggggactcctgaccgtgtgctacgtccttacgggtcgatcagcagacctggagttggaacgcgccgcggacgttcggtgggaggagcaggctgaaatctctggcagttcccccatcctcagcattacaatatctgaggatgggagcatgtccatcaagaatgaagaggaggaacagaccctgactattctaatcagaacaggactgcttgtgatttcaggcctcttcccagtgagtatccccataaccgccgcagcctggtatctgtgggaggtcaaaaagcaaagggctggtgtgttgtgggacgttcctagcccaccccctgtagggaaagcagaattagaggatggagcctaccgtatcaagcagaagggcattctgggctattctcagatcggggcgggagtgtacaaagaaggtacttttcacacaatgtggcatgtcacccgcggcgctgtgctcatgcacaaggggaaacggattgagccgtcctgggccgacgttaagaaagatctgatctcatacggaggcggttggaagcttgagggggaatggaaggagggagaagaggtgcaggtcctggcattggaaccaggcaaaaaccccagagccgtgcaaacgaagcctggcctattcaaaactaacaccgggacaataggagctgtaagtctggactttagcccaggtacctccggctctcccattgtcgataagaaagggaaggtggttggactctatggcaatggtgtggtcacaaggtcggggacttacgtgagcgccatcgcacagaccgagaagtcaatcgaggacaaccctgaaattgaggatgacatcttccgaaaaaagcggctgacgataatggatcttcatccgggagctggcaaaacaaagcgctatttacccgccattgttagagaagcgatcaaaaggggcctgcggactctcattttggccccaacccgagtggtcgcagctgagatggaagaggccctgagagggctccctatccgctaccagacacccgctataagggcagagcacaccggacgtgaaattgtggacctgatgtgtcatgccactttcaccatgcggcttctgtccccaatcagagtacctaattataacttgatcattatggatgaggcccactttacagaccccgctagtatcgcggcaaggggttacatttctacgcgcgtggaaatgggcgaggccgctgggatattcatgactgccaccccaccgggaagccgagacccttttccccagtccaatgcaccaatcatggatgaggaaagagagattcccgaacggtcatggaactctggccacgagtgggttacagacttcaagggtaagaccgtctggtttgtgcctagcatcaaagccgggaatgatatcgctgcgtgcctaaggaagaacggaaaaaaggtgattcaactgagtcgcaaaactttcgactccgaatatataaagacacgtaccaatgattgggactttgtcgtaacgactgatatcagcgagatgggcgccaacttcaaggcagagagagtgattgacccacggaggtgtatgaaacccgttatcctcacagatggcgaagagcgcgtgattttagctgggcctatgccggtcacccattcttcagccgcacagcgaagaggacgggtgggtaggaatccaaagaacgaaaatgaccagtacatctacatgggcgagcccctggaaaacgatgaggactgcgcccactggaaagaggctaagatgcttctggacaatatatccacccctgaagggatcattcccagtatgtttgagccagaacgcgagaaagttgatgccatcgacggagaatatagactcaggggcgaggcgcggaagactttcgtggatttgatgcgtcgcggtgacctgcctgtctggctcgcataccgagtggccgctgaggggattaactatgccgatagaaggtggtgttttgacggcgtaaaaaacaatcaaatcctggaagagaacgtggaagttgagatatggacaaaggagggagaacggaagaaacttaagccccgctggctagatgctagaatttacagcgacccactggcattgaaagagttcaaggaattcgccgctggcaggaaatcgttaaccctgaatctcatcacagagatggggcggctgcctacttttatgacgcagaaggcccgaaacgcacttgataatctggcggtcctccataccgccgaagctggaggtagagcctataaccacgcattgtctgagctgccggagacactagaaactctgctccttctgaccttattggctgccgtgacaggcgggattttcctgtttctcatgtccggaaagggcatcggtaaaatgaccctggggatgtgctgcataatcactgcaagcattcttctgtggtacgcccagatccagccccactggattgctgcgtcaatcatactcgagttctttttgattgtgctgttaatcccagaacctgagaagcaacgcacgccccaggacaatcagctaacctatgtcgttatcgccattctgacagtggtagcagctactatggccaacgaaatgggcttcctcgagaaaaccaagaaagattttggacttggcagtacaaccactcagcaaccagagtctaatatcctggacatagatttgaggcctgcctccgcatggacactgtacgctgtggccacgaccttcattactcccatgctccggcatagcatcgaaaactcaagtgtcaatgtgagcctgacagcgattgctaaccaggccaccgttcttatggggctcggaaagggttggccgctgtccaagatggacatcggcgtgccattgctggcaatagggtgttactctcaggtcaatcctatcaccttaacagccgctctactgctccttgtagcacactatgccattatcggacccggcctgcaggcgaaagctactcgtgaggcccaaaagagagcagccgctggtattatgaaaaacccaacggtggacgggatcaccgttattgatttggaccccatcccttacgatccgaagtttgaaaaacagctgggccaggtgatgctcctggtcctttgcgtgacacaggtcttaatgatgaggactacctgggccctgtgtgaggcactcacattggctaccggacccataagcactctgtgggaaggcaatccagggcgcttctggaacacgacaattgccgtgtccatggcgaatatctttcggggatcatatctagccggcgcaggtctgctcttctctatcatgaagaacaccgctaacactcgaagagggaccggaaatacaggcgagactcttggtgagaagtggaaaaacaggctgaatgccttgggcaagagtgaatttcaaatttacaaaaagtcggggatacaggaggttgaccgcaccctggcaaaagaaggaatcaagcggggcgagacagatcatcacgctgtgagcagagggtccgccaaactccgttggttcgtagagaggaacctggtgacgcctgaaggaaaggtcgttgacttaggctgcggtcgggggggatggtcttattactgtggcggtcttaagaatgtgaaagaggtcaagggcctgaccaaagggggacccggccatgaagagcctattccaatgtcaacttatgggtggaacctcgtgcgcctacagagcggagtagatgtgttctttacaccccctgaaaagtgcgacaccctgttgtgtgatatcggcgagtccagtccaaatcccactgttgaggccggtcgaacactgagagtgctcaaccttgtcgaaaattggctgaacaataacacccaattctgcattaaagtgttgaatccgtacatgccttctgtcatcgagaagatggaagcgctgcagaggaagtacgggggagctctcgtgcggaacccattaagccgcaattcaacgcacgagatgtattgggtttccaacgcaagtggcaacatagtaagctctgtgaatatgatctccagaatgctgattaacaggtttaccatgcgacacaaaaaggccacatacgaacccgacgtcgatcttggctcagggactcggaatatcggaattgagagcgagacccctaacctggacatcataggtaaacgtattgaaaagatcaaacaggagcatgaaacatcgtggcactatgatcaggaccatccatacaagacttgggcttatcacggctcttacgagaccaagcaaacagggagtgcctccagcatggtgaatggagttgtgagactactcaccaaaccctgggacgtcatcccgatggtgactcagatggcaatgacggatacaacccctttcggccagcagcgcgtatttaaggaaaaagtggacactaggacccaagagcccaaggagggtacaaaaaagctgatgaagattacggccgaatggttgtggaaagagctggggaagaaaaagaccccacggatgtgtactagagaagagttcacacgcaaagttaggtcaaacgctgcgctcggagccatatttaccgatgagaataagtggaaatccgcacgagaagctgtcgaggactctggcttctgggaacttgtggataaggagcggaacctgcacttagaaggcaagtgcgagacttgtgtgtataatatgatggggaaaagagagaagaaactgggagaatttggtaaggccaaaggcagcagggcaatctggtacatgtggttgggggcccgcttcctcgagtttgaagctctgggattcctaaacgaggaccattggtttagtcgtgaaaattcccttagcggcgtcgagggtgaggggctgcacaagctcggatacattctgcgggatgtttctaagaaagaaggcggcgccatgtatgcggacgatacagcagggtgggacaccagaatcacattggaggatctgaagaacgaagagatggtgactaatcatatggaaggagagcacaaaaagctcgccgaggctattttcaaacttacctaccagaacaaggtagtgagggtccagcgccctacgccccgaggtaccgtgatggacatcatatcacggagagaccagaggggcagtgggcaagttgtgacatatggactgaatactttcaccaacatggaagcccagttaatccgccagatggagggcgaaggtgtctttaagtccattcaacagctgacagtgactgaggagatcgcagtaaaaaactggttggttagagtggggcgggaaaggctcagccgtatggctatttctggagatgactgcgtcgtgaagccactggatgaccgattcgcctcggctctaaccgcccttaatgatatgggcaaagtgcgcaaggacatccagcagtgggagccctcaagaggctggaacgattggacgcaagtccctttttgcagccatcacttccacgaactgattatgaaagacgggcgggttctcgtggtaccatgtaggaatcaggatgagctgataggacgcgcaagaatctcccagggtgcgggctggagtttgcgggaaacagcctgcttagggaagtcttacgctcagatgtggaacctgatgtattttcataggcgagacctccgtcttgccgcaaatgctatttgtagcgccgtgccgtcccactgggtccccacctcaagaactacatggagtatccatgcaacccacgagtggatgactaccgaggatatgctgacagtgtggaaccgcgtttggatccaagaaaatccttggatggaggacaagacgccagtggaatcttgggaggaaattccctacctaggaaaacgggaggatcagtggtgcggcagcctgataggtctcacctccagggccacttgggcgaagaacatccagacagctattaatcaggtcagatcattgatcgggaacgaggaatataccgactacatgcctagcatgaaacgcttccggagggaggaagaggaagccggagtgctgtggtga

SEQ ID NO: 14898 - RNA, 9876 nt, synthetic construct
  misc_feature 1..9876: note = derived and/or modified CDS sequence (opt3) from DENV-2__JQ045670__SS-prME
  source 1..9876: mol_type = other RNA
agcgccggaatgatcattatgctgatacccaccgtgatggctttccacctcacaactagaaacggggaacctcatatgatcgtcggcattcaggaaaagggtaaatcccttctgtttaagacggaggacggcgttaatatgtgcaccttgatggcaatggatttaggggaactgtgtgaggacacaatcacttacaaatgcccacttctcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactgccgagtgccccaatacaaacagagcatggaatagtctggaagtggaggattacggatttggcgtgttcaccacaaacatctggctcaagctgaaagaaaagcaggacgcgttttgtgactctaagttaatgagcgctgccattaaagataatagggcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaaactcattaccgagtggtgctgtagatcctgcacactgccgcctcttaggtatcgcggagaggacggctgttggtacggtatggaaatacggccattgaaggagaaagaagagaatctggtgaactcattagttacggcggggcacggacaggtggataatttcagtctcggcgtactgggtatggccctttttctggaagagatgttgagaaccagggtcggcactaagcatgctatcctcctggtggcagtgagcttcgtcacactaattaccgggaacatgtcgtttaaagacctgggacgcgttgtggtaatggtgggcgccgctatggccgatgacatcgggatgggagtcacttatctcgcactgcttgcggccttcaaggtgcgacccacatttgctgccggcttgctgttacggaagctcacctccaaagagctgatgatgacgactattggtatcgttcttctgtctcaaagcaccatacctgaaacagtgctagagctcaccgatgcactggctttggggatgatggtcctgaagatcgtgcgtaatatggaaaaataccagttagccgttactattatggcaatcctctgcgtgcccaacgccgtcattctgcagaatgcttggaaggtatcatgtacaatccttgcggtggttagtgtgtccccactgttgctcacctctagccagcagaaaactgactggatacctctggccctaactattaagggactgaaccccaccgcaatcttccttacgacactctccagaaccaataaaaagaggtcatggccactgaacgaggctatcatggccgtcggcatggtgagcattttggccagttctctgttaaagaatgacataccgatgactggccctctcgtagctgggggactgcttaccgtgtgctatgtcctgacaggtcgctccgcagatttggaactcgagcgggccactgacgttaaatgggaggatcaagcggaaatcagcggctcgtcacccattctgtctatcaccattagtgaggacgggtccatgagcatcaagaacgaagaggaggaacagacgctaacaatactgatcagaaccggacttctcgtgatttctggcctgtttccaatcagcattcccatcactgctgccgcatggtacttgtgggaggtgaaaaagcagagggccggtgtcttatgggatgtgccttccccaccccctatggggaaagctgaactggaggacggagcatatcgaataaagcaaaagggcattctcggctactcacagatcggggccggagtttacaaagaaggtacattccacaccatgtggcatgtaactcgcggcgcggtgctgatgcacaaggggaaacggatcgagccgagttgggctgatgtcaagaaagaccttattagctatggaggcggttggaagctggagggggaatggaaggagggagaagaggtgcaggttttggccctagaaccaggcaaaaatcccagagcagtgcagacaaagcctggcctgtttaaaaccaacacggggactatcggagccgtctctctcgatttctccccaggtacctcaggcagtcccataattgacaagaaagggaaggtggtaggactgtacggcaacggtgtcgtgacaaggagcggggcttatgtttccgccatcgcacaaaccgagaagtctattgaggataatcctgaaatcgaggacgatatatttcgtaaacgccggcttacaattatggacttacacccgggagctggcaagactaaaagatacctgcccgccatcgtgagggaagcgatcaagcgaggcctccggaccttgattctggccccaacgcgcgtcgtggcagctgagatggaagaggccctcagagggctgcctatcaggtatcagacacccgctattcgggcagagcatactggacgagaaatagttgaccttatgtgtcacgccaccttcacaatgagactgttgtcgccagtgcgcgtccctaactacaatctaatcattatggatgaggcccatttcaccgaccccgctagcatcgcggcaaggggttatatctcaactcgtgtggaaatgggcgaggccgctgggatttttatgaccgccacaccaccgggatcccgggatcctttcccccagagtaacgcaccaataatggacgaggaaagagagatccccgaaaggtcttggaatagcggccacgagtgggtaacggattttaaaggtaagactgtgtggttcgttccttccattaaggccgggaacgacatcgctgcgtgcctgcgcaaaaatggaaagaaagtcattcaactctcacgaaagacctttgattctgaatacgtgaaaacaagaaccaacgactgggatttcgtggtcactacagacatcagcgagatgggcgccaattttaaggcagagcgggtaatagatccaaggcgctgtatgaaacccgtgatcttaaccgacggcgaagaacgtgttattctggctgggcctatgccggtgacgcatagttccgccgcacagagacggggaaggatcggtcgcaacccaaagaatgaaaacgaccagtacatttatatgggcgagccccttgaaaatgatgaggactgcgcccactggaaggaggctaaaatgctgctcgataacatcaatactcctgaagggataattcccagcatgttcgagccagaacgagagaaggtcgacgccatcgatggagaatacagattgcggggcgaggcgaggaaaacatttgtggacctgatgcgcagaggtgatctccctgtttggctggcatataaggtggccgctgaggggattaactacgccgacaggcggtggtgtttcgatggcatcaaaaacaatcagatacttgaagagaacgtcgaagtggagatctggaccaaggagggagaacgtaagaaactaaagccccgctggctggacgctcgaatttattctgatccattggcattaaaagagtttaaggagttcgccgctggcagaaaatcactgaccctcaatctgatcactgagatggggaggcttcctacattcatgacccaaaagacacgggacgccctggataacctcgcagtattgcacactgcggaagccggaggtcgcgcttacaatcatgccctgtccgagctaccggagacgctggaaaccctccttctgttaacattgctggcaactgtgaccggcgggatttttctcttcctgatgagtggaagaggcatcggtaagatgacacttgggatgtgctgcataattaccgctagcatcctgctctggtatgcccagatccagccccactggattgcagcctcgatcatattggagtttttcctgattgttttactaatcccagaacctgagaaacagaggactccccaagacaaccagctgacgtacgtcgtgattgctatcctcaccgtggtcgcggccacaatggcaaatgaaatgggctttcttgagaagactaaaaaggacttcggactgggctctatagctacccagcagccagagtccaacatcttggatattgacctgcggcctgccagcgcctggacactctacgcagttgctaccacttttgtgacacccatgctgcgacattcaatcgaaaatagttctgtaaacgtgtcccttacggccattgcgaatcaagctaccgtcctcatggggctgggaaaaggttggccgttgagcaagatggatatcggcgtgccactgttagccattgggtgttattcacaggttaaccctatcactctaacagcagccctgctccttctggtggctcactacgcaataattggacccggcttgcaggccaaggcgaccagagaggctcagaaacgcgccgcagccggtatcatgaagaatccaaccgtcgacgggatcacagtaattgatctggaccccataccttatgatccgaaattcgaaaagcaactcggccaggtgatgctgcttatcttatgcgttactcaggtgctgatgatgaggacgacctgggctctctgtgaggccttgacactggcaactggacccattagtaccctatgggaaggcaacccagggcggttttggaatacaaccatcgctgtcagcatggccaacattttccgtggatcctacctggcgggcgccggtctcctattttctatcatgaaaaatactacgaacacaagaagggggaccggaaacataggcgagactctgggtgagaagtggaaaagccgcttgaatgcactgggcaagtccgagttccaaacctataagaaatcagggatccaggaggtggaccggacactcgctaaggaaggaattaaacgaggcgagactgatcaccatgccgtctctagagggagtgcaaagctgaggtggtttgtggagcgcaacttagttacccctgaaggaaaagtggtagaccttggctgcggtagagggggatggtcgtactattgtggcggtctgaagaatgtgagagaggtcaagggcctcacaaaagggggacccggccacgaagaacctatcccaatgagcacgtacgggtggaacctagttcgtctgcagtccggagtggatgtcttcttcattccccctgaaaagtgcgacaccttgctgtgtgatatcggcgagtcttcaccaaatcccactgtggaggctggtaggacactccgggtacttaacctggtggaaaattggttgaacaataacacccagttttgcataaaagttctgaatccgtacatgcctagcgtgattgagaagatggaagccctccaacgcaaatatgggggagccttagtccgaaacgacctgtccagaaatagtactcatgagatgtactgggtgtctaacgcgagcggcaatatcgtctcatccgtgaacatgatcagtaggatgcttattaaccggttcacaatgcgccacaagaaggctacctatgaaccagacgttgatctgggcagcgggacgagaaatataggaatcgagtctgagattcccaacctagacatcattggtaaaaggatcgaaaagataaaacaggagcatgaaacctcctggcactacgatcaggaccacccttataagacatgggcataccatggctcatatgagactaaacagaccgggagcgcctcgtctatggtaaatggagtggtccgactcctgacaaagccatgggatgtgttgcccactgttacccaaatggctatgacagacaccactccgtttggccagcagcgggtgttcaaggaaaaagtcgatacgcgtacacaggagcctaaggagggtaccaaaaagctgatgaaaatcactgccgaatggctctggaaggagcttgggaaaaagaagacccccagaatgtgtacacgcgaagagtttacgaggaaagtgcggagtaacgcagccctgggagctattttcaccgacgagaataagtggaaatccgcgagagaagccgtagaggatagccgcttttgggaattagtggacaaggagaggaacctgcacttggaaggcaaatgcgagacttgtgtttacaatatgatgggcaagcgagagaagaaactcggggagttcggaaaggcaaaaggttcacgggctatctggtacatgtggctgggcgccagatttctagagttcgaagcacttgggtttctgaacgaggatcattggttctccagggaaaattctctcagcggagtcgagggcgagggtctgcacaagttggggtatattctgcgcgacgtgagtaaaaaggaaggaggcgccatgtacgctgacgatacagccggctgggacacccgtatcactctcgaggatcttaagaacgaagagatggtgacaaatcacatggaaggggagcataaaaagctggcggaggcaatttttaaattaacctatcaaaacaaggtcgttcgggtgcagagaccaacacctaggggaactgtaatggacataatctcccgccgagatcagcggggtagcggccaagtggggacctacggactgaatacgttcaccaacatggaagcccagttgattagacagatggagggcgaaggtgtcttcaaaaatatccagcacctcacagtgactgaggaggttgctgtgcaaaactggctggccagggtcgggcgcgaaagactatctcggatggcaatctcaggagacgattgcgtggtaaagccccttgacgataggtttgctaacgccctgaccgctctcaatgacatgggcaagattcgtaaagatatacagcagtgggagccaagtaagggctggaacgactggacacaggttcccttctgctcccatcactttcatgaactgatcatgaaagatgggcgagtgttggtcgtgccttgtcgcaatcaagacgagttaattggacgggcccggatcagccagggtgcaggctggtctctgagggaaactgcgtgcctcgggaagtcgtatgcccagatgtggtcacttatgtacttccaccgcagagacctgcggctagctgccaacgcaatttgtagcgctgtgccatcccactgggtcccgaccagtaggacgacatggtctatccatgccaaacacgagtggatgaccactgaggatatgctgacagtttggaatcgagtgtggatacgtgaaaacccctggatggaggacaagacccctgtagaaagctgggaggaaatcccatatctcggaaagagagaggatcagtggtgcggctccttgattggtctgacttcacgcgcaacctgggccaaaaatatccaagcggctattaaccaggtgcggagtcttatcgggaatgaggaatacacagactacatgccctctatgaagaggtttagacgcgaggaagaggaagccggagtcctgtggtga

SEQ ID NO: 14899 - RNA, 9876 nt, synthetic construct
  misc_feature 1..9876: note = derived and/or modified CDS sequence (opt3) from DENV-2__JQ045686__SS-prME
  source 1..9876: mol_type = other RNA
agcgccggcatgatcattatgctgatacccaccgtgatggctttccacctcacaactagaaacggggagcctcatatgatcgtcggaattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgtgattttggcatacacaatcggcaccacgcactttcagcgggttctcattttcatcctgctgactgccgtggctccatctatgacaatgcgctgcatagggatttcgaacagagattttgtcgaaggagtgtcaggtggcagctgggtagacatcgttctcgagcacgggagttgtgtgaccactatggcaaagaataagcccacattagatttcgaactgattaaaaccgaggccaagcagcctgctacgcttaggaaatattgcatcgaagccaagttgaccaacacaactaccgagtcccggtgtccaacacaaggagagccctctctgaaagaagagcaggacaagcgctttgtctgcaagcatagcatggtggatcgaggctggggtaatgggtgtggactattcggcaaaggcgggatcgtgacttgcgcgatgtttacctgcaagaaaaacatggaaggaaagattgtccagcctgagaatctcgaatacacaatagttgtgaccccacactccggtgaggagcatgcagtaggcaacgacactgggaaacacggacaggaaatcaaggtgacgccgcaatcaagtattacagaggccgaactgaccggctatggtactgtcaccatggagtgtagccccagaacagggcttgatttcaatgaaatggtgctgttgcagatggagaacaaagcttggctcgttcacaggcagtggtttctggacttacctctgccatggctccccggcgccgataagcaggagtctaattggatccaaaaggaaacccttgtgactttcaaaaaccctcatgcaaagaaacaggacgtcgtggtactgggatcccaggagggcgctatgcacacagccttgacgggggcgaccgaaatacaaatgtcaagcggaaatctactgtttactggtcatctcaagtgccggctgcgtatggacaaacttcagctgaagggcatgagttactctatgtgtacagggaagttcaaagttgtgaaggagattgccgagacccagcacggaacaatcgtcatccgcgtgcagtatgaaggcgatggttccccatgcaaaattcccttcgagatcatggacttggaaaagagatacgtcctcgggaggctgattactgtgaacccgatagttaccgagaaagatagccctgtgaacatcgaagcagagcccccatttggcgactcgtacattatcatcggagtagagcctggccaattaaagctgaattggttcaagaaagggtcttccattggacagatgtttgaaacgaccatgcggggtgctaagcgaatggccatactaggcgatacagcttgggacttcgggtcactcggaggcgtctttactagtatcggtaaagccctgcatcaggtgttcggggcaatttatggcgccgcttttagcggagtttcctggaccatgaagatccttattggcgtgatcataacatggatcgggatgaactctcgcagcacttcattgagtgtctccctggtgctcgtaggaattgtgaccctgtaccttggcgttatggtccaggcggatagcggttgtgtggtgtcttggaaaaataaggagctgaagtgcgggtcaggaatcttcattacggacaacgtccacacatggaccgaacaatataaatttcagcccgagagtccaagcaagttggcatccgccatccagaaagctcaggaagagggcatatgtggtattagatctgttactaggctcgagaatctgatgtggaagcaaatcacacccgaattaaaccacattctggccgagaatgaagtgaaactaaccatcataactggcgatatcaaggggattatgcaggcaggaaaacggtcgctccgccctcagccaaccgagctgaagtacagctggaagacatggggcaaagccaagatgctttccacggaatcatataaccagaccttcttgatcgacgggccggagactgctgagtgccccaatacaaacagagcctggaatagtctggaagtggaggattacggatttggcgtattcaccacaaacatttggctcaaactgaaggaaaaacaagacgcattttgtgactctaagttaatgagcgcggctatcaaggataatagggccgtccatgcagacatgggttattggatagagtccgccctgaacgatacttggaaaattgagaaggcttcattcatcgaagtgaaaaattgccactggcctaagagccataccctttggtctaacggggttttggagtccgaaatgatcattccaaaaaacctcgccggacccgtgagtcagcacaattaccgtcctggctaccacacgcagatcgcaggtccatggcatctgggcaagctagagatggacttcaacttttgtgatgggacaaccgtcattgtgactgaagactgcggaaatcggggccccagcctgcgaaccacaactgcttctgggaagctcataaccgagtggtgctgtagatcctgcacactgccgcctcttaggtatcgcggagaggatggctgttggtacggtatggaaatccggccattgaaagagaaggaagagaacctggttaattcattagtgacggccgggcacggacaagtagacaacttcagtctcggcgtcctgggtatggcgctttttctggaagagatgttgagaaccagggtgggcactaaacatgccattctcctggtggctgtcagcttcgttacactaatcaccgggaatatgtcgtttaaggatctgggacgcgtggtagtgatggtcggcgcaactatgacagacgatattgggatgggagtgacctatctcgccctgcttgctgccttcaaagttcgacccacgtttgcagcgggcttgctgttacggaagctcacttccaaggagctgatgatgaccacaatcggtatagtgcttctgtctcagagcaccatccctgaaactgtcctagagctcacagacgccctggctttggggatgatggtgctgaaaattgttcgtaacatggaaaagtaccagttagccgtgaccatcatggcaattctctgcgtccccaatgctgtaatcctgcagaacgcctggaaagtgtcatgtacaatacttgcagttgtgagtgtctccccactgttgctcacttctagccaacagaagaccgattggattcctctggccctaacgatcaaaggactgaatcccacagctatcttccttaccactctctccagaaccaacaagaaaaggtcatggccactgaatgaggcgattatggccgtgggcatggtaagcatattggcaagttctctgttaaagaacgacatcccgatgacaggccctctcgtggctgggggactgcttactgtctgctatgttctgaccggtcgctccgccgacttggaactcgagcgggccacggatgtgaagtgggaggaccaggctgaaattagcggctcgtcacccatcctgtctattacaatcagtgaggatgggtccatgagcataaaaaatgaagaggaggaacagaccctaactatcctgattagaacaggacttctcgtgatctctggcctgtttccaattagcatccccataaccgcagccgcgtggtacttgtgggaggtcaagaaacaaagggctggtgtgttatgggacgttccttccccaccccctatggggaaggccgaactggaggatggagcatatcgaattaaacagaagggcatcctcggctactcacagatcggggccggagtatacaaggaaggtactttccacacaatgtggcatgtgacccgcggcgctgtcctgatgcacaaagggaagcggattgagccgagttgggcagacgtgaaaaaggatcttatcagctatggaggcggttggaaactggagggggaatggaaggagggagaagaggttcaggtgttggccctagaaccaggcaagaaccccagagcggtccaaacgaaacctggcctgtttaagactaacaccgggacaataggagctgtgtctctcgacttctccccaggtacctcaggcagtcccattatcgataaaaaggggaaagtagtcggactgtacggcaatggtgtggttacaaggagcggggcctatgtgtccgcaattgcccagactgagaagtctatcgaggacaaccctgaaatagaggatgacatttttcgtaagcgccggcttaccatcatggatttacacccgggagctggcaaaacgaagagatacctgcccgccatcgtcagggaagcaattaaacgaggcctccggacattgatcctggctccaactcgcgtggttgccgcggagatggaagaggccctcagagggctgcctattaggtatcagacccccgcaatacgggctgagcatacaggacgagaaatcgtggaccttatgtgtcacgccaccttcactatgagactgttgtcgccagtccgcgtgcctaattacaacctaattatcatggacgaggctcatttcaccgatcccgcaagcatcgccgccaggggttatatttcaacacgtgtagaaatgggcgaggctgcggggatatttatgacggcaactccaccgggatcccgggaccctttcccccaaagtaatgccccaatcattgatgaggaaagagagatccccgaaaggtcttggaacagcggccacgagtgggtgaccgactttaagggtaaaacagtttggttcgtcccttccattaaggctgggaatgatatcgccgcatgcctgcgcaagaacggaaaaaaggtgatacagctctcacgaaaaacctttgactctgaatacgtgaagactagaacaaatgattgggacttcgtcgtaaccacggatatcagcgagatgggcgccaactttaaagctgagcgggtgattgacccaaggcgctgtatgaagcccgttatcttaactgatggcgaagagcgtgtgattctggcggggcctatgccggtcacacatagttccgccgcacagagacggggaaggatcggtcgcaatccaaaaaacgaaaatgaccagtacatatatatgggcgagccccttgaaaacgacgaggattgcgctcactggaaggaggccaagatgctgctcgacaatattaacacccctgaagggatcattcccagcatgttcgagccagaacgagagaaagtggatgcaatcgttggagaatacagattgcggggcgaggccaggaagacctttgtggacctgatgcgcagaggtgatctccctgtctggctggcttataaagtggccgcggaggggataaactacgcagacaggcggtggtgtttcgatggcatcaagaataaccaaattcttgaagagaatatggaagtagagatctggactaaagagggagaacgtaagaagctaaaaccccgctggctggacgcccgaatttattctgatccattggctttaaaggagtttaaagaattcgccgctggcagaaagtcactgacactcaacctgatcaccgagatggggaggcttcctacattcatgactcagaaaacgcgggacgcactggataatctcgccgtgttgcacaccgctgaagccggaggtcgcgcatacaaccatgcgctgtccgagctaccggagacactggaaactctccttctgttaaccttgctggccacagttaccggcgggatatttctcttcctgatgagtggaagaggcattggtaagatgactcttgggatgtgctgcatcatcacggctagcattctgctctggtatgcccagatccagccccactggatagcagcttcgattatcttggagtttttcctgattgtcttactaatcccagaacctgagaagcaaaggaccccccaggacaatcagctgacatacgtggtgatagccatcctcactgtcgttgcagccaccatggctaacgaaatgggctttcttgagaaaacaaagaaagatctgggattgggctctattgcgacccagcaaccagagtccaatatcctggacattgacctccggcctgccagcgcatggactctgtacgctgtggccacaacgttcgtaacccccatgcttcgacattcaatcgaaaacagttctgtgaatgtctccctcactgccattgcaaaccaggctacagtgctgatggggttgggaaagggttggccgctgagcaaaatggatatcggcgttccattactagccatagggtgttattcacaggtgaatcctattaccctgaccgcggctctccttctgttggtcgcccactacgcaatcatcggacccggcctgcaggccaaggctacaagagaggcacaaaagcgcgccgcggctggtattatgaaaaacccaactgtagacgggataacggtgatcgatctcgaccccattccttatgatccgaagtttgaaaaacagctgggccaggttatgcttttagtgctgtgcgtcacccaagtgctcatgatgaggacaacttgggccttgtgtgaggcactgaccctagccacaggacccatcagtaccctgtgggaaggcaatccagggcggttctggaacactacgattgctgtcagcatggccaatatctttcgtggatcctacctcgcaggcgctggtcttctgttctctataatgaagaacacaaccaacactagaagggggaccggaaatatgggcgagacattgggtgagaaatggaagagccgcctgaacgccctcggcaaatccgaatttcagatctataagaagtcagggattcaggaggtggaccggactctggcgaaagaaggaatcaagcgaggcgagaccgatcaccatgccgtttctagagggagtgcaaaattaaggtggttcgtggagcgcaatatggtaacacctgaaggaaaggtggtcgaccttggctgcggtcgggggggatggtcgtactattgtggcggtctgaaaaacgttagagaggtgaagggcctcacgaaggggggacccggccacgaagagcctattccaatgagcacctacgggtggaatctagtccgtctgcagtccggagtggatgtatttttcatcccccctgaaaaatgcgacactttgctgtgtgatataggcgagtcttcaccaaaccccacagtggaggctggtaggaccctccgggttcttaatctggtggaaaactggttgaataacaatactcaattctgcattaaggtcctgaacccgtacatgcctagcgtgatcgagaaaatggaagccctccagcgcaagtatgggggagcattagtccgaaatccactgtccagaaacagtacacatgagatgtactgggtgtctaatgctagcggcaacatcgtttcatccgtaaacatgattagtaggatgcttataaatcggtttaccatgcgccacaaaaaggccacgtatgaacccgacgtggatctgggcagcgggaccagaaacatcggaattgagtctgagatccctaatctagacattatcggtaagaggatagaaaaaatcaagcaggagcatgaaacatcctggcactacgaccaggatcacccatataaaacttgggcctaccatggctcatatgagaccaagcaaacagggagcgcgtcgtctatggtcaacggagtggttcgactcctgactaaaccctgggacgtgttgccgaccgtcacacagatggctatgaccgatactacgcctttcggccagcagcgggtgtttaaggaaaaggtagacacacgtacccaagagcccaaagagggtactaagaaactgatgaagattaccgcagaatggctctggaaagagcttgggaagaaaaagacaccaagaatgtgtacgcgcgaagagttcaccaggaaggtgcggagtaatgccgctctgggagccatctttactgatgagaacaaatggaagtccgcaagagaagccgttgaggacagccgcttctgggaattagtcgataaagagaggaatctgcacttggaaggcaagtgcgagacatgtgtgtacaacatgatgggcaaacgagagaagaagctcggggaatttggaaaagctaagggttcacgggcgatttggtacatgtggctgggcgccagattcctagagtttgaagcacttgggttcctgaatgaggaccattggttttccagggaaaactctctcagcggagtggagggcgagggtctgcacaaattggggtatatcctgcgcgatgtcagtaagaaagaaggaggcgctatgtacgccgacgataccgcaggctgggacactcgtgttacactcgaggaccttaagaatgaagagatggtgaccaaccacatggaaggggagcataagaaactggccgaggctattttcaagttaacatatcagaataaagtagtgcgggtccagagacctactcccaggggaaccgtgatggatataatctcccgccgagaccaacggggtagcggccaggttgggacgtacggactgaacacctttacaaatatggaagcccagttgattagacagatggagggcgaaggtgtgttcaagaacatccaacacctcactgtcaccgaggaggtggcggtaaaaaactggctggcaagggttgggcgcgaaagactatctcggatggccatctcaggagatgactgcgtggtcaagccacttgatgacaggttcgctaatgccctgacagcactcaacgatatgggcaagattcgtaaagacatacagcagtgggagcccagtcgaggctggaatgattggactcaggtgcctttttgctcccatcacttccatgaactgatcatgaaggacgggcgcgtgttggtcgttccatgtagaaaccaagatgagttaattggacgggctaggatcagccagggtgccggctggtctctgcgcgaaaccgcttgcctcgggaaatcgtatgcccagatgtggtcacttatgtactttcacagacgggacctgaggctagcagcgaatgccatttgtagcgctgtgccgtcccactgggtacccacgagtcgaacaacctggtctatccatgccaagcacgagtggatgactacagaggatatgctgaccgtgtggaaccgtgtctggataagagaaaatccttggatggaggacaaaactccagtggaaagctgggaggaaatcccctatctcggaaagcgcgaggaccagtggtgcggctccttgattggtctgacctcacgggcaacatgggctaagaacatccaagccgcaattaatcaggttaggagtcttatcgggaacgaggaatacacggattacatgccttctatgaaaagattccgccgggaggaagaggaagccggagtgctgtggtga

SEQ ID NO: 14900 - RNA, 9876 nt, synthetic construct
  misc_feature 1..9876: note = derived and/or modified CDS sequence (opt3) from DENV-2__KU094070__SS-prME
  source 1..9876: mol_type = other RNA
accgccggcatgatcattatgctgatacccacagtgatggctttccacctcactacgagaaacggggagcctcatatgatcgtcagcaggcaggaaaagggaaaatcccttctgtttaagaccgaggacggtgttaatatgtgcacattgatggcaatggatttaggcgaatggctggaggacaaaattacttacaagtgtccactactccggcaaaacgaaccggaggatatcgactgctggtgtaattctacctcaacatgggtgacctatgggacttgcacaaccacgggagagcaccgccgagaaaaacgtagtgtagccctggtgccccatgtcggcatgggtcttgagactagaaccgaaacatggatgagctccgagggggcgtggaagcacgctcagaggattgagacttggatcctgcggcatcctggattcaccataatggccgcaatcttggcctacacaattggcaccacgcactttcagcgcgctctcatcttcattctgctgactgcagtggccccatctatgacaatgagatgtatcggcatatcgaacagggattttgttgaaggggtgtcaggaggtagctgggtcgacattgtgctcgagcacggcagttgcgtaaccactatggctaagaataaacccacattagatttcgaactgatcaagaccgaggccaaacagcctgcgacgcttcggaagtattgtattgaagcaaaattgaccaacacaactaccgagtcccgctgcccaacacaaggggagccctctctgaatgaagagcaggacaagcgatttgtttgtaagcatagcatggtggatagaggatggggcaacggttgcgggctattcggaaaaggctccatcgtcacttgtgccatgtttacctgcaagaaaatcatgaagggcaaagtggtgcagcctgaaaatctcgagtacacaattgtcataaccccacactcaggggaagagcatgctgttggaaacgacactggtaagcacggcaaagagatcaagattacgccgcagagtagcatcacagaagccgagctgaccgggtatggaactgtgaccatggaatgctctcccaggacaggccttgatttcaatgagatggtactgttgcaaatggaaaacaaggcatggctcgtgcaccggcagtggtttctggacttacctctgccatggctccccggtgctgatacccaggggtccaattggatacagaaagagactcttgtcacattcaagaaccctcatgccaaaaagcaagacgtggttgtgctgggctcacaggagggagcgatgcacacggccttgaccggcgcaactgaaattcagatgagcagtgggtacctactgtttacaggacatctcaaatgtcgtctgcgcatggacaagcttcaactgaagggtatgtcttattccatgtgcaccggcaaattcaaggtcgtgaaagagatcgctgaaacacagcacgggactatcgtaattagagttcagtacgagggagatggcagcccatgtaagatccccttcgagattatggacttggaaaaaaggcatgtgctcggtcggctgataaccgtcaatccgatcgtgacggagaaggattcgcctgtcaacattgaagccgagcccccatttggggactcttacatcatcattggcgtggaacctggacagttaaagctgaactggttcaaaaagggctcctcaatagggcaaatgtttgagaccacaatgcgaggagctaaacgcatggccatcctaggtgatactgcatgggacttcggcagtctcgggggagtttttaccagcattggcaaggccctgcaccaggtgttcggtgctatctatggggcggcattttccggcgtatcttggacaatgaaaattcttactggagtcatcataacctggatcggcatgaatagcagatcaacgagtttgtccgtgagcctggttctcgtgggggccgtcacactgtaccttggagtgatggtacaggctgattctggctgcgtggtttcatggaagaacaaggagctgaaatgtggtagtgggattttcatcaccgacaatgtccacacttggacagaacagtataagtttcaacccgagagcccatccaaattggcctctgcaattcagaaggcccatgaagagggaatctgcggcataaggtcggtgacccggctcgaaaacctgatgtggaaacagattactcccgagttaaatcacatcctgagcgagaacgaagtgaagctaaccattatgacaggtgatatcaaaggcataatgcaggctgggaagcgctccctcagacctcaaccaacggagctgaagtactcatggaaaacctggggaaaggccaaaatgcttagtactgaatctcataatcagacattcttgatcgacggcccggagaccgcagaatgtcccaacacaaatagggcgtggaacagcctggaggtcgaggattatgggtttggagttttcactaccaatatttggctcaagctgcgtgaagagcaggacgtgttttgcgactccaaattaatgtcagctgccatcaaggataaccgggcagtgcacgccgacatgggctactggattgaaagcgctctgaatgatacgtggaagatcgagaaagcctctttcatagaggtaaagtcctgtcactggcctaaaagtcatacactttggagcaacggtgtcttggaatctgagatgattatcccaaagaatttcgcagggcccgtgtcccagcacaactatcgacctggataccatacccaaactgctggcccatggcacctcggtaaactggaaatggactttgatttctgcgagggcaccacagttgtggtcactgaagactgtgggaacagaggaccctcactaaggaccacaacggccagtggcaagctgatcaccgagtggtgctgccgcagctgtactctcccgcctctgcggtacagaggggaggatggatgctggtatggcatggaaattaggccacttaaggagaaagaagagaatttggtgaactcgctggttacagcgggtcatgggcagatcgacaatttttccttaggagtgctcggcatggccctgttccttgaagagatgctgcgcacccgagtaggtactaagcacgctattttgctcgtcgcagtgtcttttgtgacactgataaccggcaacatgagcttccgggatctagggcgtgtcatggttatggtgggagccacgatgactgacgatatcggcatgggggtaacctacctggctctcctggccgcatttaaagtgagacccacattcgcggccggacttttgctgaggaagttaacctcaaaagagctcatgatgactacaattggcatcgtcctgcttagtcagtccaccattcctgaaacaatcctggagctaactgacgctctcgccctgggtatgatggtgttgaagatggttcgcaagatggaaaaatatcaactggcagtgaccataatggctatcttatgtgtccccaatgccgtgattctccagaacgcatggaaggtttcttgcacgatcctggccgtggtcagcgtatccccactttttctgacatcaagccagcagaaagctgattggattcctttggcgctcaccatcaaggggctgaatcccactgccatattcctaaccacactgagtcggactaacaaaaagagatcttggccacttaatgaggcaattatggctgtgggaatggtttccatcctcgccagctcgctgttgaaaaacgacatcccgatgaccggccctctggtggccggcgggttactcacggtctgttacgtgctgacaggaaggtcagctgaccttgaactggagcgagcagccgatgtaaagtgggaggaccaagcggaaatttctggtagttcccccatattgagcatcaccatttctgaggatggcagcatgtccatcaagaatgaagaggaggaacagactctcacaattctgatccgcaccgggctactggtgatatcaggactttttccagtcagtatccccattactgctgccgcatggtatctctgggaggttaaaaagcagcgggccggcgtgctgtgggacgtgcctagcccaccccctgtcggtaaagctgaattggaggatggggcatacagaatcaagcagaaaggaattttaggctattctcaaatcggcgccggggtgtacaaggaaggaacattccacaccatgtggcatgttacgaggggtgcggtactgatgcacaagggcaaacgtatagagccgtcctgggctgacgtgaagaaagatctcatttcatacgggggaggctggaagctggagggtgaatggaaagagggggaagaggtccaggtgcttgccctggaaccaggaaagaacccccgcgcagttcagactaagcctggcttgtttaaaaccaatgccggcacaatcggggctgtgagtctagacttcagcccaggaacctccggttctcccatcattgataagaaaggcaaggtcgtggggctgtatggaaacggcgtagtcacacggtcgggtgcctacgtgagcgcaatcgctcagactgagaaatcaatagaggacaatcctgaaattgaggatgacatcttcagaaagaggaagctcaccattatggatctgcatccgggggccggaaaaacgaagcgatatcttcccgcgatcgttcgggaagccataaaacgcggcttaagaacactgattctcgcaccaactagggtggtcgctgccgagatggaagaggctttgcggggcctgcctatccgataccaaacccccgcaatcagagccgagcacacagggcgcgaaattgtggacctcatgtgccatgccacctttactatgaggctgctttccccagttcgtgtgcctaactataacctgatcattatggacgaggctcacttcaccgatcccgcgagtatagcagcccggggatacatctctacaagagtcgaaatgggtgaggctgccggcatttttatgacggcaactccaccggggagcagggaccctttcccccagtccaatgccccaatcatggatgaggaacgcgagatccccgaacgatcatggtctagcggacacgagtgggtgaccgactttaagggcaaaacagtatggttcgtgcctagtattaaggctggtaacgatatagcggcctgtttgagaaagaatgggaaaaaggttatccagctatcccggaaaacctttgacagcgaatatgtcaagactaggacaaacgattgggacttcgtggtgaccacggatatttctgagatgggagcaaattttaaagctgagcgcgtcatcgacccacgtagatgcatgaagcccgtaattctgactgatggcgaagagcgggtgacactcgccggccctatgccggttacccattcatccgcagcccaaaggcgcgggcgaatcggaagaaacccaaaaaatgaaaacgaccagtacatatacatgggtgagcccttagaaaatgacgaggattgtgctcactggaaggaggccaagatgctgcttgacaacatcaatacccctgaaggcattatccccagtatgttcgagccagaacgggagaaagtggatgcgattgacggggaatataggctgcgcggagaggcaagaaagacttttgtcgatctcatgaggcggggcgacttgcctgtgtggctggcctaccgtgttgctgccgagggtatcaactatgctgatcgccgatggtgcttcgacgggataaaaaataaccagattctcgaagagaatgtggaagtcgagatctggacaaaggagggcgaaagaaaaaagctgaagcccaggtggcttgatgcacggatttacagcgacccactagccctgaaagagttcaaggaatttgctgccggacgcaaatcgttgaccttaaacctgatcacagagatgggcagactccctactttcatgacgcagaaggcaagggatgcgctggacaaccttgccgtgctgcataccgctgaagccgggggacgggcatataatcacgctctctctgagttgccggagacactggaaactctactgctccttaccctgttagccacagtaaccggtggcatatttttgttcctgatgtccgggcgaggaatcggcaaaatgactctcggtatgtgttgcattatcacggcaagcattctgctttggtacgcccaaatccagccccactggatagctgcgtcaattatcctggagtttttcctcatcgtgttgctgattccagaacctgagaagcagagaaccccccaggataaccaattaacatatgttgtcatcgccatactaactgtggtggcagctaccatggccaatgaaatggggtttctggagaagacaaaaaaggacctcggccttggaagtattaccactcagcagccagagtctaacatcctggacattgatttgcgccctgcctccgcatggacactgtacgctgtcgccacgaccttcgttactcccatgctcaggcatagcatcgaaaattcaagtgtgaacgtaagcctgacagcgatagctaatcaggccaccgtgcttatgggcctcgggaaaggatggccgctgtccaagatggacatcggtgtcccattgctggcaattggctgctactctcaagtgaaccctatcaccttaacagccgctctatttctgctcgttgcacactatgccattatcgggcccggacttcaggcgaaagctactcgggaggcccagaagcgtgcagccgctggcattatgaagaatccaacggtggatggtatcaccgtcatagacctggatcccattccttacgacccgaaattcgaaaagcagttggggcaagtaatgctgctcgtgctgtgtgttacacaggtgcttatgatgagaactacctgggccttatgcgaggcactgacactcgctaccggccccatcagcactttgtgggaaggaaacccaggcaggttttggaatacgacaatcgccgtctccatggcgaacattttccgcgggtcatatctggccggagcaggcctactgttttctataatgaaaaataccactaacacccggcgaggtacagggaatatcggagagactctcggcgagaagtggaaaagtagacttaacgctctgggtaagtcggaattccagatttacaaaaagagcggcatccaagaggtggataggaccttggccaaggaagggattaaacgcggagagacagaccatcacgcagtctcccggggctctgctaagctgagatggttcgtggagcgtaatctcgttacgcctgaagggaaagtggtagatctgggatgtggcaggggtgggtggtcatattactgcggaggcttaaagaacgtgcgggaggtcaaaggtcttaccaagggcgggcccggacatgaagagcctatcccaatgagcacttatggctggaacctggttcgcctccagtccggggtggacgtctttttcacaccccctgaaaagtgtgataccctactgtgcgacataggagagagttctccaaatcccactgtggaggccggccgaacattgagagtactgaacctcgtggaaaattggcttaacaataacacccagttttgtatcaaagttctgaatccgtacatgcctagcgtgattgagaagatggaagccttgcagaggaaatacggtggggcgctggtccggaacccactctcacgcaattccacgcacgagatgtattgggtgagtaacgctagcggaaatatcgtctcttccgtgaacatgatttcaagaatgttaatcaataggttcaccatgcgacacaagaaagcaacatacgaacccgatgttgacctgggcagcggcactcggaacatagggattgagtcggagatccctaatcttgacatcattggaaagcgtatagaaaagatcaaacaagagcatgaaacctcttggcactatgatcaggaccatccatacaagacatgggcctatcacggtagttacgagactaaacagaccggctccgctagctcaatggtaaacggggtggtcagactgctaacaaagccctgggatgtggttccgatggtgacccagatggccatgactgacacgacaccttttggacaacagcgcgtcttcaaagaaaaggtggataccaggactcaggagcccaaggagggcaccaaaaagctcatgaaaattacagcagaatggctgtggaaggagttgggtaaaaagaaaacgccacggatgtgcaccagagaagagtttactcgcaaggtaaggtccaacgccgctctgggggcgatcttcacagacgagaataagtggaaatctgcccgagaagcagtggaggatagccggttttgggaactcgttgacaaggagagaaaccttcacctggaaggaaaatgtgagacctgcgtctataatatgatgggcaagagggagaaaaagttaggcgaattcgggaaggctaaaggaagtcgcgccatttggtacatgtggctgggtgcacgttttttggagttcgaagccctcggctttctgaacgaggatcattggttctcccgggaaaatagcctatctggggtggagggagagggccttcacaagctgggttacatcctcagagacgtgtcaaaaaaggaagggggagctatgtatgccgatgacactgcgggctgggacacaaggataaccctggaggatttgaaaaacgaagagatggtcacaaatcatatggaaggcgagcacaagaagctggcagaggccatcttcaaactcacttaccagaacaaggttgtgcgcgtacaacgacctaccccccgggggacggtgatggacattatcagtagaagggatcagcgcggatccggtcaggtcggcacctatgggcttaatacatttactaacatggaagctcaactgattagacagatggagggagaaggcgtgttcaaaagcatccagcatttaaccgttacagaggagattgccgtgcagaattggctggcacgggtcggtagggaacgtttgtctcgaatggctatatcgggggacgattgtgtggtaaagccactcgacgatcgctttgcctcagctctgactgccctaaacgacatgggaaaagttagaaaggatatccaacagtgggagcccagccggggctggaatgactggacccaggtgcctttctgctcccaccactttcatgaacttattatgaaggatggcagggtcctggtggtgccatgccgcaaccaggacgagctcatcgggagagcacggatcagtcaaggagcgggttggtctctgagggaaacggcctgtttgggcaaaagctacgctcagatgtggtccttaatgtatttccaccgacgtgatctgagactcgccgcaaatgctatttgctcagccgtcccgagtcattgggttcccacatctcgcaccacttggagcatacacgcaaagcacgagtggatgacaaccgaggacatgcttactgtgtggaaccgggtatggatccaggaaaacccttggatggaggacaaaaccccagtggaatcctgggaggaaattccctacctggggaagagggaggatcagtggtgtggatcactaatcggcctgacaagcagagtcacgtggggtaaaaatattcaaaccgccatcaaccaggtgcgctctctcatagggaatgaggaatatactgactacatgccttccatgaagcggtttaggcgagaggaagaggaagcgggagttttgtggtga

SEQ ID NO: 14901 - RNA, 9876 nt, synthetic construct
  misc_feature 1..9876: note = derived and/or modified CDS sequence (opt3) from DENV-2__FM210215__SS-prME
  source 1..9876: mol_type = other RNA
agcgcaggcatgatcgtgatgctgattccaaccgtcatggctttccacctcactactagaaacggggagcctcatatgatagttggaatccaggaaaagggtaaatcccttctgtttaagacggaggacggcgtgaatatgtgcaccttgatggcaatggatttaggggaactgtgtgaggacacaattacttacaaatgcccactgctcaggcaaaacgaaccggaggatatcgactgttggtgcaattctacctcaacatgggtaacctatggaacttgtacaaccacgggcgagcaccggcgcgaaaagcgaagtgtggccctggtcccccatgtgggtatggggcttgagactcgtaccgaaacatggatgagctccgagggagcgtggaaacacgctcagagaattgagacttggatcctgaggcatcctggcttcaccataatggccgcaatcttggcctacacaattggcaccacgcactttcagcgggttctcatcttcattctgctgactgctgtggcaccatctatgacaatgcgctgcatcgggatatcgaacagagattttgtcgaaggagtgtcaggtggcagctgggtagacattgttctcgagcacgggagttgtgtgaccactatggccaagaataagcccacattagatttcgaactgatcaaaaccgaggctaagcagcctgccacgcttaggaaatattgcattgaagcgaagttgaccaacacaactaccgagtcccggtgtccaacacaaggagagccctctctgaaagaagaacaagacaagcgctttgtctgcaagcatagcatggtggatcgaggctggggtaatgggtgtggactattcggcaaaggcgggatcgtgacttgcgcaatgtttacctgcaagaaaaacatggaaggaaagatcgtccagcctgagaatctcgaatacacaattgttgtgaccccacactccggtgaggagcatgccgtaggcaacgacactgggaaacacggaaaggaaataaaagtgacgccgcagtcaagtatcacagaggctgaactgaccggctatggtactgtcaccatggagtgtagccccagaacagggcttgatttcaatgaaatggtgctgttgcaaatggagaacaaggcctggctcgttcacaggcagtggtttctggacttacctctgccatggctccccggcgcagataagcaggagtctaattggattcagaaagaaacccttgtgactttcaagaaccctcatgctaaaaagcaagacgtcgtggtactgggatcccaggagggcgccatgcacacagcgttgacgggggccaccgaaatccagatgtcaagcggaaatctactgtttactggtcatctcaaatgccggctgcgtatggacaaacttcaactgaagggcatgagttactctatgtgtacagggaaattcaaggttgtgaaagagatagcagagacccagcacggaacaattgtcatccgcgtgcagtatgaaggcgatggttccccatgcaagatccccttcgagattatggacttggagaagaggtacgtcctcgggaggctgatcactgtgaacccgattgttaccgagaaggatagccctgtgaacatagaagctgagcccccatttggcgactcgtacatcattatcggagtagagcctggccagttaaagctgaattggttcaaaaaggggtcttccatcggacaaatgtttgaaacgaccatgcggggtgccaaacgaatggctattctaggcgatacagcctgggacttcgggtcactcggaggcgtctttacaagtataggtaaggcactgcatcaggtgttcggggccatctatggcgctgcgtttagcggagtttcctggaccatgaaaattcttatcggcgtgattatcacatggatagggatgaactctcgcagcacttcattgagtgtctccctggtgctcgtaggaatcgtgaccctgtaccttggcgttatggtccaggcagatagcggttgtgtggtgtcttggaagaataaggagctgaaatgcgggtcaggaattttcatcacggacaacgtccacacatggaccgaacagtataagtttcaacccgagagtccaagcaaattggcctccgctattcagaaggcccaggaagagggcatctgtggtataagatctgttactaggctcgagaatctgatgtggaaacagattacacccgaattaaaccacatcctggcagagaatgaagtgaagctaaccattatgactggcgatatcaaagggataatgcaagccggaaagcggtcgctccgccctcagccaaccgagctgaagtacagctggaaaacatggggcaaggctaaaatgctttccacggaatcatataaccagaccttcttgatcgacgggccggagactgccgagtgccccaatacaaacagagcatggaatagtctggaagtggaggattacggatttggcgtattcaccacaaacatttggctcaagctgaaagaaaagcaggacgcgttttgtgactctaagttaatgagcgctgccatcaaagataatagggcagtccatgccgacatgggttattggattgagtccgctctgaacgatacttggaagatcgagaaagcctcattcatagaagtgaagaattgccactggcctaaaagccataccctttggtctaacggggttttggagtccgaaatgattatcccaaagaacctcgcaggacccgtgagtcaacacaattaccgtcctggctaccacacgcagatcgctggtccatggcatctgggcaagctagagatggacttcgatttttgtgacgggacaaccgtcattgtgactgaagattgcggaaaccggggccccagcctgcgaaccacaactgcctctgggaaactcatcaccgagtggtgctgtagatcctgcacactgccgcctcttaggtatcgcggagaggacggctgttggtacggtatggaaattcggccattgaaggagaaagaagagaatctggttaactcattagtgacggcggggcacggacaggtagataatttcagtctcggcgtcctgggtatggccctttttctggaagagatgttgagaaccagggtgggcactaagcatgctatactcctggtggcagtcagcttcgttacactaatcaccgggaacatgtcgtttaaagacctgggacgcgtggtagtgatggtcggcgccactatggctgatgacattgggatgggagtgacatatctcgccctgcttgcagcgttcaaggttcgacccacctttgccgctggcttgctgttacggaagctcacgtccaaagagctgatgatgactaccatcggtattgtgcttctgtctcaaagcacaatccctgaaaccgtcctagagctcactgatgccctggcattggggatgatggtgctgaagatagttcgtaatatggaaaaataccagttagctgtgacaatcatggccattctctgcgtccccaacgcagtagtgctgcagaatgcctggaaggtttcatgtaccatccttgctgtggtcagtgtgtccccactgttgctcacatctagccagcagaagactgactggattcctctggcgctaaccatcaagggactgaaccccacggccatattccttacaaccctctccagaactaataaaaagaggtcatggccactgaacgaggcaattatggctgtaggcatggtgagcatcttggccagttctctgttaaagaatgacatcccgatgaccggccctctcgtcgccgggggactgcttacagtttgctatgtgctgactggtcgctccgctgatttggaactcgagaaagcaaccgacgtgaagtgggaggatcaggccgaaattagcggctcgtcacccatactgtctatcacgattagtgaggacgggtccatgagcatcaaaaacgaagaggaggaacagacactaaccattctgatccggactggacttctcgtcatatctggcctgtttccaatcagcattcccatcacagcggctgcctggtacttgtgggaggtgaagaaacagagagccggtgttttatgggatgtaccttccccaccccctatggggaaggccgaactggaggacggagcttataggattaagcaaaaaggcatcctcggctactcacagataggggcaggagtgtacaaggaaggtaccttccacactatgtggcatgtcacacgaggcgccgtgctgatgcacaaagggaagcgcattgagccgagttgggcggatgttaaaaaggaccttatcagctatggaggcggttggaagctggagggggaatggaaagagggagaagaggtgcaggtcttggctctagaaccaggcaagaatccccgggccgtgcagaccaaacctggcctgtttaagacgaacactgggaccatcggagcagtatctctcgatttctccccaggtacatcaggcagtcccattatcgacaaaaaggggaaggtcgtgggactgtacggcaacggtgttgtgaccagaagcggggcctatgtctccgctatagcccaaacagagaaatctattgaggataatcctgaaatcgaggacgatatttttaggaagcgtcgccttactatcatggacttacacccgggagcaggcaaaaccaagcggtacctgcccgctatagtgagagaagccattaaaaggggcctccgaacgttgatcctggcgccaacacgggttgtggccgcagagatggaagaggctctccgcgggctgcctatcagatatcagactcccgccattaaggctgagcataccggaagggaaatcgtcgaccttatgtgtcacgcaacattcaccatgcggctgttgtcgccagtgcgagtacctaactacaatctaattataatggatgaggcccatttcactgaccccgccagcatcgctgcgagaggttatatttcaacccgcgtggaaatgggcgaggcagccgggatctttatgacagctacgccaccgggatccagggatcctttcccccagagtaacgccccaatcattgacgaggaacgtgagatacccgaacggtcttggaatagcggccacgagtgggttactgattttaagggtaaaaccgtctggttcgtgccttccatcaaggcagggaacgacattgccgcttgcctgaggaaaaatggaaagaaagtgatccaactctcaaggaagacatttgattctgaatacgtcaaaacccgcactaacgactgggatttcgtagtgacaaccgacattagcgagatgggcgcgaattttaaggccgagcgagttatcgatccaagacggtgtatgaagcccgtgatattaacggacggcgaagagagggtcatcctggcagggcctatgccggtgactcatagttccgctgcccagcgccgtggaagaattggtcggaaccccaaaaatgaaaacgaccagtacatctatatgggcgagccccttgaaaatgatgaggactgcgcacactggaaggaggccaaaatgctgctcgataacattaatacacctgaagggatcatacccagcatgttcgagccagaaagggagaaggttgacgctattgatggagaataccgcttgcgaggcgaggccagaaaaacctttgtggacctgatgcggaggggtgatctccctgtctggctggcgtataaggtggcagccgaggggatcaactacgctgaccgcagatggtgtttcgatggcattaagaacaatcagatccttgaagagaacgtagaagtggagatatggaccaaagagggagaaaggaagaaactaaagccccggtggctggacgcccgtatctattctgatccattggctttaaaagagtttaaggagttcgcagccggccgcaagtcactgactctcaatctgattacagagatggggcgacttcctaccttcatgacacagaaaactagagacgctctggataacctcgccgttttgcacacggcagaagcgggaggtagggcctacaatcatgctctgtccgagctaccggagaccctggaaacactccttctgttaactttgctggccaccgtcacaggcgggatctttctcttcctgatgagtggacggggcattggtaagatgacccttgggatgtgctgcatcataactgcaagcattctgctctggtatgctcagatccagccccactggatcgccgcatcgattatcttggagtttttcctgatagtgttactaattccagaacctgagaaacagcgcacgccccaagacaaccagctgacctacgtggtcatcgccattctcacagttgtggctgcgactatggccaatgaaatgggctttcttgagaagaccaaaaaggacctgggattgggctctatcgcaacacagcagccagagtccaacatactggatatcgacctcagacctgctagcgcctggaccctgtacgccgtagcaactacattcgtgacgcccatgcttaggcattcaattgaaaatagttctgtcaacgtgtccctcaccgctatcgccaatcaagcgactgttctgatggggttgggaaagggttggccgctgagcaaaatggatattggcgtgccattactagctatcgggtgttattcacaggtcaaccctattacactgaccgccgcactccttctgttggtagcccactacgctatcataggacccggcctgcaggcaaaggccacccgggaggcgcagaaacgagctgccgcaggtattatgaagaatccaacagtggacgggatcactgttatcgatctcgaccccattccttatgatccgaaatttgaaaagcaactgggccaggtgatgcttttaatactgtgcgtcacgcaagtgctcatgatgagaaccacatgggccttgtgtgaggctctgactctagccaccggacccatcagtacactgtgggaaggcaacccagggcgcttctggaataccactattgcagtcagcatggctaacatctttaggggatcctacctcgccggcgcgggtcttctgttctctattatgaaaaatacgacaaacacccggcgtgggactggaaacatcggcgagaccttgggtgagaagtggaaaagcagactaaattccctcggcaaatcagaatttcaaatatataagaaatctgggatccaggaggtggacaggacactggccaaggaaggaattaaacgcggcgagactgatcaccatgcagttagtcgggggtcggctaagttacgatggttcgtggagagaaacatggtaacccctgaaggaaaggtggtcgaccttggctgcggtagaggcgggtggagctactattgtgggggtctgaaatccgttcgcgaggtgaagggcctcacaaaagggggacccggccacgaagaacctatcccaatgtctacgtacgggtggaatctagtccggctgcagtcaggagtggatgtatttttcattccccctgaaaagtgcgacaccttgctgtgtgatatcggcgagagctccccaaaccccactgtggaggccggtagaacactccgtgttcttaatctggtggaaaactggttgaataacaatacccagttctgcataaaagtcctgaacccgtacatgcctagtgtgattgagaagatggaagcactccaaaggaagtatgggggagctttagtccggaatccactgtctcgcaacagcactcatgagatgtactgggtgtcaaatgcctccggcaacatcgttagtagcgtaaatatgatctctcgaatgcttattaacagatttacaatgaggcacaaaaaggccacctatgaacccgacgtggacctgggctccgggacgcggaacataggaatcgagtcagagattcctaatctagatatcattggtaaacgcatcgaaaagataaaacaggagcatgaaaccagctggcactacgaccaggatcacccatataagacatgggcgtaccatggctcgtatgagactaagcagaccgggtctgctagttccatggtcaacggagtggttagactcctgacaaaaccctgggacgtgttgccgactgtcacccaaatggcaatgacagataccactcctttcggccagcagagggtgtttaaggaaaaagtagacacgcgaacacaggagcccaaggagggtaccaaaaagctgatgaaaatcactgccgaatggctctggaaggagcttgggaagaaaaagaccccacggatgtgtacacgtgaagagttcacgagaaaagtgcgcagcaatgctgccctgggagcaatttttaccgatgagaacaagtggaaatcagccagggaagctgttgaggactcccggttctgggaattagtcgataaggagagaaatctgcacttggaaggcaagtgcgagacttgtgtgtacaacatgatgggcaaacgcgagaagaaactcggggaatttggaaaggcgaaaggttctagggccatctggtacatgtggctgggcgcacgattcctagagtttgaagctcttgggttcctgaatgaggaccattggtttagccgggaaaacagtctctccggagtggagggcgagggtctgcacaagttggggtatattctgagagatgtcagcaagaaagaaggaggcgccatgtacgcagacgacacagccggctgggataccaggatcactctcgaggaccttaagaatgaagagatggttacaaaccacatggaaggggagcataaaaagctggctgaggccattttcaaattaacctatcaaaataaggtggtacgcgtgcagcgtcctacaccccggggaactgtcatggatataatctctagaagggaccagcgcggttcaggccaagtggggacctacggactgaacacgtttaccaatatggaagcgcagttgattcgacagatggagggcgaaggtgttttcaagaacatccagcacctcacagtgactgaggaggtcgcagtgcaaaattggctggcccgggtagggagagaaaggctaagtcgcatggctatctccggagatgactgcgttgtgaaaccacttgatgacagattcgccaacgcactgaccgctctcaacgatatgggcaagattcggaaagacatacagcagtgggagcccagcaagggctggaatgattggacacaggtccctttttgctctcatcacttccatgaactgatcatgaaagacgggagggtgttggtggtcccatgtcgtaaccaagatgagttaattggacgagcccgcatctcgcagggtgctggctggtcactgagagaaactgcctgcctcggaaagagctatgcacagatgtggtcccttatgtactttcaccggagggacctgcgcctagcggccaatgctatttgtagtgccgttccgtctcactgggtgcccaccagcagaacgacatggtccatccatgcaaagcacgagtggatgaccactgaggacatgctgacagtatggaaccgggtgtggataagggaaaatccttggatggaggataaaaccccagtcgaatcatgggaggaaatcccctatctcggaaagcgagaggaccagtggtgcggcagtttgattggtctgacttctcgtgctacctgggccaaaaacatccaagcagccattaatcaggtgagaagccttatcgggaacgaggaatacacagattacatgccttccatgaagcgcttccggagggaggaagaggaagcgggagttctgtggtga

SEQ ID NO: 14902 - RNA, 9876 nt, synthetic construct
  misc_feature 1..9876: note = derived and/or modified CDS sequence (opt3) from DENV-2__FM210216__SS-prME
  source 1..9876: mol_type = other RNA
agcgccggcatgataattatgctgatacccaccgtgatggctttccacctcaccactagaaacggggagcctcatatgatcgtcggtattcaagaaaagggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactacagagtgccccaataccaacagagcctggaatagtctggaagtggaggattacggatttggcgtgttcacaactaacatctggctcaagctgaaagaaaagcaggacgcattttgtgactctaagttaatgagcgcggctattaaagataatagggccgtacatgcagacatgggttattggatcgagtccgccctgaacgatacctggaagatagagaaggcttcattcattgaagtcaagaattgccactggcctaaaagccatacgctttggtctaacggggtgttggagtccgaaatgatcatcccaaagaacctcgccggacccgttagtcaacacaattaccgtcctggctaccacacacagattgcaggtccatggcatctgggcaagctagagatggacttcgatttttgtgacgggaccactgtgatcgtcaccgaagattgcggaaaccggggccccagcctgcgaacaactaccgcttctgggaaactcattacagagtggtgctgtagatcctgcacgctgccgcctcttaggtatcgcggagaggacggctgttggtacggtatggaaatacggccattgaaggagaaagaagagaatctggtgaactcattagttaccgccgggcacggacaggtggataatttcagtctcggcgtactgggtatggcgctttttctggaagagatgttgagaactagggtcggcacaaagcatgccatcctcctggtggctgtgagcttcgtcaccctaattactgggaacatgtcgtttaaagacctgggacgcgttgtggtaatggtgggcgcaacaatggccgatgacatcgggatgggagtcacctatctcgctctgcttgccgcattcaaggtgcgacccacgtttgcggccggcttgctgttacggaagctcacttccaaagagctgatgatgaccacaattggtatcgttcttctgtctcaaagcaccatacctgaaactgtgctagagctcacagatgctctggccttggggatgatggtcctgaagatcgtgcgtaatatggaaaaataccagttagcagttaccattatggctatcctctgcgtgcccaacgccgtcattctgcagaatgcatggaaggtatcatgtacaatccttgccgtggttagtgtgtccccactgttgctcacttctagccagcagaaaaccgactggatacctctggctctaacgattaagggactgaaccccacagcgatcttccttaccactctctccagaaccaataaaaagaggtcatggccactgaacgaggccatcatggcagtcggcatggtgagcattttggctagttctctgttaaagaatgacataccgatgacaggccctctcgtagccgggggactgcttactgtgtgctatgtcctgaccggtcgctccgccgatttggaactcgagcgggctacggacgttaaatgggaggatcaggcagaaatcagcggctcgtcacccattctgtctatcacaattagtgaggacgggtccatgagcatcaagaacgaagaggaggaacagaccctaactatactgatcagaacaggacttctcgtgatttctggcctgtttccaatcagcattcccatcaccgccgcggcttggtacttgtgggaggtgaaaaagcagagggccggtgtcttatgggatgtgccttccccaccccctatggggaaagcagaactggaggacggagcctatcgaataaagcaaaagggcattctcggctactcacagatcggggctggagtttacaaagaaggtactttccacacaatgtggcatgtaacccgcggcgcagtgctgatgcacaaggggaaacggatcgagccgagttgggccgatgtcaagaaagaccttattagctatggaggcggttggaagctggagggggaatggaaggagggagaagaggtgcaggttttggcgctagaaccaggcaaaaatcccagagctgtgcagacgaagcctggcctgtttaaaactaacaccgggacaatcggagccgtctctctcgatttctccccaggtacctcaggcagtcccataattgacaagaaagggaaggtggtaggactgtacggcaacggtgtcgtgacaaggagcggggcatatgtttccgccatcgctcaaactgagaagtctattgaggataatcctgaaatcgaggacgatatatttcgtaaacgccggcttaccattatggacttacacccgggagccggcaagacgaaaagatacctgcccgcaatcgtgagggaagctatcaagcgaggcctccggacattgattctggccccaactcgcgtcgtggcggccgagatggaagaggcactcagagggctgcctatcaggtatcagacccccgctattcgggccgagcatacaggacgagaaatagttgaccttatgtgtcacgctaccttcactatgagactgttgtcgccagtgcgcgtccctaactacaatctaatcattatggatgaggcacatttcaccgaccccgccagcatcgccgctaggggttatatctcaacacgtgtggaaatgggcgaggcggcagggatttttatgacggccactccaccgggatcccgggatcctttcccccagagtaacgctccaataatcgacgaggaaagagagattcccgaaaggtcttggaatagcggccacgagtgggtaaccgattttaaaggtaagacagtgtggttcgttccttccatcaaggccgggaacgacattgcagcctgcctgcgcaaaaatggaaagaaagtcatccaactctcacgaaagacctttgattctgaatacgtgaaaactagaacaaacgactgggatttcgtggtcaccacggacataagcgagatgggcgctaattttaaggcggagcgggtaatcgatccaaggcgctgtatgaaacccgtgattttaactgacggcgaagaacgtgttatcctggccgggcctatgccggtgacacatagttccgcagctcagagacggggaaggattggtcgcaacccaaagaatgaaaacgaccagtacatctatatgggcgagccccttgaaaatgatgaggactgcgcccactggaaggaggcaaaaatgctgctcgataacataaatacccctgaagggattatccccagcatgttcgagccagaacgagagaaggtcgacgccattgatggagaatacagattgcggggcgaggctaggaaaacctttgtggacctgatgcgcagaggtgatctccctgtttggctggcctataaggtggcggcagaggggatcaactacgccgacaggcggtggtgtttcgatggcatcaaaaacaatcagatccttgaagagaacgtcgaagtggagatttggactaaggagggagaacgtaagaaactaaagccccgctggctggacgctcgaatctattctgatccattggccttaaaagagtttaaggagttcgctgcaggcagaaaatcactgacactcaatctgattaccgagatggggaggcttcctacattcatgactcaaaagacgcgggacgccctggataacctcgctgtattgcacaccgccgaagcaggaggtcgcgcgtacaatcatgccctgtccgagctaccggagacactggaaactctccttctgttaaccttgctggctacagtgaccggcgggatctttctcttcctgatgagtggaagaggcataggtaagatgactcttgggatgtgctgcattatcacggccagcatcctgctctggtatgcacagattcagccccactggatcgctgcctcgataattttggagtttttcctgatcgttttactaattccagaacctgagaaacagaggacaccccaagacaaccagctgacatacgtcgtgatcgcaatactcactgtggtcgccgctaccatggcgaatgaaatgggctttcttgagaagactaagaaagacctgggattgggctctatcgccacccagcagccagagtccaacattctggatatcgacctccggcctgcaagcgcttggactctgtacgccgttgccacaacgttcgtgacccccatgcttcgacattcaattgaaaatagttctgtaaacgtgtccctcactgcaatcgctaatcaagccacagtcctgatggggttgggaaaaggttggccgctgagcaaaatggatattggcgtgccattactagcgatcgggtgttattcacaggttaaccctataaccctgaccgctgccctccttctgttggtggcacactacgccattatcggacccggcctgcaggctaaggcaacaagagaggcccagaaacgcgcggctgccggtatcatgaagaatccaactgtcgacgggattacggtaatagatctcgaccccatcccttatgatccgaaatttgaaaagcaactgggccaggtgatgcttttaattctgtgcgttacccaggtgctcatgatgaggacaacttgggcattgtgtgaggccctgaccctagctacaggacccatcagtaccctgtgggaaggcaacccagggcggttctggaatactacgattgccgtcagcatggcaaacatctttcgtggatcctacctcgctggcgccggtcttctgttctctataatgaaaaatacaaccaacactagaagggggaccggaaacatcggcgagacattgggtgagaagtggaaaagccgcctgaatgcgctcggcaagtccgaatttcaaatttataagaaatcagggatccaggaggtggaccggactctggccaaggaaggaattaaacgaggcgagaccgatcaccatgcagtctctagagggagtgctaagttaaggtggttcgtggagcgcaacatggttacacctgaaggaaaagtggtagaccttggctgcggtagagggggatggtcgtactattgtggcggtctgaagaatgtgagagaggtcaagggcctcacgaaagggggacccggccacgaggaacctatcccaatgagcacctacgggtggaacctagttcgtctgcagtccggagtggatgtctttttcataccccctgaaaagtgcgacactttgctgtgtgatattggcgagtcttcaccaaatcccacagtggaggccggtaggaccctccgggtacttaacctggtggaaaattggttgaacaataacactcagttctgcatcaaagttctgaatccgtacatgcctagcgtgatcgagaagatggaagcactccaacgcaaatatgggggagctttagtccgaaacccactgtccagaaatagtacacatgagatgtactgggtgtctaacgccagcggcaatattgtctcatccgtgaacatgataagtaggatgcttatcaaccggtttaccatgcgccacaagaaggccacgtatgaacccgacgttgacctgggcagcgggaccagaaatattggaatcgagtctgagattcctaacctagatatcataggtaaaaggatcgaaaagattaaacaggagcatgaaacatcctggcactacgaccaggatcacccatataagacttgggcgtaccatggctcatatgagaccaaacagacagggagcgcttcgtctatggtaaatggagtggtccgactcctgactaagccctgggacgtgttgccgaccgttacacaaatggcaatgaccgatactacgcctttcggccagcagcgggtgtttaaggaaaaagtcgacacacgtacccaggagcccaaggagggtactaaaaagctgatgaaaatcaccgccgaatggctctggaaggagcttgggaaaaagaagacaccaagaatgtgtacgcgcgaagagttcaccaggaaagtgcggagtaacgctgccctgggagcaatttttactgatgagaataagtggaaatccgccagagaagctgtagaggacagccgcttctgggaattagtggataaggagaggaacctgcacttggaaggcaaatgcgagacatgtgtttacaatatgatgggcaagcgagagaagaaactcggggaatttggaaaggcgaaaggttcacgggccatctggtacatgtggctgggcgcaagattcctagagtttgaagctcttgggttcctgaacgaggaccattggttttccagggaaaattctctcagcggagtcgagggcgagggtctgcacaagttggggtatattctgcgcgatgtgagtaaaaaggaaggaggcgccatgtacgcagacgacaccgccggctgggatactcgtataacactcgaggaccttaagaacgaagagatggtgaccaatcacatggaaggggagcataaaaagctggctgaggccatcttcaaattaacatatcaaaacaaggtcgttcgggtgcagagacctactcccaggggaaccgtaatggatattatctcccgccgagaccagcggggtagcggccaagtggggacgtacggactgaatacctttacaaacatggaagcgcagttgatcagacagatggagggcgaaggtgtcttcaaaaatattcagcacctcactgtgaccgaggaggttgcagtgcaaaactggctggccagggtcgggcgcgaaagactatctcggatggctatatcaggagatgactgcgtggtaaagccacttgatgacaggttcgccaacgcactgacagctctcaatgatatgggcaagatccgtaaagacattcagcagtgggagcccagtaagggctggaacgattggactcaggttcctttttgctcccatcacttccatgaactgatcatgaaagacgggcgagtgttggtcgtgccatgtcgcaatcaagatgagttaattggacgggcccggatcagccagggtgctggctggtctctgagggaaaccgcctgcctcgggaagtcgtatgcacagatgtggtcacttatgtactttcaccgcagagacctgcggctagcggccaacgctatatgtagcgccgtgccgtcccactgggtccccacgagtaggacaacctggtctatccatgcaaaacacgagtggatgactacagaggacatgctgaccgtttggaatcgagtgtggattcgtgaaaacccttggatggaggataagactccagtagaaagctgggaggaaatcccctatctcggaaagagagaggaccagtggtgcggctccttgattggtctgacctcacgcgctacatgggccaaaaatatccaagcagccataaaccaggtgcggagtcttattgggaatgaggaatacacggattacatgccttctatgaagaggttcagacgcgaggaagaggaagcgggagtcctgtggtga

SEQ ID NO: 14903 - RNA, 9876 nt, synthetic construct
  misc_feature 1..9876: note = derived and/or modified CDS sequence (opt3) from DENV-2__FM210217__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgatcaccgccgagagaagcgttcagtagcgctggtgccccatgtcggtatggggcttgaaaccagaacagagacttggatgagtagcgaaggagcttggaaacacgcccagaggatcgagacctggatactgcggcatcctggcttcacaatcatggcagccattttggcttacaccgtgggcacgactcactttcagcgcgcactcatcttcattctgctggccgctgttgccccatccatgacaatgagatgcatcgggatatctaacagggactttgtggagggagtctcgggtggctcatgggtggatattgtactcgaacacgggagctgtgttaccactatggcgaagaataagcccacattagacttcgagctgatcaaaaccgaagcaaagcagcctgccacgcttcggaaatattgcattgaggctaagttgaccaacacaactaccgaaagtcgctgtccaacacaaggagagccctccctgaatgaggaacaggataaacgatttgtgtgcaagcattctatggtcgacagaggctggggtaacgggtgtggactattcggcaagggcgggatcgtgacttgcgccatgtttacctgcaaaaagaatatggagggaaaaatcgtgcagcctgaaaacctcgagtacacaattgtcataaccccacacagcggtgaagagcatgcagttggcaatgatactgggaagcacggaaaagagatcaagattacgccgcagtcccccatcacagaagctgagctgaccggctatggtactgtgaccatggaatgttcacctaggacagggcttgacttcaacgagatggtactgttgcaaatggaagataaagcctggctcgtgcaccggcagtggtttctggacttaccactgccctggctccctggcgcggacacccagggaagtaattggatacagaaggagactcttgtcacattcaagaacccacatgccaaaaagcaagatgtggttgtgctgggcagccaggagggggcaatgcacacggctttgaccggagccactgaaattcagatgtcttccggtaatctactgtttacaggccatctcaaatgccgtctgcgcatggacaagcttcaactgaaagggatgtcatacagcatgtgtaccggaaagttcaagatcgtcaaagagatcgctgaaacacagcacggcactattgtgatcagagtacagtatgagggtgatgggagtccctgcaagattccgttcgagataatggacttggaaaaaaggcatgttctcggccggctgatcaccgtgaaccctattgtcacggagaaggattctcccgtgaacatcgaagccgagccaccttttggagactcctacatcattataggcgtcgaacccgggcagttaaaactgaattggttcaagaagggaagctcgatcggtcaaatgtttgagaccacaatgcgaggcgcaaaacgcatggccattctaggggatactgcttgggacttcggatctctcggcggtgtgtttacctccatcgggaaggcgctgcaccaggttttcggcgcaatttacggagccgctttttcaggcgtgagttggacaatgaaaatccttataggggtaatcattacttggatcggaatgaacagcagatccacctctttgagcgtctcactggtgctcgttggcgtgattacgctgtatcttggtgccatggtccaggcagatagtgggtgtgtggtatcctggaagaataaagagctgaagtgcggaagcggcatcttcataacagacaacgtgcacacctggactgaacagtacaagtttcaaccagagtctccctcaaaattggccagtgctattcagaaggcccatgaagagggtatctgtggcattaggagcgttacacggctcgaaaatctgatgtggaaacagatcacccctgagttaaaccacatactgtccgagaatgaagtcaagctaactatcatgaccggggatattaaaggaatcatgcaggcaggcaagcgctctctcagaccacaaccgacagagctgaaatattcgtggaagacgtgggggaaggcgaaaatgcttagcaccgaatcccataaccagactttcttgattgacggacccgagacagctgaatgccctaataccaacagggcctggaattcactggaggtggaggactacggctttggtgtgttcacaactaacatctggctcaagctgcgtgaaaaacaggatgtcttttgtgacagtaagttaatgtctgcagccataaaagataatcgggctgttcacgccgacatggggtattggattgagagcgcactgaacgatacctggaagatggaaaaggcttccttcatcgaggtgaaatcatgccactggccaaagagccatacgctttggtctaatggagtgttggagtccgaaatgatcattcccaaaagtttcgccggccctgtaagccagcacaactaccgaccaggttattacacacaaaccgcgggcccctggcatctcgggaagctggagatggactttgatttctgtgaaggaactaccgtcgtggttacagaggactgcggcaacagagggccgtctctaaggactaccacagcctccggaaaactgatcacggaatggtgctgtcgctcatgcaccctccctccactgcggtacagaggcgaggatggttgttggtatgggatggagattaggccccttaaggaaaaggaggaaaatttggtgaacagtctggtcactgctggacacggccagatagacaattttagcttaggtgtgctcggcatggcactgttccttgaggaaatgctgcgcacacgagttgggaccaaacatgccatcttgctcgtggctgtatcgtttgtcactctgattacaggaaacatgtccttccgggatctaggccgtgtgatggtgatggtcggggccgcaatgaccgacgatatcggaattggcgttacgtacctggcgctcctggccgcttttaaggtgagacctactttcgccgcaggtcttttgctgaggaaattaacctctaaggagctcatgatggctacaatcgggatagccctgcttagccagtcaaccatccccgagactattctggaactaacagacgcactcgccctgggaatgatggtattgaaaatcgtgcgcaatatggagaagtatcaactggctgtcaccattatggcgatcagttgcgtgccaaacgccgttatattacagaatgcatggaaggtgtcctgtacaattctcgctactgtctctgtgagccctctgcttctgacctcctcacagcagaaagccgactggatccccttggccctcacgatcaagggcctgaacccaacagctatttttctaaccactctgagccggaccagtaaaaagagatcttggccgcttaatgaagcaataatggccgttggcatggtgtccatcctcgcgagctcgctgttgaaaaacgatattcctatgacagggcccctggtcgctggaggtttactcactgtatgctacgtgctgaccggcaggtcagccgaccttgagctggaacgagcaacggatgttaagtgggaggaccaagccgagatctctgggagttccccaattttgagcatcacaatagctgaagatggatctatgagcatcaaaaatgaggaagaggagcagaccctcactattctgatccgcacaggcctactggtgatttccggtcttttccccgtctcaatccctataaccgcagccgcgtggtatctctgggaagtgaagaagcagcgggctggggtactgtgggacgtgccaagtccccctccggtcggaaaagccgagttggaagatggcgcatacagaattaagcagaaaggcatcttagggtatagccaaatcggagccggtgtttacaaggagggcacttttcacacaatgtggcacgtgaccaggggggctgtgctgatgcatcgtggaaaacgcattgaaccatcttgggccgacgtcaagaaggatctcatctcctacggcggtgggtggaaactggagggagagtggaaggaaggcgaggaagtgcaggttcttgcactggagcccggcaaaaaccctcgggctgtacagacgaagccagggttgttcaaaactaataccggaacaataggtgccgtgtcactagactttagtcccggcaccagcgggtcccctattgtcgatagaaagggaaaggtggttggcctgtatggtaacggggtggtcacaaggtctggagcgtacgtgtcggccatcgcacagactgaaaaaagcattgaggacaatccggagatcgaagatgacatattccgaaagaaacggctcaccattatggacctgcaccccggcgctggcaagacgaaacgctatcttccagccatcgtaagagaggctatcaagagggggttacggacactgattctcgcacctactcgagtcgtggccgccgaaatggaggaagctttgagaggactgcccatccgctaccaaaccccagcgattagggcagagcatacaggtcgtgagatagttgatctcatgtgtcacgccaccttcactatgcggctgctttcacctgtgagagtccccaactataacctgatcattatggacgaagctcattttaccgatccagcctccatcgcagccaggggctacatcagtacacgcgtggagatgggggaagctgcgggaattttcatgacggccactccgcctggctctaaggacccctttccacagagcaatgcacccataatggatgaggagcgagaaatccctgagagatcctggaactcaggtcacgaatgggttaccgacttcaaagggaagacagtgtggtttgtcccatctattaaagctggaaatgatatcgccgcatgcttgcggaagaacggcaaaaaggtgattcagctaagcaggaagaccttcgacagtgagtatgtaaaaactcgcacaaatgattgggactttgtggttaccacggatatctccgaaatgggcgccaacttcaaggctgagcgtgtcatagaccccagacggtgtatgaaacctgtgatcctgactgacggggaggaaagggtgattctcgccggaccgatgccagtcacacacagctctgcggcacaacgccgaggtagaatcggccggaatcccaagaacgagaatgatcagtacatttacatgggggaacctttagagaacgacgaagattgcgcccattggaaagaggctaagatgctgcttgacaatatcaacacccccgagggaataattccatcaatgtttgaacctgagagggaaaaagtagatgccatcgacggcgagtatcgcctgagaggtgaagctaggaagaccttcgtggatctcatgcggcgtggggacttgcccgtttggctggcataccgcgtggccgctgagggcattaattatgccgatcgaagatggtgttttgacggagtcaagaacaatcagatcctcgaggaaaacgtggaggttgaaatatggactaaagagggcgagaggaagaaactgaagccacggtggcttgatgcacgcatctactccgaccctctagcgctgaaagaattcaaggagttcgccgctgggagaaagagtttgacattaaacctgattaccgaaatgggaaggctcccgacatttatgactcagaaagcccgggatgcactggacaatcttgctgtgctgcacacggccgaggcaggtggccgagcctataaccatgctctcagcgaattgcccgagaccctggagacactactgctccttactctgttagcgaccgtcacagggggaatcttcttgtttctgatgtcgggcaagggtgtggggaaaatgaccctcggcatgtgctgcattatcactgcctctatactgctttggcacgcacaaattcagccacactggatcgctgcctccatcattctggaattctttctcatcgtattgctgatacctgagcccgaaaagcagagaacgccacaggacaatcaattaacctacgtggttattgccatcctaacagtcgtggcagctactatggccaacgagatgggattcctggaaaaaaccaagaaggatctcggccttgggagcattgcgacacaggagcctgagtcaaatatcctggacatagatttgcgccccgctagtgcctggaccctgtatgcagtggccactacatttgtcacgccgatgctcaggcattctatcgaaaactccagcgttaatgtgtcactgaccgctattgcaaaccaggccactgtacttatgggactcggtaaaggctggccactgagtaagatggacatcggggtgcctttgctggcgattggatgttacagccaggtcaatcccatcacattaaccgctgccctactgctccttgtggcacactacgccattatcggcccaggtctgcaagctaaagccacccgggaggcacagaagcgtgctgccgcggggataatgaaaaaccccacagttgatggcattactgtgatcgacttggatcctatcccgtatgaccccaagttcgaaaagcagctgggacaggtcatgctcctgattctttgcgtaacgcaagtgttaatgatgagaaccacatgggccctgtgtgaggcactcactttggctaccggcccaatatccacactgtgggaagggaatcctggaaggttttggaacaccactatcgccgtttctatggcaaatattttccgcggcagctacctagctggtgccgggctgctcttttccatcatgaaaaacacgacaaatacccggcgaggaactggcaacattggtgagacccttggcgagaagtggaaatcaagactgaatgccttggggaagtctgaattccagatctataaaaagagtggaatacaggaggtggataggacactggcgaaagaaggcatcaagcgcggggagactgaccatcacgctgtctcgcggggaagcgcaaagctcagatggtttgtggagcgtaacatggtcacccccgaaggcaaagtggttgatctgggttgcgggaggggaggctggtcctactattgtggtggcttaaagaacgtgcgggaggtaaaagggcttacaaagggaggccctgggcatgaagagccaattcccatgtctacgtacggatggaatctggtgcgcctccaatcaggcgtcgacgttttcttcacccctccagaaaaatgcgatactctactgtgtgacatcggtgagagctcccccaacccgacaattgaggccgggcgaaccttgagagtgctgagtctcgtcgaaaattggcttaacaatgacactcagttttgcatcaaggtgctgaacccttatatgccatctgtaatagagaagatggaaacattgcagaggaaatacggaggcgctctggtgcggaatcccctcagccgcaactcaacccacgagatgtactgggtttccaatgccacgggcaacattgtgagtagcgtcaatatgatctctagaatgttaatcaacaggttcaccatgaagcacaaaaaggcaacatatgaacctgatgtggacctggggtccggaactcgaaatattggtatagagtcagagatcccaaaccttgatattatcggcaaacggattgaaaagatcaagcaggagcatgaaaccagctggcactacgaccaagatcatccctataaaacatgggcctaccacgggtcgtatgagactaagcagaccggatctgctagttccatggtcaatggcgtggttcgtctgctaacaaaaccgtgggacgtagtgcctatggtcacccagatggcgatgactgatacgacaccctttggtcagcaaagagtgttcaaggaaaaagttgacacccgcactcaggagccaaaggaggggaccaagaaactcatgaagataacagccgaatggctgtggaaagagttgggaaagaaaaagacgcctaggatgtgtacccgggaagagtttactagaaaagtgcgcagcaacgcagctctgggcgccatcttcacagatgagaacaagtggaagtcagcaagggaagccgtcgaggactcccgattttgggaactcgtggataaagagcggaatcttcacctggaaggcaagtgcgagacctgtgtatacaacatgatggggaaaagagagaagaaattaggagaattcggtaaggctaagggctctagggccatttggtatatgtggctgggggcgcgctttttggagttcgaagcactcggatttctgaatgaggaccattggttcagccgtgaaaacagtctatccggcgtggagggtgaggggcttcacaaactgggatacatcctccgggacgttagcaagaaagaaggcggcgccatgtacgctgatgacactgccgggtgggatacaagaattaccctggaggacttgaagaatgaagagatggtcacaaaccatatggaaggagagcacaaaaagctggcagaggctatctttaagctcacttatcagaataaagtggtgagggtccagcgccccaccccacgaggtacggttatggatattatatctcggagagaccaaaggggctcagggcaggtgggaacctacggccttaacacattcactaatatggaagcccagctgatccgccaaatggagggtgaagggattttcaagagtatccagcatttaaccgctacagaggagatcgccgtacagaactggctggcaagagtgggacgggaaaggttgtcccgtatggcgattagcggcgatgactgcgtcgtgaaacccctcgatgaccgatttgcctctgctctgactgccctaaatgatatgggcaaggttcgcaaagacatacagcaatgggagccttcgagagggtggaacgattggacccaggtgccattctgctcacaccactttcatgaacttatcatgaaggacggacgggtcctggtggtaccgtgtaggaatcaggacgagctcattggtcgcgcaagaatcagccagggcgctgggtggtccctgaaggaaacggcctgcttgggaaaaagttatgcacaaatgtggtctttaatgtacttccaccggagggatctgcgactcgccgcgaacgctatttgtagcgccgttccctcccattgggtgcctacatcacgtaccacttggagtatccacgcaaagcacgagtggatgacaaccgaggacatgcttactgtctggaatagagtgtggatacaggaaaacccatggatggaggataaaacccccgtggaatcttgggaggaagtcccttatctgggcaagcgcgaggaccagtggtgcggtagcctaatcgggctgacatcccgggccacgtgggctaaaaacattcagaccgccatcaatcaagttaggtcactcattggaaacgaggaatacactgattatatgccaagcatgaagagatttcgccgggaggaagaggaagcaggcgtgttgtggtga

SEQ ID NO: 14904 - RNA, 9876 nt, synthetic construct
  misc_feature 1..9876: note = derived and/or modified CDS sequence (opt3) from DENV-2__JX286524__SS-prME
  source 1..9876: mol_type = other RNA
accgcaggcgtgatcgtaatgctgattcccaccgctatggcattccacctcactacgaggaacggggagcctcatatgatagttggaaggcaggaaaagggtaaaagccttctgtttaagaccgaggacggcgtgaatatgtgcacattgatggcaatcgatttaggggaactgtgtgaggacactattacctacaaatgcccactactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataaacttcaactgaaagggatgagctacagtatgtgtactggaaagttcaagatcgtcaaagaaatcgctgagacccagcacggcacgattgtgatcagagtacagtatgagggtgacgggtctccatgcaagattcccttcgaaataaccgatttggagaaaaggcatgttctcggccggctgatcacagtgaacccgattgtcactgaaaaggactcccctgtgaacatcgaggccgaacccccatttggagatagctacatcattgtcggcgtggagcctgggcagttaaaactgaattggttcaagaagggatcgtctataggtcaaatgtttgagaccacaatgcgaggcgctaaacgcatggccatcctaggggacactgcatgggatttcggatccctcggcggtgtttttacctcaattgggaaggccctgcaccaggtgttcggcgctatctacggagcggcatttagtggcgtaagctggacgatgaaaattcttatcggggtcataatcacatggattggaatgaactccagatctaccagcttgtcagtgagtctggttctcgtgggcgtcgtgactctgtatcttggtgccatggtacaggctgactccgggtgtatcgtgagctggaagaataaagaactgaagtgcggatctggcattttcatcacagataacgttcacacctggactgagcagtacaagtttcaacccgaatcaccaagtaaattggccagcgcaatacagaaggcccatgaggaaggtatttgtggcatcaggtccgtcacccggctcgagaatctgatgtggaaacagattacacccgagttaaaccacatcctgtctgaaaatgaggtgaagctaacgataatgaccggggacatcaaaggaattatgcaggctggcaagcgctcgctcagacctcaaccaactgaactgaaatatagctggaagacatgggggaaggccaaaatgctttccaccgagtcacataaccagacattcttgatcgatggaccggaaactgcagagtgccccaataccaacagggcgtggaatagtctggaggtggaagactacggctttggtgtcttcacgacaaacatttggctcaagctgcgtgagaaacaggacgtattttgtgattctaagttaatgagcgctgccatcaaagacaatcgggcagtgcacgccgatatggggtattggatagaatccgctctgaacgacacctggaagatggagaaggcctcattcattgaggtgaaaagctgccactggcctaagtctcatactctttggtccaatggagtattggaaagtgagatgatcatcccaaagagcttcgcaggccccgtctctcagcacaactaccgacctggttatcatacccaaacagctggcccatggcacctcgggaagctggaaatggattttgacttctgtgagggaactaccgtggttgtgacagaagattgcggcaacagagggccctccctaaggacgaccactgcctcaggaaaactgattacagagtggtgctgtcgcagttgcaccctcccgcctctgcggtacagaggcgaggacggttgttggtacgggatggaaatcaggccacttaaggagaaggaagagaatttggtcaacagcctggtgactgcgggacatggccagattgataatttttcgttaggtgttctcggcatggccctgttccttgaagagatgctgcgcacacgagtggggaccaaacacgctatattgctcgtagcactgtcctttgtcacgctaatcactggaaacatgtctttccgggacctgggccgtgtgatggtgatggtcggggccaccatgacagatgacattggaatgggcgttacctatctcgctctgcttgccgcatttaaggtgagacccactttcgcggccggtttgctgttaaggaaactcacaagcaaggagctgatgatggctaccatcgggattgcccttctgtcacagagtacactacctgaaactatcctcgagctgaccgatgcattggctctgggaatgatggccttaaaaatagtacgcaatatggaaaagtaccaactcgcagtgacgatcatggccatttcctgcgtccccaacgctgtgatcctgcagaatgcgtggaaggtttcttgtacaattcttgccgcagtgagcgtctccccactgttgctcacctcaagccagcagaaagctgactggatccctctggccctaactataaagggcctgaaccccaccgccatttttcttacaactctcagtcggacctctaaaaagagatcctggccactgaatgaggctatcatggcagtgggcatggttagcatcttggcctcgtcactgctaaagaacgacattccgatgacggggcctctcgtggcgggaggtctgcttacagtctgctatgtactgaccggcaggtctgctgatttggaactcgagcgagccgcagacgtgaagtgggaggatcaagccgaaataagtgggtccagccccatcctgtctattactatcagcgaggacggatccatgtcaattaaaaatgaagaggaggaacagacactaaccatcctgatacgcactggccttctcgttatcagtggtgtgttcccagtcagcattcccatcacagctgcagcctggtacctgtgggaggtgaagaagcagcgggcgggggtattgtgggatgtgccttctccaccccctgtcggaaaagctgaattagaggacggcgcctatagaattaagcagaggggcatcctggggtactcccaaataggagccggtgtttataaagaaggcacctttcacacgatgtggcatgtgactcgtggggcagtgctcatgcaccgcggaaagcggattgagccgtcatgggctgatgtcaaaaaggacctgatcagttacggcggtgggtggaaacttgagggagaatggaaagagggcgaagaggtgcaggttctggccttggaaccaggcaagaaccccagagcagtacagaccaaacctgggatcttcaagacaaataccggaacaattggtgctgtgagcctagatttttccccaggcacttctgggtcgcccatcgtcgacaggaaaggaaaggtggttggcctgtacggtaacggggtggtcacccgaagcggagcctatgtgtcagcgatagcccagacggagaagtccattgaggataatcctgaaatcgaggacgatattttccggaaaaagcgcctcacaatcatggacctgcatccgggcgcaggcaaaactaagagataccttcccgctatagtaagggaagccattaaacgggggttacgaaccctgatcctcgctccaacaagagtcgtggcagccgagatggaagaggccttgcgcggactgcctatcaggtatcaaacccccgctattcgtgcggagcacactggtcgggaaatcgttgacctcatgtgtcatgcaaccttcacaatgagactgcttagtccagtgagggtccctaactacaacctgattataatggatgaggcccactttacggaccccgcttctatcgccgcacgcggctatattagcactcgagtggaaatgggggaggccgctggaatcttcatgaccgcgacaccaccgggctccagagatccttttccccagtcaaatgccccaatcatggacgaggaacgggagattcccgaaaggtcttggaacagcggtcacgagtgggttaccgatttcaaggggaagactgtgtggtttgtccctagtataaaagcaggaaatgacatcgctgcctgcttgcgcaagaacggcaaaaaggtgattcagctatcccgtaaaacattcgatagcgaatacgtaaagaccagagcaaatgactgggattttgtggttacgactgacatctctgagatgggcgccaacttcaaggctgagcgggtcattgatccaaggcgctgtatgaaacccgtgatcctgacagacggggaagaacgagtgatactcgccggacctatgccggtcacccattcatccgcggcacaaagacggggtaggatcggccgcaatccaaagaacgaaaatgaccagtatatttacatgggggagcccttagaaaacgatgaggactgcgcccactggaaagaggctaagatgctgcttgataatatcaacacccctgaaggaattatccccagtatgtttgagccagaaagagagaaagtagacgccatagatggcgaatacaggctgcggggtgaggctcgtaagactttcgtggacctcatgcgccgaggggatttgcctgtttggctggcatataaagtggccgctgagggcattaattacgccgacagaaagtggtgttttgatggaatcaagaacaatcagattctcgaagagaacgtcgaagtggagatctggacaaaagagggcgaaaggaagaaactgaagccccggtggcttgacgcacgcatatatagcgatccactagcgctgaaagagttcaaggagttcgccgctgggagaaagtcgttgaccttaaacctgatcacagagatgggaaggctccctacttttatgacgcagaaagcccggaatgcactggacaaccttgctgttctgcataccgccgaagtgggtggcaaggcatacacacacgccctctctgagttgccggagactctggaaaccctactgctccttacactgttagctgcggtcaccgggggaattttcttgtttctgatgtccggcaaaggtatcgggaagatgactctcggcatgtgctgcattatcacggccagcatactgctttggtatgcacaaattcagccccactggatcgctgcctcaatcattctggagttctttctcatcgtgttgctgataccagaacctgagaaacagcgaacaccccaggataatcaattaacatacgtagtgattgccatcctaactgttgtcgcagctaccatggccaacgaaatgggattcctggagaagacaaagaaagacctcggctttgggagtattaccactcaggagtctgaatccaatatccttgacatagatctgagaccagcgagcgcttggacattgtatgccgtggcaacgaccttcgtgactcctatgctgcgccattcaatcgagaacagtagcgtcaatgtttccctcacagccattgctaaccaggcaaccgtgctgatgggacttggtaagggctggcccctctctaaaatggacatcggggtaccgctgttggccattggatgttacagccaggtgaatccaatcaccctgacagcggctttactactgctcgtcgcccactacgcaattatcggccctggtcttcaagccaaggctactagggaagcccagaaacgggcagctgccgggataatgaagaaccccacggtggatggcattaccgttatcgacctggagccaatcccctatgatcctaagtttgaaaaacagttgggacaggtgatgctgctcattctgtgcgtcacacaagtacttatgatgcgtactacctgggcgttatgtgaggccctgacactcgcaaccggcccgatatccactttgtgggaggggaatcccggaagattctggaacacgacaatcgctgtgtcaatggccaatatttttaggggctcttacctggccggtgctgggctactgttcagtatcatgaagaacaccactaatacccgccggggaacaggcaacgttggtgaaactctcggcgagaaatggaagtcgcgacttaatgccctggggaaaagcgaatttcagatttataagaaatccggaatccaggaggtggacagaaccttggccaaggagggcataaagagaggggaaacagatcatcacgcggtctctcgcggatcagctaaactgcggtggttcgtggagagaaacatggtcacgccagaaggcaaggtggttgacctcggttgcgggcgtggaggctggagctactattgtggtggcctgaaaaacgtgagggaggtaaaggggttaaccaaaggaggccctgggcatgaggaacccatccctatgtccacttacggatggaatcttgtgcggctgcaaagtggcgtcgatgttttctttacaccacccgagaagtgcgacaccctcctatgtgatattggtgaatctagccctaacccaactatcgaggcagggcgcacactgcgagtgttgaatctggtcgaaaactggctcaataacaatacccagttctgcattaaggtgcttaacccctatatgccgtcagtaatcgagaaaatggaaacgctgcagagaaagtacggaggcgccttggtgaggaatcctctgtcccggaacagtacccacgagatgtactgggttagcaatgctacaggcaacatagtgtcttccgtcaatatgatttcacgcatgctcatcaacagatttactatgaaacacaagaaagccacctatgagccagacgtggatttagggagcggaacaaggaatatcggtattgaatcggagatacccaacctggacatcattggcaagcgaatcgaaaagattaaacaggagcatgaaacttcttggcactacgaccaagatcatccttataagacctgggcataccacgggagttatgagacaaaacagaccggatccgccagctcaatggtcaacggcgtggttcggcttctgactaagccatgggacgtagtgcccatggtcacgcagatggctatgacagataccactccgttcggtcagcaacgtgtgtttaaagagaaggttgacaccagaacacaggaacctaaggaggggacgaaaaagctaatgaaaatcaccgcggaatggctctggaaggagctgggaaaagagaagactccccgcatgtgtacaagggaagagttcacccggaaagtgagatccaatgccgcattgggcgctgtctttactgatgaaaacaagtggaagtctgcccgcgaggcagtggaagacggcaggttctgggagctggtagatcgagagcggaatctccaccttgaagggaaatgcgagacatgtgtgtacaacatgatgggaaagagagagaaaaagctgggtgagtttggcaaagccaaggggagcagggctatatggtatatgtggttaggagcccgcttcctggaatttgaggcgttgggcttcctcaatgaggaccattggtttagtcgtggtaactccctgagcggggttgaaggagagggcctacaccggcttggctacatcctgagagaagtcgggaagaaagagggaggtgcaatgtacgccgatgacaccgctggctgggatacaaggattactctcgaagacctgaagaatgaggagatggtgaccaaccatatgaaaggggaacacaagaaattggccgaggcaatcttcaagctgacgtatcagaataaggtggtccgcgttcagcgaccaacccctcggggaacagtgatggacattatctctagaaaagatcaaaggggctcaggtcaggtagggacttacggactcaacaccttcacaaatatggaagctcagcttattcgccaaatggagggcgagggcatatttaagagtatccagcatctgactgccaccgaagagattgctgtgcagaactggttagccagagtcgggcgggaaaggctgtcccgtatggcaatcagcggagacgattgcgtggttaaacccatcgacgatcgattcgcgtctgccttgacggctctcaatgacatgggtaaggtgcgcaaagatattcagcaatgggagccatcgagaggctggaacgactggacacaggtccccttttgctcacaccacttccatgaactggtgatgaaggatgggcgggtcttagttgtgccttgtaggaatcaggacgagcttataggacgcgccagaatcagccagggcgcaggttggtccctgaaggagaccgcttgcctcgggaaaagttatgcccaaatgtggactctgatgtactttcaccggagggatttgcgattagcagccaacgcgatttgttctgctgtcccaagccattgggtgccgacatcccgtaccacttggtcaatccacgccaagcacgaatggatgaccacagaggacatgctggcagtgtggaacagagtctggattcaggaaaatccctggatggaggataaaacgcctgttgaaagttgggaggaggtgccatatctcggaaagcgcgaagaccagtggtgcggctctcttatcggcctgaccagccgggccacttgggctaaaaacatacagacagccatcaatcaagtaaggtccctaattgggaacgagggatacaccgactatatgccctcaatgaagagattccgccgggaagaggaagaggccggtgtgctgtggtga

SEQ ID NO: 14905 - RNA, 9876 nt, synthetic construct
  misc_feature 1..9876: note = derived and/or modified CDS sequence (opt3) from DENV-2__JX286520__SS-prME
  source 1..9876: mol_type = other RNA
accgcaggcgtgatcgtcatgctgattcccaccgctatggcattccacctcactacgaggaacggggaacctcatatgatagttggaaggcaggaaaagggtaaaagccttctgtttaagaccgaggacggcgtgaatatgtgcacattgatggcaatcgatttaggggaactgtgtgaggacactattacctacaaatgcccattactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagacccggacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtatagtgacaatggagtgtagtcccaggaccgggcttgatttcaacgaaatggttctgttgcaaatggaggacaaagcatggctcgtgcaccggcagtggtttctggatttacctctgccatggctccccggcgctgacactcagggaagcaattggattcagaaggagacacttgtcacgttcaagaaccctcatgccaaaaagcaagacgtggttgtgctgggctctcaggaaggggcgatgcacaccgccttgactggagcaacagagatccagatgtcctcaggtaatctactgtttaccggccatctcaaatgccgtctgcgcatggataaacttcaactgaaagggatgagctacagtatgtgtacaggaaagttcaagatcgtcaaagaaattgctgagactcagcacggcaccatcgtgattagagtacagtatgagggtgacgggtctccatgcaagatacccttcgaaatcacggatttggagaaaaggcatgttctcggccggctgattaccgtgaacccgatcgtcacagaaaaggactcccctgtgaacatcgaggccgaacccccatttggagatagctacattatagtcggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccatggtacaggctgactccgggtgtattgtgagctggaagaataaagaactgaagtgcggatctggcatcttcataactgataacgttcacacatggaccgagcagtacaagtttcaacccgaatcaccaagtaaattggccagcgcaattcagaaggcccatgaggaaggtatctgtggcattaggtccgtcactcggctcgagaatctgatgtggaaacagatcacccccgagttaaaccacatactgtctgaaaatgaggtgaagctaacaatcatgacgggggacattaaaggaatcatgcaggctggcaagcgctcgctcagacctcaaccaaccgaactgaaatatagctggaagacttgggggaaggccaaaatgctttccacagagtcacataaccagaccttcttgattgatggaccggaaacagcagagtgccccaatactaacagggcgtggaatagtctggaggtggaagactacggctttggtgtcttcaccacgaacatctggctcaagctgcgtgagaaacaggacgtattttgtgattctaagttaatgagcgctgccataaaagacaatcgggcagtgcacgccgatatggggtattggattgaatccgctctgaacgacacatggaagatggagaaggcctcattcatcgaggtgaaaagctgccactggcctaagtctcataccctttggtccaatggagtattggaaagtgagatgatcattcccaagaatttcgcaggccccgtcagccagcacaactaccgacctggttatcatactcaaaccgctggcccatggcacctcgggaagctggaaatggattttgacttctgtgagggaacaactgtggttgtgaccgaagattgcggcaatagagggccctctctaaggacaacgaccgcctccggaaaactgatcactgagtggtgctgtcgctcatgcacactcccgcctctgcggtacagaggcgaggacggttgttggtacgggatggaaattaggccacttaaggagaaggaagagaacttggtcaatagtctggtgaccgcgggacatggccagatagataactttagcttaggtgttctcggcatggccctgttccttgaagagatgctgcgcactcgagtggggacaaaacacgctatcttgctcgtagcactgtcgtttgtcaccctaattacgggaaatatgtccttccgggacctgggccgtgtgatggtgatggtcggggccactatgaccgatgacatcggaatgggcgttacatatctcgctctgcttgccgcatttaaggtgagacccaccttcgcggccggtttgctgttaaggaaactcacttctaaggagctgatgatggctacaattgggatcgcccttctgagccagtcaaccctacctgaaacaatactcgagctgactgatgcattggctctgggaatgatggccttaaaaatcgtacgcaacatggaaaagtaccaactcgcagtgaccattatggccatcagttgcgtccccaatgctgtgattctgcagaacgcgtggaaggtttcctgtacgatccttgccgcagtgtctgtcagcccactgttgctcacatcctcacagcagaaagctgactggatacctctggccctaaccattaagggcctgaatcccactgccatctttcttaccacactcagccggacaagtaaaaagagatcttggccactgaacgaggctatcatggcagtgggcatggtttccattttggccagctcgctgctaaagaatgacataccgatgaccgggcctctcgtggcgggaggtctgcttacggtctgctatgtactgacaggcaggtcagctgatttggaactcgagcgagccgcagacgtgaagtgggaggatcaagccgaaatctctgggagttcccccattctgagcatcaccatttctgaggacggaagcatgtccatcaaaaacgaagaggaggaacagactctaacaatactgatccgcaccggccttctcgttatttcaggtgtgttcccagtcagtatccccattactgctgcagcctggtacctgtgggaggtgaagaagcagcgggcgggggtattgtgggatgtgcctagcccaccccctgtcggaaaagctgaattagaggacggcgcctatagaatcaagcagaggggcatactggggtactctcaaattggagccggtgtttataaagaaggcacatttcacaccatgtggcatgtgacgcgtggggcagtgctcatgcaccgcggaaagcggatcgagccgtcctgggctgatgtcaaaaaggacctgatctcatacggcggtgggtggaaacttgagggagaatggaaagagggcgaagaggtgcaggttctggccttggaaccaggcaagaatcccagagcagtacagactaaacctgggattttcaagaccaacacaggaaccatcggtgctgtgagtctagattttagcccaggcacatccgggtctcccatagtcgacaggaaaggaaaggtggttggcctgtacggtaatggggtggtcactcgatcgggagcctatgtgagcgcgattgcccagaccgagaagtcaatcgaggataaccctgaaattgaggacgatatcttccggaaaaagcgcctcacgataatggacctgcatccgggcgcaggcaaaacaaagagataccttcccgctattgtaagggaagccatcaaacgggggttacgaactctgatcctcgctccaaccagagtcgtggcagccgagatggaagaggccttgcgcggactgcctattaggtatcaaacacccgctatccgtgcggagcacaccggtcgggaaattgttgacctcatgtgtcatgcaactttcaccatgagactgctttccccagtgagggtccctaactacaatctgataatcatggatgaggcccactttacagaccccgctagtattgccgcacgcggctatatctctacgcgagtggaaatgggggaggccgctggaatcttcatgactgcgaccccaccgggcagcagagatccttttccccagtccaacgccccaattatggacgaggaacgggagatacccgaaaggtcatggaactctggtcacgagtgggttacagatttcaaggggaagaccgtgtggtttgtccctagcatcaaagcaggaaacgacattgctgcctgcttgcgcaagaatggcaaaaaggtgatccagctaagtcgtaaaactttcgattccgaatacgtaaagacaagagcaaacgactgggattttgtggttaccacggacattagcgagatgggcgccaatttcaaggctgagcgggtcatcgatccaaggcgctgtatgaaacccgtgatactgactgacggggaagaacgagtgatcctcgccggacctatgccggtcacacattcttcagcggcacaaagacggggtaggattggccgcaacccaaagaatgaaaacgaccagtatatctacatgggggagcccttagaaaatgatgaggactgcgcccactggaaagaggctaagatgctgcttgataacattaatacccctgaaggaatcataccctccatgtttgagccagaaagagagaaagtagacgccattgatggcgaatacaggctgcggggtgaggctcgtaagaccttcgtggacctcatgcgccgaggggatttgcctgtttggctggcatataaagtggccgctgagggcatcaactacgccgacagaaagtggtgttttgatggaattaagaataaccagatcctcgaagagaacgtcgaagtggagatatggactaaagagggcgaaaggaagaaactgaagccccggtggcttgacgcacgcatctatagtgatccactagcgctgaaagagttcaaggagttcgccgctgggagaaagagcttgacattaaatctgattaccgagatgggaaggctccctacatttatgactcagaaagcccggaacgcactggacaatcttgctgttctgcatacggccgaagtgggtggcaaggcatacacccacgccctctcggagttgccggagacactggaaactctactgctccttaccctgttagctgcggtcacagggggaatcttcttgtttctgatgtctggcaaaggtattgggaagatgaccctcggcatgtgctgcatcataactgcctccattctgctttggtatgcacaaatccagccccactggatcgctgccagcattatcctggagttctttctcatagtgttgctgattccagaacctgagaaacagcgaacgccccaggataaccaattaacctacgtagtgatcgccattctaacagttgtcgcagctactatggccaatgaaatgggattcctggagaagaccaagaaagactttggcttcgggtcaatcacaacccaggagagtgaatctaacatactcgacatcgatcttagaccagcgtccgcttggactctgtatgccgtggcaacaacgtttgtgacccctatgttgcgccatagcattgaaaattcaagtgtcaacgttagcctgactgccatcgctaatcaggcaacagtgctcatgggactgggtaagggctggcccctttccaaaatggacattggggtaccgctcctggccatcggatgttactctcaggtgaacccaattaccttgaccgcggctctgttactactggtcgcccactacgcaatcataggccctggtctccaagccaaggctacaagggaagcccagaaacgggcagctgccgggattatgaagaatcccactgtggatggcatcacggttatcgaccttgagccaattccctatgatcctaagttcgaaaaacagctgggacaggtgatgttgctgatactctgcgtcacccaagtactgatgatgcgtacaacttgggcgctttgtgaggccttaaccctggcaacaggcccgatcagcaccctctgggaggggaaccccggaagattttggaatactacgattgctgtgtccatggccaacatcttcaggggctcatacttggccggtgctgggctgctattttctattatgaagaatacaaccaacactcgccggggaaccggcaatgttggtgaaacactgggcgagaaatggaagagtcgactcaacgcccttgggaaatcggagttccagatctataagaaaagcggaatacaggaggtggacagaactctggccaaggagggcatcaagagaggggaaaccgatcatcacgcggtctcccgcggatctgctaaattgcggtggttcgtggagagaaacatggtcacaccagaaggcaaggtggttgacctgggttgcgggcgtggaggctggtcatactattgtggtggcctcaaaaatgtgagggaggtaaaggggctgacgaaaggaggccctgggcatgaagaaccaattcctatgagcacctacggatggaacttagtgcggcttcaatccggcgtcgatgtatttttcactccacccgagaagtgcgacacactgctctgtgatatcggtgaaagttctcctaatccaaccattgaggcagggcgcactctacgagtgctgaacttggtcgaaaattggctgaacaataacacacagttttgcatcaaggtgctcaatccctatatgccgagcgtaatagagaaaatggaaacccttcagagaaagtacggaggcgccctggtgaggaaccctttgtcaagaaattccacgcacgagatgtactgggttagtaacgctaccggcaatattgtgagctctgtcaacatgatctcccgcatgctgatcaatagattcacaatgaaacacaagaaagccacttatgagccagacgtggatctcgggtcaggaaccaggaacattggtatagaaagcgagatccccaacttagacattatcggcaagcgaattgaaaagatcaaacaggagcatgaaacatcgtggcactacgaccaagatcatccttataagacttgggcataccacgggtcttatgagaccaaacagacaggaagtgcctccagcatggtcaatggcgtggttcggctgcttaccaagccatgggacgtagtgcccatggtcactcagatggctatgacggatacaaccccgtttggtcagcaacgtgtgttcaaagagaaggttgacactagaacccaggaacctaaggaggggacgaaaaagctgatgaaaataacagcggaatggctatggaaggagctcggaaaagagaagacaccccgcatgtgtactagggaagagtttacacggaaagtgagatcaaacgccgcactgggcgctgtcttcaccgatgaaaataagtggaagtccgcccgcgaggcagtggaagacggcaggttttgggagttggtagatcgagagcggaacctgcacctcgaagggaaatgcgagacttgtgtgtacaatatgatgggaaagagagagaagaaacttggtgagttcggcaaagccaaggggtctagggctatctggtatatgtggctgggagcccgctttttagagttcgaggcgctgggctttttgaacgaggaccattggttcagccgtggtaatagtctctccggggttgaaggagagggcctgcaccggctaggctacattcttagagaagtcgggaagaaagagggaggtgcaatgtacgccgatgacacagctggctgggataccaggatcacactggaagacctcaagaacgaggagatggtgactaatcatatgaaaggggaacacaagaaactggccgaggcaattttcaagttgacctatcagaacaaggtggtccgcgttcagcgaccaacgcctcggggaaccgtgatggacatcattagcagaaaagatcaaaggggctctggtcaggtagggacatacggactgaatacttttaccaacatggaagctcagctcatacgccaaatggagggcgagggcatcttcaagtcaattcagcatcttacagccactgaagagatcgctgtgcagaattggctggccagagtcgggcgggaaaggttaagtcgtatggcaatctccggagacgattgcgtggttaaacccattgacgatcgatttgcgagcgccctgaccgctttgaacgacatgggtaaggtgcgcaaagatatacagcaatgggagccatctagaggctggaatgactggacgcaggtccccttctgctcgcaccactttcatgaactcgtgatgaaggatgggcgggtactggttgtgccttgtaggaaccaggacgagctaatcggacgcgccagaatttcacagggcgcaggttggagccttaaggagacagcttgcctggggaaatcctatgcccaaatgtggaccctcatgtacttccaccggagggatctgcgattggcagccaacgcgatctgtagtgctgtcccatctcattgggtgccgactagccgtacaacctggtccattcacgccaagcacgaatggatgactaccgaggacatgttagcagtgtggaatagagtctggatccaggaaaacccctggatggaggataaaacacctgttgaatcatgggaggaggtgccatatctgggaaagcgcgaagaccagtggtgcggcagtctcataggccttacgtctcgggccacctgggctaaaaatatccagactgccattaaccaagtaaggagcctgatcgggaatgagggatacacagactatatgccctccatgaagagatttcgccgggaagaggaagaggccggtgtgctatggtga

SEQ ID NO: 14906 - RNA, 9876 nt, synthetic construct
  misc_feature 1..9876: note = derived and/or modified CDS sequence (opt3) from DENV-2__JX286525__SS-prME
  source 1..9876: mol_type = other RNA
accgcaggcgtgatcgtcatgctgattcccaccgcaatggcattccacctcactacgaggaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccattactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataaacttcaactgaaagggatgagctacagtatgtgtactggaaagttcaagatcgtcaaagaaatcgctgagacccagcacggcacgattgtgatcagagtacagtatgagggtgacgggtctccatgcaagattcccttcgaaataaccgatttggagaaaaggcatgttctcggccggctgatcacagtgaacccgattgtcactgaaaaggactcccctgtgaacatcgaggccgaacccccatttggagatagctacatcattgtcggcgtggagcctgggcagttaaaactgaattggttcaagaagggatcgtctataggtcaaatgtttgagaccacaatgcgaggcgctaaacgcatggccatcctaggggacactgcatgggatttcggatccctcggcggtgtttttacctcaattgggaaggccctgcaccaggtgttcggcgctatctacggagcggcatttagtggcgtaagctggacgatgaaaattcttatcggggtcataatcacatggattggaatgaactccagatctaccagcttgtcagtgagtctggttctcgtgggcgtcgtgactctgtatcttggtgccatggtacaggctgactccgggtgtatcgtgagctggaagaataaagaactgaagtgcggatctggcattttcatcacagataacgttcacacctggactgagcagtacaagtttcaacccgaatcaccaagtaaattggccagcgcaatacagaaggcccatgaggaaggtatttgtggcatcaggtccgtcacccggctcgagaatctgatgtggaaacagattacacccgagttaaaccacatcctgtctgaaaatgaggtgaagctaacgataatgaccggggacatcaaaggaattatgcaggctggcaagcgctcgctcagacctcaaccaactgaactgaaatatagctggaagacatgggggaaggccaaaatgctttccaccgagtcacataaccagacattcttgatcgatggaccggaaactgcagagtgccccaataccaacagggcgtggaatagtctggaggtggaagactacggctttggtgtcttcacgacaaacatttggctcaagctgcgtgagaaacaggacgtattttgtgattctaagttaatgagcgctgccatcaaagacaatcgggcagtgcacgccgatatggggtattggatagaatccgctctgaacgacacctggaagatggagaaggcctcattcattgaggtgaaaagctgccactggcctaagtctcatactctttggtccaatggagtattggaaagtgagatgatcatcccaaagagcttcgcaggccccgtctctcagcacaactaccgacctggttatcatacccaaacagctggcccatggcacctcgggaagctggaaatggattttgacttctgtgagggaactaccgtggttgtgacagaagattgcggcaacagagggccctccctaaggacgaccactgcctcaggaaaactgattacagagtggtgctgtcgcagttgcaccctcccgcctctgcggtacagaggcgaggacggttgttggtacgggatggaaatcaggccacttaaggagaaggaagagaatttggtcaacagcctggtgactgcgggacatggccagattgataatttttcgttaggtgttctcggcatggccctgttccttgaagagatgctgcgcacacgagtggggaccaaacacgctatattgctcgtagcactgtcctttgtcacgctaatcactggaaacatgtctttccgggacctgggccgtgtgatggtgatggtcggggccaccatgacagatgacattggaatgggcgttacctatctcgctctgcttgccgcatttaaggtgagacccactttcgcggccggtttgctgttaaggaaactcacaagcaaggagctgatgatggctaccatcgggattgcccttctgtcacagagtacactacctgaaactatcctcgagctgaccgatgcattggctctgggaatgatggccttaaaaatagtacgcaatatggaaaagtaccaactcgcagtgacgatcatggccatttcctgcgtccccaacgctgtgatcctgcagaatgcgtggaaggtttcttgtacaattcttgccgcagtgagcgtctccccactgttgctcacctcaagccagcagaaagctgactggatccctctggccctaactataaagggcctgaaccccaccgccatttttcttacaactctcagtcggacctctaaaaagagatcctggccactgaatgaggctatcatggcagtgggcatggttagcatcttggcctcgtcactgctaaagaacgacattccgatgacggggcctctcgtggcgggaggtctgcttacagtctgctatgtactgaccggcaggtctgctgatttggaactcgagcgagccgcagacgtgaagtgggaggatcaagccgaaataagtgggtccagccccatcctgtctattactatcagcgaggacggatccatgtcaattaaaaatgaagaggaggaacagacactaaccatcctgatacgcactggccttctcgttatcagtggtgtgttcccagtcagcattcccatcacagctgcagcctggtacctgtgggaggtgaagaagcagcgggcgggggtattgtgggatgtgccttctccaccccctgtcggaaaagctgaattagaggacggcgcctatagaattaagcagaggggcatcctggggtactcccaaataggagccggtgtttataaagaaggcacctttcacacgatgtggcatgtgactcgtggggcagtgctcatgcaccgcggaaagcggattgagccgtcatgggctgatgtcaaaaaggacctgatcagttacggcggtgggtggaaacttgagggagaatggaaagagggcgaagaggtgcaggttctggccttggaaccaggcaagaaccccagagcagtacagaccaaacctgggatcttcaagacaaataccggaacaattggtgctgtgagcctagatttttccccaggcacttctgggtcgcccatcgtcgacaggaaaggaaaggtggttggcctgtacggtaacggggtggtcacccgaagcggagcctatgtgtcagcgatagcccagacggagaagtccattgaggataatcctgaaatcgaggacgatattttccggaaaaagcgcctcacaatcatggacctgcatccgggcgcaggcaaaactaagagataccttcccgctatagtaagggaagccattaaacgggggttacgaaccctgatcctcgctccaacaagagtcgtggcagccgagatggaagaggccttgcgcggactgcctatcaggtatcaaacccccgctattcgtgcggagcacactggtcgggaaatcgttgacctcatgtgtcatgcaaccttcacaatgagactgcttagtccaattagggtgcctaactacaacctgataatcatggatgaggcccactttacggaccccgcttctattgccgcacgcggctatatcagcactcgagtcgaaatgggggaggccgctggaatcttcatgaccgcgacaccaccgggctccagagatccttttccccagtcaaatgccccaattatggacgaggaacgggagatacccgaaaggtcttggaacagcggtcacgagtgggtgaccgatttcaaggggaagactgtttggtttgtgcctagtatcaaagcaggaaatgacattgctgcctgcttgcgcaagaacggcaaaaaggtcatccagctatcccgtaaaacattcgatagcgaatacgtgaagaccagagcaaatgactgggattttgtagtgacgactgacatttctgagatgggcgccaacttcaaggctgagcgggttatcgatccaaggcgctgtatgaaacccgtcatactgacagacggggaagaacgagtgatcctcgccggacctatgccggtgacccattcatccgcggcacaaagacggggtaggattggccgcaatccaaagaacgaaaatgaccagtatatctacatgggggagcccttagaaaacgatgaggactgcgcccactggaaagaggctaagatgctgcttgataatattaacacccctgaaggaatcatacccagtatgtttgagccagaaagagagaaagtcgacgccattgatggcgaatacaggctgcggggtgaggctcgtaagactttcgtagacctcatgcgccgaggggatttgcctgtgtggctggcatataaagttgccgctgagggcatcaattacgccgacagaaagtggtgttttgatggaattaagaacaatcagatcctcgaagagaacgtggaagtcgagatatggacaaaagagggcgaaaggaagaaactgaagccccggtggcttgacgcacgcatctatagcgatccactagcgctgaaagagttcaaggagttcgccgctgggagaaagtcgttgaccttaaacctgattacagagatgggaaggctccctacttttatgacgcagaaagcccggaatgcactggacaaccttgctgtgctgcataccgccgaagttggtggcaaggcatacacacacgccctctctgagttgccggagactctggaaaccctactgctccttacactgttagctgcggtgaccgggggaatcttcttgtttctgatgtccggcaaaggtattgggaagatgactctcggcatgtgctgcatcataacggccagcattctgctttggtatgcacaaatccagccccactggatcgctgcctcaattatcctggagttctttctcatagtcttgctgattccagaacctgagaaacagcgaacaccccaggataatcaattaacatacgtggtaatcgccattctaactgtggttgcagctaccatggccaacgaaatgggattcctggagaagacaaagaaagacctcggctttgggagtatcaccactcaggagtctgaatccaatatacttgacatcgatctgagaccagcgagcgcttggacattgtatgccgtcgcaacgaccttcgtgactcctatgctgcgccattcaattgagaacagtagcgtgaatgtctccctcacagccatcgctaaccaggcaaccgttctgatgggacttggtaagggctggcccctctctaaaatggacattggggtgccgctgttggccatcggatgttacagccaggtaaatccaattaccctgacagcggctttactactgctcgtggcccactacgcaatcataggccctggtcttcaagccaaggctactagggaagcccagaaacgggcagctgccgggattatgaagaaccccacggtcgatggcatcaccgtgatcgacctggagccaattccctatgatcctaagtttgaaaaacagttgggacaggttatgctgctcatactgtgcgtgacacaagtccttatgatgcgtactacctgggcgttatgtgaggccctgacactcgcaaccggcccgatctccactttgtgggaggggaatcccggaagattctggaacacgacaattgctgtatcaatggccaatatctttaggggctcttacctggccggtgctgggctactgttcagtattatgaagaacaccactaatacccgccggggaacaggcaacgtgggtgaaactctcggcgagaaatggaagtcgcgacttaatgccctggggaaaagcgaatttcagatctataagaaatccggaatacaggaggttgacagaaccttggccaaggagggcatcaagagaggggaaacagatcatcacgcggtgtctcgcggatcagctaaactgcggtggttcgtcgagagaaacatggtgacgccagaaggcaaggtcgtggacctcggttgcgggcgtggaggctggagctactattgtggtggcctgaaaaacgttagggaggtgaaggggttaaccaaaggaggccctgggcatgaggaacccattcctatgtccacttacggatggaatcttgtacggctgcaaagtggcgtggatgtcttctttacaccacccgagaagtgcgacaccctcctatgtgatatcggtgaatctagccctaacccaactattgaggcagggcgcacactgcgagttttgaatctggtggaaaactggctcaataacaatacccagttctgcatcaaggtccttaacccctatatgccgtcagtgatagagaaaatggaaacgctgcagagaaagtacggaggcgccttggtaaggaatcctctgtcccggaacagtacccacgagatgtactgggtgagcaatgctacaggcaacattgtttcttccgtgaatatgatctcacgcatgctcatcaacagatttactatgaaacacaagaaagccacctatgagccagacgtcgatttagggagcggaacaaggaatattggtatagaatcggagatccccaacctggacattatcggcaagcgaattgaaaagatcaaacaggagcatgaaacttcttggcactacgaccaagatcatccttataagacctgggcataccacgggagttatgagacaaaacagaccggatccgccagctcaatggtgaacggcgtcgtgcggcttctgactaagccatgggacgttgtacccatggtgacgcagatggctatgacagataccactccgttcggtcagcaacgtgtctttaaagagaaggtggacaccagaacacaggaacctaaggaggggacgaaaaagctaatgaaaataaccgcggaatggctctggaaggagctgggaaaagagaagactccccgcatgtgtacaagggaagagttcacccggaaagttagatccaatgccgcattgggcgctgtgtttactgatgaaaacaagtggaagtctgcccgcgaggcagtcgaagacggcaggttctgggagctggtggatcgagagcggaatctccaccttgaagggaaatgcgagacatgtgtatacaacatgatgggaaagagagagaaaaagctgggtgagtttggcaaagccaaggggagcagggctatctggtatatgtggttaggagcccgcttcctggaatttgaggcgttgggcttcctcaatgaggaccattggtttagtcgtggtaactccctgagcggggtggaaggagagggcctacaccggcttggctacattctgagagaagttgggaagaaagagggaggtgcaatgtacgccgatgacaccgctggctgggatacaaggatcactctcgaagacctgaagaatgaggagatggtcaccaaccatatgaaaggggaacacaagaaattggccgaggcaattttcaagctgacgtatcagaataaggtggtgcgcgtccagcgaccaacccctcggggaacagttatggacatcatttctagaaaagatcaaaggggctcaggtcaggtggggacttacggactcaacaccttcacaaatatggaagctcagcttatacgccaaatggagggcgagggcatctttaagagtattcagcatctgactgccaccgaagagatcgctgtacagaactggttagccagagtggggcgggaaaggctgtcccgtatggcaatcagcggagacgattgcgtcgtgaaacccattgacgatcgattcgcgtctgccttgacggctctcaatgacatgggtaaggttcgcaaagatatacagcaatgggagccatcgagaggctggaacgactggacacaggtgcccttttgctcacaccacttccatgaactggtcatgaaggatgggcgggtgctagtagttccttgtaggaatcaggacgagcttatcggacgcgccagaattagccagggcgcaggttggtccctgaaggagaccgcttgcctcgggaaaagttatgcccaaatgtggactctgatgtactttcaccggagggatttgcgattagcagccaacgcgatctgttctgctgtgccaagccattgggtcccgacatcccgtaccacttggtcaattcacgccaagcacgaatggatgaccacagaggacatgctggcagtgtggaacagagtgtggatccaggaaaatccctggatggaggataaaacgcctgtcgaaagttgggaggaggttccatatctcggaaagcgcgaagaccagtggtgcggctctcttataggcctgaccagccgggccacttgggctaaaaacatccagacagccattaatcaagtgaggtccctaatcgggaacgagggatacaccgactatatgccctcaatgaagagattccgccgggaagaggaagaggctggtgttctgtggtga

SEQ ID NO: 14907 - RNA, 9876 nt, synthetic construct
  misc_feature 1..9876: note = derived and/or modified CDS sequence (opt3) from DENV-2__KM279598__SS-prME
  source 1..9876: mol_type = other RNA
accgccggcatcattataatgatgatccccacagtgatggctttccacctgactacgcgaaacggggagcctcatatgattgtcagcaggcaggaaaagggaaagtccctcctttttaagaccgagaatggtgttaacatgtgcacactgatggcaatggacttgggcgaattatgtgaggatactatcacctacaattgcccactgctgcggcaaaacgaaccggaggacattgattgttggtgcaattctacatcaacctgggtgacttatgggacatgtaccgccacgggagagcaccgccgagaaaagcgtagtgtagcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaagaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcacgctcagaccccagcctaccgagctgaagtacagctggaaagcctggggcaaggcaaagatgctttccactgaattgcacaatcatacattcctgatcgatgggccagagaccgcggaatgcccgaacacaaatagggcttggaactcactcgaggtcgaggactatggatttggcgtgttcactaccaatatatggctgaaattaaaggaacgtcaagatgtattttgtgacagtaaactgatgtctgccgcaatcaaggacaaccgggccgtgcacgctgatatgggttactggattgagagcgcccttaacgacacgtggaaaatcgaaaaggcatccttcattgaggtcaagtcatgccactggcccaaaagccatacattgtggtctaatggggtgctcgagtccgaaatgatcatacctaagaacttcgctggaccagttagtcagcacaattatcgacccggctaccatacccagactgccggtccttggcacctgggcagactagagatggattttgacttctgtgaagggaccacagtggtagtcactgaggattgcggaaacaggggcccaagcctgcgcaccacaacggcgtctgggaaactcattaccgaatggtgctgtcggtcctgcactctgcccccgcttagatacaggggagaggacggctgttggtatggtatggagatccgccctttgaaggaaaaagaggaaaatctggtgaactcattagtgacagccgggcatggacagatcgataattttagtctcggcgtcctgggtatggctcttttcctggaggaaatgttgcgaacccgggttggcactaagcacgcaattctcctggtggccgttagctttgtgacactaatcaccgggaacatgtcgttccgtgacgtcggaagagtgatggttatggtgggcgctacgatgactgatgacattgggatgggagtcacctacctggccctcctggcagcgtttaagataaggccaacattcgccgctggccttttgctgcgcaaattaacctccaaggagctcatgatgactacaatcggtattgtgctgctttctcaaagcaccatccccgagtcaattctggaactaacagatgccctcgcactggggatgatggttttgaaaatcgtgcggaatatggagaagtatcagctggctgtcactataatggccatcttatgcgtacctaacgcagtgattctccagaatgcctggaaagttagttgtaccacgctggctgtggtctccgtgtctccccttctgttgacaagctcccaacagaaggcggactggatcccactcgccctgaccattaagggactaaaccctactgcaatctttctgaccacactttcaagaactagcaaaaagaggagttggcccctcaatgaagctataatggccgtaggcatggtgtctattctggcctccagcttgctgaaaaacgatatcccaatgaccggcccgttagtcgctgggggactcctgacggtttgctacgtgcttacaggtcgatcggcagacctggagttggaacgcgccgcggacgtgcggtgggaggagcaggctgaaatctcaggctctagtcctattctctccataaccatcagcgaggatgggtctatgagcattaagaatgaagaggaggaacagactctgacaatcctaattagaaccggactgcttgtcatctccggcctcttccccgtgtcaataccaatcactgccgcagcctggtatctgtgggaggttaaaaagcaaagggctggtgtattgtgggacgtgcccagtcctccacccgtcgggaaagcagaattagaggatggagcctaccgtattaagcagaagggcatcctgggctatagccagattggggcgggagtgtacaaagaaggtacatttcacaccatgtggcatgttacgcgcggcgctgtgctcatgcacaaggggaaacggatcgagccttcttgggccgacgtcaagaaagatctgatatcctacggaggcggttggaaacttgagggggaatggaaggagggagaagaggtgcaggtactggcattggaaccgggcaaaaacccaagagccgtccaaactaagcccggcctattcaaaaccaacacagggaccattggagctgtgtcactggactttagtcctggtacaagcggctccccaatcgttgataagaaagggaaggtggtcggactctatggcaatggtgtggttactaggtctgggacctacgtgtcggccatcgcacagacggaaaagagcattgaggacaaccccgaaatcgaggatgacatattcagaaagaagcggctgacaattatggatcttcatcctggagctggcaaaactaagcgctatttaccggccatcgtcagagaagcgattaaaaggggcctgcggaccctcatcttggcccccacacgagtggtagcagctgagatggaagaggccctgagagggctcccaatacgctaccagacccctgctattagggcagagcacactggacgtgaaatcgtggacctgatgtgtcatgccaccttcacaatgcggcttctgtcacccatcagagttccaaattataacttgattatcatggatgaggcccactttacggaccctgcttccattgcggcaaggggttacataagtactcgcgtcgaaatgggcgaggccgctgggatcttcatgaccgccacacccccaggatctcgagacccgtttcctcagagcaatgcacccattatggatgaggaaaaggagatcccagaaagatcctggaactcaggccacgagtgggtgaccgacttcaagggtaaaactgtgtggtttgtcccctctatcaaggccgggaatgatattgctgcgtgcctacggaaaaacggaaagaaagtaatacaactgagcaggaagacattcgacagtgaatatatcaagacccgcacgaatgattgggactttgtggttactacagatatttccgagatgggcgccaacttcaaagcagagcgtgtgatcgaccctagacggtgtatgaagccagtcattctcaccgatggcgaagagagggtgatcttagctgggcccatgcctgttacccatagctctgccgcacagcgccgaggaagagtgggtcggaatccgaaaaacgaaaatgaccagtacatatacatgggcgagccactggaaaacgatgaggactgcgcccactggaaggaggctaaaatgcttctggacaatatcaacactcccgaagggattatcccttcaatgtttgagcccgaaagggagaaggtcgatgccattgacggagaatatcgcctcagaggcgaggcgaggaaaacattcgtggatttgatgcggcgtggtgacctgccagtatggctcgcataccgcgtggccgctgaggggatcaactatgccgatcgaagatggtgttttgacggcgttaagaataaccaaatactggaagagaatgtcgaagtggagatttggaccaaggagggagaaaggaagaaacttaaacctcggtggctagatgctcgcatctactccgaccccctggcattgaaagagttcaaagagttcgccgctggcagaaagagtttaacactgaacctcattactgagatggggaggctgccaacgtttatgacccagaaggccaaaaatgcacttgataacctggcggtgctccatacagccgaagctggaggtcgggcctataatcacgcattgagcgagctgcctgagactctagaaaccctgctccttctgacattattggctaccgtcactggcgggatcttcctgtttctcatgtcgggaaagggcataggtaaaatgacgctggggatgtgctgcatcattaccgcctctatccttctgtggtacgcacagattcagccgcactggatcgccgcttccataattctcgagttctttttgatcgttctgttaatccccgaaccagagaagcaacgaacacctcaggacaaccagctaacttatgtggtaattgcgatcctgaccgtggtcgccgcaacaatggctaatgaaatgggcttcctcgagaaaaccaagaaggattttggacttggcagcataactacacagcaacccgagtcaaacattctggacatcgatttgagaccagccagtgcctggacgctgtacgcagtggctaccactttcattacacctatgctccgccattctatcgaaaattccagcgttaacgtgtcactgaccgccatagcgaatcaggctaccgtccttatggggctcggaaaaggttggcccctgagtaagatggacatcggcgtaccgttgctggccattgggtgttacagccaggtgaacccaatcacattaactgcagccctactgctccttgttgctcactatgcaattatcggacctggcctgcaggccaaagcgacgagggaggctcaaaagcgggccgcagccggtattatgaaaaatcccaccgtggacgggatgacagtcatcgatttggacccaataccctacgatcctaagtttgaaaagcagctgggccaggtgatgctcctggtcctttgcgtgactcaggttttaatgatgcgtaccacatgggctctgtgtgaggccctcaccttggcaactggaccgatttccacgctgtgggaaggcaaccccgggagattctggaatacaaccatcgctgtgtctatggccaacatctttaggggaagctatctagcgggcgccggtctactcttctccattatgaaaaacactgcaaatacccgccgggggacaggaaacactggcgagacccttggtgagaagtggaaaaatcgactgaacgctttgggcaagtcagaatttcaaatatacaaaaagtctgggatccaggaggtagacagaacactggccaaagaaggaattaagaggggcgagacggatcatcacgcagtgagtcgcgggtcggctaagctccggtggttcgtcgagagaaatctggttaccccagaaggaaaagtggtcgacttaggctgcggtcgtgggggatggagctattactgtggcggtcttaagaacgtgaaagaggtaaagggcctgactaaagggggacctggccatgaggaacccatccctatgtccacatatgggtggaatctcgtgaggctacagtctggagttgatgtgttctttaccccacccgaaaagtgcgacactctgttgtgtgatattggcgagtcaagccctaacccaacagtcgaggccggtcggaccctgcgcgtgctcaatcttgtcgaaaactggctgaataacaatacgcaattctgcatcaaggtgttgaacccctacatgccgtccgttatagagaaaatggaagccctgcagcgaaagtacgggggagcgctcgtaagaaatcctttaagtaggaactctacccacgagatgtattgggtgagcaacgcttcaggcaatatcgtctccagtgtgaacatgattagccggatgctgatcaatcgctttacaatgagacacaaaaaggcaacttacgaaccagacgttgatcttggctctgggaccaggaacattggaatcgagtccgagacacccaatctggacataattggtaaacgaatcgaaaagatcaagcaggagcatgaaacttcatggcactatgatcaggaccatccttacaaaacctgggcctatcacggcagctacgagacaaagcaaaccgggtcggcttctagtatggtgaacggagtcgtgcggctactcactaaaccatgggacgtaattcccatggtgacgcagatggccatgacagataccactccgttcggccagcagcgtgtttttaaggaaaaagtcgacaccagaacacaagagcctaaggagggtacgaagaaactgatgaagataaccgcagaatggttgtggaaagagctggggaagaaaaagactccccgcatgtgtacaagggaagagttcacccggaaagtgagatccaatgccgctctcggagcgatctttactgatgagaacaagtggaaaagcgcccgcgaagcagtggaggactcaggcttctgggaacttgtcgataaagagaggaatctgcacttagaaggcaagtgcgagacatgtgtttataacatgatggggaaacgagagaagaaactgggagaatttggtaaggctaagggctcccgggccatttggtacatgtggttgggggcaagattcctcgagtttgaagccctgggattcctaaatgaggaccattggttttctagggaaaacagccttagtggcgtggagggtgaggggctgcacaaactcggatacatcctgcgcgatgtatccaagaaagaaggcggcgctatgtatgccgacgataccgcggggtgggacacacgtattactttggaggatctgaagaatgaagagatggtgaccaaccatatggaaggagagcacaaaaagctcgcagaggccatcttcaaacttacgtaccagaataaagtcgtgcgggttcagagaccaacccctaggggtacagtgatggacataatcagccgccgagaccagcggggctctgggcaagtcgtgacttatggactgaacaccttcacaaacatggaagctcagttaattagacagatggagggcgaaggtgtatttaagtcaatccaacagctgactgttaaagaggagattgccgtgaagaattggttgatcagggtcgggcgcgaaagactcagtcggatggcaatttccggagatgactgcgtggtgaaacccctggatgacaggttcgctagcgccctaaccgctcttaacgatatgggcaaggtccgtaaggacatacagcagtgggagccatctcgaggctggaatgattggacgcaagttcccttttgctcgcatcacttccacgaactgatcatgaaagacgggcgcgtgctcgtagtgccttgtagaaaccaggatgagctgattggacgggccaggatctcacagggtgcaggctggagcttgcgcgaaacagcgtgcttagggaagtcctacgcccagatgtggagtctgatgtattttcatagacgggacctcaggcttgctgccaatgcaatctgttctgctgtcccaagccactggattccgacctcccgaactacatggtcaatacatgccacccacgagtggatgactaccgaggatatgctgacagtgtggaaccgtgtttggatccaagaaaatccctggatggaggacaaaacgcctgtggaaagttgggaggaaattccatacctaggaaagagagaggatcagtggtgcggctctctgatcggtctcaccagccgcgcaacttgggccaaaaacattcagacagcgatcaatcaggtccggtccttgatagggaacgaggaatataccgactacatgccctcaatgaagaggttcagacgcgaggaagaggaagctggagtgctgtggtga

SEQ ID NO: 14908 - RNA, 9876 nt, synthetic construct
  misc_feature 1..9876: note = derived and/or modified CDS sequence (opt3) from DENV-2__KM279576__SS-prME
  source 1..9876: mol_type = other RNA
accgccggcatcattataatgatgatccccacagtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcacgctcagaccccagcctaccgagctgaagtacagctggaaagcctggggcaaggcaaagatgctttccactgaattgcacaatcatacattcctgatcgatgggccagagaccgcggaatgcccgaacacaaatagggcttggaactcactcgaggtcgaggactatggatttggcgtgttcactaccaatatatggctgaaattaaaggaacgtcaagatgtattttgtgacagtaaactgatgtctgccgcaatcaaggacaaccgggccgtgcacgctgatatgggttactggattgagagcgcccttaacgacacgtggaaaatcgaaaaggcatccttcattgaggtcaagtcatgccactggcccaaaagccatacattgtggtctaatggggtgctcgagtccgaaatgatcatacctaagaacttcgctggaccagttagtcagcacaattatcgacccggctaccatacccagactgccggtccttggcacctgggcagactagagatggattttgacttctgtgaagggaccacagtggtagtcactgaggattgcggaaacaggggcccaagcctgcgcaccacaacggcgtctgggaaactcattaccgaatggtgctgtcggtcctgcactctgcccccgcttagatacaggggagaggacggctgttggtatggtatggagatccgccctttgaaggaaaaagaggaaaatctggtgaactcattagtgacagccgggcatggacagatcgataattttagtctcggcgtcctgggtatggctcttttcctggaggaaatgttgcgaacccgggttggcactaagcacgcaattctcctggtggccgttagctttgtgacactaatcaccgggaacatgtcgttccgtgacctgggaagagtcatggtgatggttggcgctacgatgactgatgacattgggatgggagtgacctacctcgccctgcttgcagcgtttaagataaggccaacattcgccgctggcttgctgttacgcaaactcacctccaaggagctgatgatgactacaatcggtattgtccttctgtctcaaagcaccatccccgagtcaattctagaactcacagatgccctggcattggggatgatggtgctgaaaatcgttcggaatatggagaagtatcagttagctgtgactataatggccatcctctgcgtccctaacgcagtaattctgcagaatgcctggaaagtgagttgtaccacgcttgctgttgtgtccgtctctcccctgttgctcacaagctcccaacagaaggcggactggatcccactggccctaaccattaagggactgaaccctactgcaatctttcttaccacactctcaagaactagcaaaaagaggagttggcccctgaatgaagctataatggccgtgggcatggtatctattttggcctccagcctgctaaagaacgatatcccaatgaccggcccgctcgtggctgggggactgcttacggtctgctacgttctgacaggtcgatcggcagacttggagctcgaacgcgccgcggacgtgcggtgggaggagcaggctgaaatctcaggctctagtcctattctgtccataaccatcagcgaggatgggtctatgagcattaagaatgaagaggaggaacagactctaacaatcctgattagaaccggacttctcgtgatctccggcctgttccccgtctcaataccaatcactgccgcagcctggtatttgtgggaggtgaaaaagcaaagggctggtgttttatgggacgtacccagtcctccacccgtggggaaagcagaactggaggatggagcctaccgtattaagcagaagggcatcctcggctatagccagattggggcgggagtctacaaagaaggtacatttcacaccatgtggcatgtgacgcgcggcgctgttctgatgcacaaggggaaacggatcgagccttcttgggccgacgtgaagaaagatcttatatcctacggaggcggttggaagctggagggggaatggaaggagggagaagaggtccaggtgttggcactagaaccgggcaaaaacccaagagccgtacaaactaagcccggcctgttcaaaaccaacacagggaccattggagctgtctcactcgactttagtcctggtacaagcggctccccaatcgtggataagaaagggaaggttgtgggactgtatggcaatggtgtcgtgactaggtctgggacctacgtttcggccatcgcacagacggaaaagagcattgaggacaaccccgaaatcgaggatgacatattcagaaagaagcggcttacaattatggatttacatcctggagctggcaaaactaagcgctatctgccggccatcgtgagagaagcgattaaaaggggcctccggaccttgatcctggcccccacacgagtcgtggcagctgagatggaagaggccctcagagggctgccaatacgctaccagacccctgctattagggcagagcacactggacgtgaaatcgtagaccttatgtgtcatgccaccttcacaatgcggctgttgtcacccatcagagtgccaaattataacctaattatcatggatgaggcccactttacggaccctgcttccattgcggcaaggggttacataagtactcgcgttgaaatgggcgaggccgctgggatcttcatgaccgccacacccccaggatctcgagacccgtttcctcagagcaatgcacccattatggatgaggaaaaggagatcccagaaagatcctggaactcaggccacgagtgggtcaccgacttcaagggtaaaactgtgtggtttgtgccctctatcaaggccgggaatgatattgctgcgtgcctgcggaaaaacggaaagaaagtcatacaactcagcaggaagacattcgacagtgaatatatcaagacccgcacgaatgattgggactttgtagtgactacagatatttccgagatgggcgccaacttcaaagcagagcgtgttatcgaccctagacggtgtatgaagccagtgattttaaccgatggcgaagagagggtcatcctggctgggcccatgcctgtgacccatagctctgccgcacagcgccgaggaagagttggtcggaatccgaaaaacgaaaatgaccagtacatatacatgggcgagccacttgaaaacgatgaggactgcgcccactggaaggaggctaaaatgctgctcgacaatatcaacactcccgaagggattatcccttcaatgtttgagcccgaaagggagaaggtggatgccattgacggagaatatcgcttgagaggcgaggcgaggaaaacattcgtcgatctgatgcggcgtggtgacctcccagtgtggctggcataccgcgtagccgctgaggggatcaactatgccgatcgaagatggtgttttgacggcgtgaagaataaccaaatacttgaagagaatgttgaagtcgagatttggaccaaggagggagaaaggaaaaagctaaaacctcggtggctggatgctcgcacatactccgaccccttggcattaaaggagttcaaagagttcgccgctggcagaaagagtctgactctcaacctgatcacggagatggggaggcttccaacctttatgacacagaaggccaaaaatgcactggataacctcgcggtgttgcatactgccgaagctggaggtcgggcctataatcacgcactgagcgagctacctgagaccctggaaacactccttctgttaaccttgctggctactgtgacgggcgggattttcctctttctgatgtcgggaaagggcatcggtaaaatgacccttgggatgtgctgcataatcacagcctctattctgctctggtacgcacagatccagccgcactggattgccgcttccatcatattggagttctttctgattgtcttactaatccccgaaccagagaagcaacgaactcctcaggacaaccagctgacctatgttgtgatcgcgattctcacagtagtggccgcaaccatggctaatgaaatgggcttccttgagaaaactaagaaggattttggactgggcagcatcacaacgcagcaacccgagtcaaacatattggacattgatctgagaccagccagtgcctggaccctctacgcagtcgctactacattcatcacccctatgctgcgccattctattgaaaattccagcgtgaacgtttcacttaccgccatcgcgaatcaggctacagtgctcatggggctgggaaaaggttggcccttgagtaagatggacataggcgtcccgctgttagccatcgggtgttacagccaggtaaacccaattactctaacggcagccctgctccttctggtggctcactatgcaatcattggacctggcttgcaggccaaagcgaccagggaggctcaaaagcgggccgcagccggtatcatgaaaaatcccacagttgacgggatgactgtgattgatctggacccaatcccctacgatcctaagtttgaaaagcagctcggccaggtcatgctgcttgtgttatgcgtcacccaggtgctgatgatgcgtacaacctgggctctctgtgaggccttgactctggcaacgggaccgatatccacactatgggaaggcaaccccgggagattctggaataccactattgctgtttctatggccaacatctttaggggaagctatctggcgggcgccggtctccttttctccatcatgaaaaacaccgcaaatacacgccgggggactggaaacaccggcgagacactgggtgagaagtggaaaaatcgattgaacgctctgggcaagtcagaatttcaaatttacaaaaagtctgggatacaggaggtggacagaacgctcgccaaagaaggaatcaagaggggcgagaccgatcatcacgcagtaagtcgcgggtcggctaagctgcggtggttcgtggagagaaatttagtcactccagaaggaaaagttgtggaccttggctgcggtcgtgggggatggagctattactgtggcggtctgaagaacgtcaaagaggtgaagggcctcacaaaagggggacctggccatgaggaacccattcctatgtccacctatgggtggaatctagtaaggctgcagtctggagtggatgttttctttactccacccgaaaagtgcgacacattgctgtgtgatatcggcgagtcaagccctaacccaaccgtggaggccggtcggacgctccgcgtccttaatctggtggaaaactggttgaataacaatacccaattctgcattaaggtcctgaacccctacatgccgtccgtgatcgagaaaatggaagccctccagcgaaagtacgggggagcgttagttagaaatcctctgagtaggaactctacacacgagatgtattgggtaagcaacgcttcaggcaatatagtgtccagtgtcaacatgatcagccggatgcttattaatcgctttactatgagacacaaaaaggcaacctacgaaccagacgtggatctgggctctgggacaaggaacatcggaattgagtccgagactcccaatctagacatcataggtaaacgaattgaaaagatcaagcaggagcatgaaacctcatggcactatgatcaggaccatccttacaaaacatgggcctatcacggcagctacgagaccaagcaaactgggtcggcttctagtatggttaacggagtggtccggctcctgacgaaaccatgggacgtgatccccatggtaacacagatggccatgaccgatactaccccgttcggccagcagcgtgtgtttaaggaaaaagttgacacaagaacgcaagagcctaaggagggtaccaagaaattgatgaagattactgcagaatggctgtggaaagagctcgggaagaaaaagacaccccgcatgtgtaccagggaagagttcactcggaaagtcagatccaatgccgctcttggagcgatatttacagatgagaacaagtggaaaagcgcccgcgaagcagtggaggactcaggcttctgggaactggtggataaagagaggaatttacacctggaaggcaagtgcgagacctgtgtctataacatgatggggaaacgagagaagaaattgggagaatttggtaaggctaagggctcccgggccatctggtacatgtggctcggggcaagattcctggagtttgaagccctaggattccttaatgaggaccattggttttctagggaaaacagcctgagtggcgttgagggtgaggggctccacaaactgggatacattttgcgcgatgtgtccaagaaagaaggcggcgctatgtatgccgacgatacagcggggtgggacactcgtatcaccctggaggatctcaagaatgaagagatggtaacgaaccatatggaaggagagcacaagaaacttgcagaggccattttcaaactgacctaccagaataaagtggtccgggtgcagagaccaacacctaggggtactgttatggacatcataagccgccgagaccagcggggctctgggcaagtggtcacctatggattaaacacattcactaacatggaagctcagctgatcagacagatggagggcgaaggtgtgtttaagtcaattcaacagttgaccgtaaaagaggagatcgccgttaagaattggctcattagggtggggcgcgaaagactgagtcggatggcaatctccggagatgactgcgtcgtgaaacccctagatgacaggttcgctagcgcccttacggctctgaacgatatgggcaaggtgcgtaaggacattcagcagtgggagccatctcgaggctggaatgattggacacaagtccccttttgctcgcatcacttccacgaactcataatgaaagacgggcgcgttctggtggtaccttgtagaaaccaggatgagttgatcggacgggccaggatttcacagggtgcaggctggagcttacgcgaaaccgcgtgcctggggaagtcctacgcccagatgtggagtctcatgtattttcatagacgggaccttaggctggctgccaatgcaatctgttctgctgtgccaagccactggatcccgacttcccgaacaacctggtcaattcatgccactcacgagtggatgaccacagaggatatgctaacggtctggaaccgtgtgtggatacaagaaaatccctggatggaggacaaaacccctgttgaaagttgggaggaaatcccatacctgggaaagagagaggatcagtggtgcggctctctcattggtttgactagccgcgcaacatgggccaaaaacatccagaccgcgattaatcaggtgcggtccctgatcgggaacgaggaatatactgactacatgccctcaatgaagaggttcagacgcgaggaagaggaagctggagtcctttggtga

SEQ ID NO: 14909 - RNA, 9876 nt, synthetic construct
  misc_feature 1..9876: note = derived and/or modified CDS sequence (opt3) from DENV-2__KC964095__SS-prME
  source 1..9876: mol_type = other RNA
agcgcaggaatgatcattatgctgatacccaccgtgatggctttccacctcacaactcggaatggggagcctcatatgatcgtctccattcaggaaaagggaaaatctcttctgtttaagacggaggacggtgttaatatgtgcaccttgatggcaatggatttaggcgaactgtgtgaggacacaatcacttacaaatgcccactactcaggcaaaatgaaccggaggatattgaccggtggtgtaattcaaccagtacatgggtgacctatgggacttgcacaaccacgggagagcaccgccgagaaaagcgtagcgtagccctggtgccccatgtcggcatgggtcttgagactagaaccgaaacatggatgtcctctgagggggcgtggaaacacgctcagaggatcgagacttggattctgcggcatcctggattcaccatcatggccgcaattttggcctacacaatcggcaccacgcactttcagcgcgctctcattttcatcctgctgactgcagtggccccacccatgacaatgagatgtataggcatttcgaacagggattttgttgaaggggtgtcaggaggtagctgggtcgacatcgtgctcgagcacggcagttgcgtaaccactatggctaagaataagcctacattagatttcgaactgattaaaaccgaggccaagcagccagcgacgcttcggaaatattgtatcgaagcaaagttgaccaacacaactaccgagtcccgctgccccacacaaggggagccttctctgaaagaggaacaggacaagcgatttgtttgtaagcatagcatcgtggatagaggatggggcaatggttgcgggtccttcggaaaaggcggcattgtcacttgtgccatgtttacctgcaagaaaaacatggaagggaagatagtgcagccagagaatctagaatacacaatcgtggtcaccccgcactcaggagaggagcatgctattggtaacgacactggcaaacacgggaaggaaatcaaagttacgccccagagtagcgtgacagaggccgaactcaccggatatggcactgtaaccatagagtgctctcctaggacaggtctggatttcaatgaaatggtgcttctgcaaatggggaacaaggcatggttggtccaccggcagtggtttctcgacctgccattaccctggctgcctggcgctgatacccagggatccaattggattcagaaggagactctcgtgacattcaaaaacccacatgccaagaaacaagacgttgtggtccttggctcacaggagggggcgatgcacacggccctgaccggagcaactgaaatccagatgagcagtggtaatttgctatttacaggccatctgaagtgtgggctccgtatggacaaactgcaacttaagggaatgtcttactccatgtgcaccggcaagttcaaagtggtaaaggagatcgctgaaacacagcacggtactattgttatccgcgtgcagtatgagggggatggcagcccctgtaaaattccgttcgagataatggacctggaaaagagatacgtcttgggaaggctcatcaccgtgaaccctattgtcacggagaaagattcgcccgtgaacatcgaagccgagccaccttttggcgactcttacatcattataggggttgaacccggacagctgaagttaaattggttcaagaaaggttcctcaatcggccaaatgtttgagaccacaatgagaggggctaagcgaatggccattctgggagatactgcatgggacttcggcagtctaggtggggtgtttaccagcatcggcaaagccctccatcaggtattcggagctatttatggcgcggcattttccggggtctcttggacaatgaagatcctgataggagtgatcattacttggatcggcatgaacagccgctcaaccagtctttccgttagcttggtgctggtcggtattgtgacgctctacctgggggtaatggtgcaggccgattctggatgcgttgtctcatggaaaaataaggagcttaagtgtggcagtggtatcttcataacagacaacgtgagaacctggactgaacagtataaatttcaaccagagagcccctccaagctggcttctgccattcagaaagcacaggaagagggcatctgcgggattaggtcggtgacacggttggaaaatctcatgtggaagcagatcacccctgagctgaaccacatattagccgagaatgaagtcaaactgactatcatgaccggagatattaagggcacaatgcaagctgggaaacgcagcctaagaccacagccgacggagctcaagtactcctggaagacctggggaaaagccaagatgctgtcaactgaaagtcacaaccagacattccttatcgacggccccgagaccgcagaatgtcctaatacaaacagggcgtggaactctttggaggttgaggattatggttttgggatgttcactaccaacatttggctgcagctcaaagaaaagcaagacgctttttgcgacagcaaactgatgtccgccgcaatcaaggataatcgtgccgtgcatgctgacatgggatactggatagagtcagccttaaacgatacgtggaagattgaaaaagcgagcttcatcgaggtgaagaattgtcactggccaaaatctcatacactgtggtccaacggcgtacttgagagtgaaatgatcattcccaagaacttggctggtcctgtcagccagcacaattatcggccaggctaccacacccagatcgccgggccctggcatcaaggaaaaccggagatggacttcgatttttgcgacggcactaccgtggttgtgacagaagattgtgggaaccgaggaccttctctcagaactaccacagcgtccggcaagctgattacggagtggtgctgcaggtcatgtaccctaccacccctgcgctaccggggtgaagacgggtgctggtatggaatggagataagacctctcaaggagaaagaagagaatctggtcaacagtcttgtgactgccggccacggtcagatcgataatttcagcttgggcgttctggggatggctttatttctcgaagagatgctgaggacacgcgtgggaaccaagcatgcaattcttctggtagccgtctcgttcgtgactttgatcacaggcaacatgtcctttaaagacctcgggcgagtggtcgttatggtgggagctaccatgacggatgacattggcatgggtgtaacttacctggccctactggcagcgttcaaggtgcggcccacctttgccgctgggctcctgcttcgtaaattgacatctaaggaactgatgatgaccactatcggaatagtcttactcagccagtcaacaatcccagagaccgtgctggagcttacagatgccctggcactaggcatgatggctctcaagattgttagagacatggaaaaatatcagctggccgtgactatcatggcaattttgtgtgtccctaatgccgtgatcctgcaaaacgcttggaaggttagttgcaccatattagcggtggtctccgtatctcccctcctgcttacgagctcccagcagaaaacagactggattccactggccttgaccatcaagggcctcaatccgactgcaatcttcctgaccacactatcaaggactaacaaaaagcgcagctggcctctgaatgaggctattatggccgtggggatggttagtatacttgcctcttccctcctgaaaaacgatatccccatgaccggaccattggtggctggtggcctgttaacggtctgttacgtgctcacagggcggagcgcagacctggaacttgagagagccaccgatgtaaattgggaagaccaggcggagatttcgggatcatctcccatcctgagtattactatctccgaggatggcagcatgtctataaagaacgaagaggaggaacaaacattgaccatcctcattaggactggtctgctagtgatcagcgggctgtttcctgtctccattccaatcacagctgccgcatggtatctttgggaggttaagaaacagcgagccggagtgctctgggacgtgccctcacctccgccaatgggcaaggctgaactggaggatggcgcataccgcataaaacagaagggggtcttgggatatagtcagattggtgccggcgtgtacaaagaagggaccttccacacgatgtggcatgttactcggggagcggtattaatgcacaagggcaagagaatcgagcccagctgggctgacgtgaaaaaggatctgatctcttacggtgggggatggaaactcggcggcgaatggaaggagggggaggaagtccaagtgctggcccttgagcctggcaagaatccaagggcagttcagaccaagcccggtctgtttaagacaaacaccggcacaattggggccgtgtccttggacttctcacctggaacaagtggcagcccgatcatagataaaaagggtaaagtcgaagggctatatggaaacggcgtggtaacccgttccggcacgtacgtctctgctattgcccagacagagaagtcgatcgaagacaatcccgagattgaggatgacatctttcgcaaaaagcggctgactataatggacctccacccaggggcaggaaagaccaaaagatatctgcctgctattgtgagggaagccatcaagcgaggtcttcggacattaatcctggcgcccacccgcgttgtggccgcagagatggaagaggctctcagaggcttgccaattaggtaccaaactcctgccatccgggctgaacataccgggcgagagattgtcgatctgatgtgccacgcaacattcacgatgagactcctgagccccgtgcgcgttccaaactataatcttataatcatggacgaggcccatttcactgatccggcctcaattgctgcgaggggatacatctccacccgtgtggaaatgggcgaggcagccggtatctttatgacagctacccctcccgggagtcgggacccattcccccagtctaacgcccctattatagatgaagagagagagatcccagaaaggagctggaactccggacacgagtgggtcactgactttaaaggcaagacagtgtggttcgtaccctcaattaaagcaggcaacgatatcgccgcttgtctgcgcaagaatgggaagaaagtgattcagttgtctcgaaagacctttgacagcgaatatgttaaaacgagaactaacgattgggacttcgtcgtgacaaccgatatcagtgagatgggagcgaattttaaggccgaacgggtgatagaccctaggcgctgcatgaaaccggtcatcctaaccgacggtgaggagcgtgtaattctggcaggcccaatgcccgtgactcattccagcgctgcccagagacgggggaggatcggacgcaaccctaagaatgaaaacgatcaatacatttacatgggcgagcccctcgaaaatgacgaggattgtgcacactggaaagaagccaagatgttactggacaacatcaatacaccagagggtataattccttctatgttcgagcccgaacgagagaaggttgatgctatcgacggggaatatagacttcggggcgaggccaggaaaacctttgtggatctgatgcgcagaggagacctcccagtctggttggcgtacaaggtggcagccgaaggcattaactatgctgataggcggtggtgcttcgacgggatcaaaaacaatcagatactggaggagaacgttgaagtggagatctggacaaaggaaggagagcgtaaaaagctcaagcctcgctggctggatgcccgaatttactcagacccgcttgctctaaaagagtttaaggagttcgcagccggtagaaaatccctgactttgaatttaatcacggagatgggcaggctgcccaccttcatgacacagaagactcgggatgctctcgacaacctggccgtccttcacaccgcagaagcaggcgggcgcgcctataatcatgctctgagtgagctcccagaaacattggagaccctgctactgctcactcttctggccacggtgaccgggggtatatttttattcttgatgagcgggagaggcatcggaaaaatgacactgggcatgtgttgcataattactgcatcgatcctcctgtggtacgctcagatccaacctcactggattgccgcatctatcatacttgagtttttcctgattgtactcttgatccccgaaccagagaagcagaggacccctcaggacaaccagctgacatatgtggttattgccatcttaaccgtcgtggctgcgactatggccaatgaaatggggtttctagagaagactaaaaaggatctgggactcggttccataacgacccaacagcccgaaagcaacatccttgacattgatctgccgccagcatcagcttggactttgtacgccgtggccacaaccttcgtcacccctatgctgcggcatagtatcgaaaattcttccgttaacgtgagcctcacagcaattgctaatcaggccactgtactgatgggccttgggaaaggatggcccctctcaaagatggacatcggcgtgccactgttggcgattggttgctacagtcaggtcaaccccatcacgctgaccgctgccttactactgctcgtggcacactatgccataattgggcctggccttcaagctaaagcaacacgagaggcccagaagagagcggctgccggaatcatgaagaatccgactgttgatggcatcaccgtgattgacctggatcccataccatacgaccctaaatttgaaaagcagttggggcaagtcatgctgctcgtactgtgtgtgacacaggttcttatgatgcgcaccacttgggcattatgcgaggccctgacgctcgctacaggacccatcagcaccttgtgggaaggcaaccctggtaggttctggaatactaccattgccgtgtccatggcaaacatctttcgggggtcttatctggctggagccggcctactgttcagcattatgaaaaatacaactaacacccgtagaggtacaggcaacatcggggagacgctcggagaaaagtggaaatccaggcttaatgcgctgggcaagtcagagtttcagatatacaaaaagtctgggatccaggaggtcgatcgcaccttggccaaggaaggaattaaacggggcgagactgaccaccatgcagtgagtcgaggttcggctaagctgagatggttcgtcgaaaggaacatggtgacaccagaggggaaagttgtggatctcggatgtggccgcggtggctggagctattactgcgggggactgaagaatgtacgggaggtgaaaggcttaaccaaagggggacccggccacgaggaacctatcccaatgtccacttatggttggaaccttgtcagactgcaatctggggttgacgtgtttttcattcccccggaaaagtgtgatacactcctatgcgacatcggagagtggtcacctaatccaaccgtcgaagccggccgtacgctgagggtgttgaacctggtagagaattggctcaacaataacacccagttctgtataaaagtgcttaatccctacatgcctagcgttattgagaagatggaaacactgcagcggaaatacggcggggcattggtgcgcaacccactgtcccgaaatagtactcatgagatgtattgggtctctaacgctagcggaaatatcgtgtcatccgtcaacatgatcagtagaatgctcattaacaggtttaccatgcggcacaagaaagccacatacgaacccgacgtggatttaggtagcggcactcgcaatatagggatcgagtctgaaaccccgaacctggacattatcggaaagagaattggcaagatcaaacaggagcatgagacatcctggcactatgatcaagaccacccttacaagacctgggcctatcatggttcatacgaaactaaacagacggggagcgcgtcgtctatggttgatggagtagtgaggcttctgacaaagccctgggacgtcataccaatggtgacccagatggctatgactgataccacacctttcggccagcaacgagtttttaaagagaaggtggacacgcggacccaggaacccaaggagggcactaaaaagctaatgaaaatcacagcagaatggctctggaaggagctggggaaaaaggagaccccacgtatgtgcactagagaagagttcacacgcaaagtcaggagtaatgccgctttgggagccatttttaccgatgaaaacaagtggaagtccgcacgggaggccgtggaggacagcggtttctgggaactggtagataaagagagaaatctccaccttgaaggcaagtgtgagacatgcgtgtataacatgatggggaaacgcgaaaagaaactgggagagtttggcaaggctaagggttcaagggcgatctggtacatgtggttaggggcccgattcctggagtttgaagcattgggattcctcaatgaggaccattggttttcccgggaaaactctctgagcggcgttgagggcgaagggctacacaaacttggatacattctgagagacgtcagtaagaaagagggtggcgctatgtatgccgatgacactgcagggtgggataccaggatcacgctcgaggacctgaagaatgaagagatggtgaccaaccacatggaaggagagcataaaaagttggccgaagctattttcaagctgacataccagaataaagtggtccgcgttcaacgtccccctccacggggcactgtgatggatataatctccagaagggaccagcgcggtagcgggcaggtagtgacctatggactcaacacatttactaatatggaggcccagcttattcgacaaatggagggcgaaggcgtcttcaagaacatccagcacctgaccgtgacggaggaaatcgcggttcagaattggttagcacgggtggggagagagaggctgtctcgcatggccatttcaggagatgactgtgtcgtgaaaccgttggatgacagattcgctagtgccctcacagcactgaacgatgtaggtaagatacggaaagacatccagcaatgggagccctccaggggctgggatgactggacccaggttcctttttgcagccatcactctcatgaactaattatgaaggacgggcgtgtgcttgtcgtgccatgccgaaaccaggatgagctgatcggacgcgctagaatttcgcagggcgccggttggtcactccgggaaactgcttgtctgggaaagagctacgcccaaatgtggtccttgatgtatttccacaggcgcgacttaagactggcagcgaatgccatctgcagtgctgtgccctctcactgggtccctacaagccggaccacttggtccatacatgccaaacacgagtggatgaccacagaagatatgctcacggtttggaacagggtgtggatccaggagaatccatggatggaggacaagacccccgtagaatcatgggaggaaattccttaccttggaaaacgagagggccagtggtgtggcagtctgatcgggctaacttctcgtgcaacatgggctaagaacattcagaccgccatcaatcaagtgagaagcctgataggaaacgaagagtatactgattacatgccgtccatgaaacgctttcggagggaggaagaggaagccggtgtcctctggtga

SEQ ID NO: 14910 - RNA, 9876 nt, synthetic construct
  misc_feature 1..9876: note = derived and/or modified CDS sequence (opt3) from DENV-2__KC964094__SS-prME
  source 1..9876: mol_type = other RNA
agcgcaggaatgatcattatgctgatacccaccgtgatggctttccacctcaccactcgaaacggggaacctcatatgatcgtctccattcaagaaaagggaaaatctcttctgtttaagacggaggacggtgttaatatgtgcaccttgatggcaatggatttaggcgaactgtgtgaggacacaatcacttacaaatgcccattactcaggcaaaacgaaccggaggatattgactgttggtgcaattcaaccagtacatgggtgacctatgggacttgtacaaccacgggagagcaccggcgcgaaaagcgaagcgtagccctggtgccccatgtcggcatgggtcttgagactcgtaccgaaacatggatgtcctctgagggggcgtggaaacacgctcagagaatcgagacttgggtgctgaggcatcctggattcaccataatggccgcaatcttggcctacacaattggcaccacgtattttcagcgggttctcatcttcattctgctgactgctgtggcaccatcgatgacaatgcgctcaatcggcataagcaacagagattttgtcgaaggggtgagtggaggttcctgggtagacgttgtgctcgagcacggctcttgcgtcaccactatggccaagaataagcccacattagatttcgaactgaccaaaacggaggctaagcaccctgccacccttaggaaatactgtattgaagcgaagttgacaaacactaccacagcaagccggtgcccaactcagggggagccctccctgaatgaggaacaagacaaacgctttgtgtgtaagcattcaatggtggatcgaggatggggcaacggttgcgggctattcggaaagggcggcatcgtcacctgtgccatgtttacatgcaaaaagaatatggaggggaaagttgtgcagcctgaaaacctcgagtataccattgtaatcactccacacagtggagaagagaatgctgtgggtaacgacacgggcaagcatgggaaagagatcaaggtcacaccgcagagctctgtgaccgaagccgagctgactggatacggcaccgttacaatggaatgctcccccagaaccggtcttgatttcaatgagatggtgctgttgcagatgaaaaacaaggcatggctcgtccacaggcaatggtttctggacttacctctgccatggctccccggggctgatactcagggctcaaattggattcagaaggaaacacttgtgacgttcaaaaaccctcacgccaagaaacaggacgtagttgtgctgggaagccaagagggcgcgatgcataccgccttgactggggcaacagagatacagatgagttctggaaacctactgtttaccggtcacctcaagtgtcggctgcgtacagacaaacttcagctgaagggcatgtcctatagcatgtgcactgggaagttcaaagtcgtgaaggaaatcgctgagacccaacatggaacgattgtcatccgcgtgcagtacgaaggcgatggttcgccatgtaaaatacccttcgagattatggacttggagaagagacacgttctcgggaggctgatcaccgtgaatccgatcgtaacagaaaaagattctcctgtcaacattgaggccgaacccccatttggcgactcctacatcattataggagtggagcctggccagttaaagctgtcatggttcaagaaagaaagtagcatcgggcagatgtttgagactaccatgcggggagctaagcgaatggccattctaggtgatacagcatgggacttcggctccctcgggggagtttttacttctatcggcaaagccctgcatcaagtgttcggtgctatctatggggcggcatttagcggcgtctcatggaccatgaagattcttataggagtggtaatcacgtggattggcatgaatagtcgctccacctcattgtctgtgtcactggttctcgtcggggtggtgaccctgtaccttggagtcatggttcaggccgatagtggctgcgtggtgagctggaaaaacaaggagctgaagtgtggttccgggatcttcgtaactgacaatgtccacacatggaccgaacagtataaatttcagcccgagtctccatcgaagttggctagcgccattcaaaaagcacacgaagagggaatctgcggcataagatccgtgactaggctcgaaaacctgatgtggaagcagatcacccccgagttaaatcatattctgtcagagaacgaagttaaactaacaatcatgacgggtgatattaagggcatcatgcaggccgggaaacggagtctccgccctcagccaaccgagctgaagtactcttggaaggcttggggaaaagccaagatgcttagcactgaattgcacaatcatacattcctgatagacggcccggagaccgcagaaagacccaacacaaatagggcgtggaactccctcgaggtggaggattatgggtttggagtcttcactaccaatatttggctgaaattaaaggaacgtcaagacgtgttttgtgactcaaaactgatgagcgctgccatcaaggataaccgggcagttcacgccgacatgggctactggattgagtctgctcttaatgatacgtggaagatcgaaaaagcctccttcatagaggtgaagagttgccactggcctaaaagccatacattgtggtctaacggtgtactcgagtccgaaatgatcattccaaagaacttcgcagggcccgtctcacagcacaattatcgacctggataccatacccagactgctggcccatggcacctgggtagactagagatggactttgatttctgtgaaggcaccacagtggtggtcactgaggactgcgggaacaggggacccagtctgcgcaccacaacggccagcggcaaactcatcaccgaatggtgttgccggtcgtgcactctgccgcctcttagatacagaggggaagatggatgttggtatggcatggagattcgcccattgaaggaaaaggaggaaaatctggttaactccttagtgacagcgggtcatgggcagatcgacaatttttctctcggagtactgggcatggcccttttcctggaggaaatgttgcgaacccgggtgggtactaaacacgctatactcctggtcgcagtgagctttgttacactaattaccggcaacatgtcattccgtgatctggggagagtgatggtcatggtgggagccacgatgactgacgatatcggcatgggggttacctacctcgctctgcttgccgcatttaaggtgaggcccacattcgcggccggattgctgttacgcaaactcaccagtaaggagctgatgatgactacaatcggcattgtccttctgtcccaatctaccatccctgagacaattctagaactcactgacgctctggccttgggtatgatggtactgaaaatagtgcggaatatggagaagtatcagttagcagttaccatcatggctattctctgcgtgcccaacgccgtcatcctgcagaatgcatggaaggtgagctgtacgacacttgccgtagtgtccgtctcaccactgttgctcaccagcagtcaacagaaagctgattggattcctctggcgctaactatcaaggggctgaaccccaccgccatatttcttacaactctctctagaacctccaaaaagaggagctggccactgaatgaagcaatcatggctgttggaatggtgtcgattttggcctcatctctgctaaagaacgacatcccgatgacgggccctctcgtggccggcgggctgcttacagtctgctacgtgctggctggacgaagtgcagacttggagctcgaacgcgccgcggatgttcggtgggaggagcaggctgaaatttccggtagctctcccatcctgagcataaccatttccgaggacggcgggatgtcaatcaagaatgaagaggaggaacagactctaacaatcctgattagaaccggacttctcgtaataagtggcctgttcccagtgagcatccccattactgccgcagcctggtatttgtgggaggtcaaaaagcaaagggctggtgtgttatgggatgttccttctccaccccctgtggggaaggcagaactggaggacggagcctaccgtatcaaacagaagggcattctcggctattcccagatcggggcgggagtctacaaagaaggtacatttcacaccatgtggcatgtgacgcgcggcgctgtactgatgcacaaggggaaacggatagagccgtcatgggccgatgtcaagaaggaccttatcagttacggaggcggttggaaactggagggggaatggaaggagggagaagagattcaggtgttggcactagaaccaggcaaaaaccccagagccgttcaaactaagcctggcctgttcaaaaccaatacagggaccatcggagctgtgagcctcgatttttccccaggtacatctggctcgcccattgtcgacaagaaggggaaagtggttggactgtatggcaacggtgtggtcactaggagcgggacctacgtgtcagccatcgcacagacggagaagtccatagaggataaccctgaaattgaggacgatacattcaggaaaaagcggcttactatcatggacttacatccgggagctggcaaaaccaagcgctatctgcccgccatcgtaagagaagcgattaagaggggcctccggacattgatcctggccccaacccgagtggttgcagctgagatggaagaggccctcagagggctgcctatacgctaccagactcccgctattagggcagagcacaccggacgtgaaatcgtcgatcttatgtgtcatgccacattcacgatgcggctgttgagtccaattagagtgcctaattataacctaatcataatggacgaggcccactttactgaccccgcttctattgcggcaaggggttacatcagcacccgcgtggaaatgggcgaggccgctgggatcttcatgacagccaccccaccgggatcccgagatccttttccccagtcaaatgcaccaattatggacgaggaaagagagatccccgaacggtcttggaacagcggccacgagtgggtcactgatttcaaaggtaagacagtatggtttgtgcctagtattaaagccgggaatgacatagctgcgtgcctgaggaagaacggacgcaaagttatccaactctcccgtaagaccagcgattctgaatatattaagacgagaactaatgactgggatttcgtggtcacaaccgacatctcagagatgggcgccaactttaaagcagagcgggtgatcgatccaaggcgctgtatgaagcccgttattttaaccgacggcgaagaacgagtgatactggctgggcctatgccggtcactcattccagtgccgcacagagacggggaagggtgggtcgcaatcccaaaaacgaaaatgatcagtacatctacatgggcgagccccttgaaaacgacgaggactgcgcccactggaaggaggctaaaatgctgctcgataatattaacacacctgaagggatcattcccagcatgttcgagccagaaagagagaaggtagacgccatcgatggagaatataggttgcggggcgaggcgcgtaaaacctttgtggacctgatgcgccgaggtgatctccctgtttggctggcatacagagtcgccgctgaggggataaattatgccgacaggcggtggtgtttcgatggcgtgaagaacaaccaaatccttgaagagaatgtggaagtcgagatttggacaaaggagggagaacgcaaaaagctaaaacccagatggctggacgctaggatctactcggatccattggcattaaaggagtttaaagagttcgccgctggccggaagtctctgactctcaacctgattacggagatggggcgacttcctaccttcatgacacagaaggccagaaatgcactggacaacctcgcggttttgcatactgccgaagctggaggtcgcgcctataatcacgcactgtccgagctaccggagaccctggaaacactccttctgttaaccttgctggctactgtgacgggcgggatctttctcttcctgatgagcggaaaaggcataggtaagatgacccttgggatgtgctgtattatcacagcctcaattctgctctggtacgcacagatccagccccactggatagccgctagtatcattttggagtttttcctgatcgtattactaattccagaacctgagaaacaaaggactccccaggataaccagctgacctatgtggtcatcgcgatactcacagtggttgccgcaaccatggctaatgaaatgggctttcttgagaagactaaaaaggacttcggactgggctctattgccacacagcaaccagagtccaacatcttggatatcgacctgcggcctgccagcgcatggacgctctacgctgtggccaccacttttattacacccatgctgcgtcattcaatcgaaaatagtagcgtcaacgtatcccttaccgcgatagctaatcaggccaccgtgctcatggggctgggaaagggttggccgttgtctaaaatggacattggcgttccactgttagcaatcgggtgctacagccaggtgaaccctattacactaactgccgctctgctccttctggtcgcacactatgccatcataggacccggcttgcaggcgaaggctacgagagaggcccagaaaagggcagccgctggtatcatgaagaatccaaccgtggatgggattacagtcatcgacctggatcccattccttacgacccgaaattcgaaaagcagctcggccaggtgatgctgcttgttttatgcgtgactcaggtactgatgatgcgcaccacatgggccctctgtgaggcattgaccctggctactggacccatctccacgctatgggaaggcaacccagggcggttttggaatacaaccattgccgtgtcaatggcgaacatcttccgaggatcttatctggccggcgcaggtctcctttttagtataatgaagaatactgctaacaccagaagggggacaggaaacactggcgagaccctgggtgagaaatggaagaatcgcttgaacgccctgggcaaatcggagttccaaatttacaagaaaagcgggatccaggaggtcgatcggacactcgcaaaggaaggaatcaaaagaggcgagacggaccatcacgctgtttcccgtgggtctgccaagctgaggtggtttgtggagcggaatttagtcacccctgaaggaaaggtggtagatcttggctgcggtcgcgggggatggtcatattactgtggcggtctgaaaaacgtgaaggaggttaaaggcctcactaaagggggacccggccatgaagaacctattccaatgagcacatatgggtggaatctagtgcgactgcagtccggagtcgacgtgttcttcacaccacctgaaaaatgcgatactttgctgtgtgacataggcgagagttctccaaaccccacagtcgaggccggtagaaccctcagggtgcttaatctggttgaaaactggttgaataacaatacgcaattttgcatcaaggtactgaacccgtacatgcctagcgtgattgagaagatggaagcgctccagcggaaatacgggggagctttagtcggcaatccactgtcacgcaactccacccacgagatgtattgggcaagtaatgccagcggcaacatcgtgtcttccgttaacatgatttcaagaatgcttatcaataggttcacaatgcgacacaagaaagctacttacgaacccgatgtggacctggggagcggaacccggcatataggtatcgagtcggagacacctaacctagatattatcggcaagcgtattgagaaaatcaagcaggagcacgaaacttcttggcattgtgaccaggaccacccatataagacctgggcctaccacgggagttatgaggcaaaacaaacaggatccgccagctcaatggtcaatggcgtggtaagactcctgaccaagccctgggatgtgataccgatggttactcagatggctatgacggacacaaccccttttggtcagcagcgcgtcttcaaagaaaaggtggatactaggacccaagagcccaaagaggggacaaagaagttgatgaaaattacggcggaatggctgtggaaggagctcggcaaaaagaaagccccacggatgtgcaccagagaagagtttactcgcaaggtgaggtccaacgcagctcttggcgccatgttcacagacgagaataaatggaagtctgcacgagaagccgtcgaggatagcggcttttgggaactggttgacaaggagcggaacttacatctggaagggaaatgtgagacctgcgtgtacaatatgatgggaaagagagagaaaaagttgggtgagttcggcaaagctaaggggagtagggccatctggtatatgtggctcggagcgcgctttctggagttcgaagcactaggctttcttaacgaggatcactggttctcccgtgaaaatagcctgtctggtgtagagggggagggactccataagctgggctacatcttgcgggacgtgagcaaaaaggaaggcggggccatgtacgctgatgacactgccggatgggatacaagaattaccctggaggacctcaaaaacgaagagatggtcacaaatcacatggaaggtgagcataagaaacttgcagaggctatatttaagctgacttatcagaacaaggtggttagggtgcagcgccctacaccccgaggcacggtcatggacatcattagtcggagagatcagagggggtccggacaagtggtaacctacggcttaaatacattcactaacatggaagcccagctgatccgccagatggagggtgaaggggttttcaaaagcattcaacacttgaccgtgacagaggagatcgctgtcaagaattggctcgtgagagtgggacgggaaaggctgtctcgtatggccatatcgggcgacgattgtgtcgttaaaccactagacgatcgatttgcatcagcgcttactgccctgaacgacatgggcaaggtgcgcaaagatatccagcagtgggagcccagcagagggtggaacgactggacccaggtacctttctgctcccaccattttcacgaactcattatgaaggatggacgggtgctggtcgtgccatgcaggaatcaagacgagttgatcggtcgcgctagaattagtcagggcgccgggtggtctttacgggaaacggcatgtctgggaaagagctatgctcagatgtggtccctcatgtacttccataggcgagatcttcgtctggccgcaaacgccatctgctcagcggttccgagtcactgggtgcccacatctagaaccacttggagcattcacgctacacatgagtggatgaccactgaggacatgctaaccgtctggaatcgcgtgtggatacaggaaaacccttggatggaggataaaacaccagtagaatcctgggaggaaatcccctatctgggcaagcgggaggaccaatggtgtggttcactcattgggttgacgagcagggccacctgggccaaaaatatccagactgccatcaaccaggttagatctctgattggaaatgaggaatacacagactatatgccttccatgaagcgctttcggagggaggaagaggaagctggcgtgctttggtga

SEQ ID NO: 14911 - RNA, 9876 nt, synthetic construct
  misc_feature 1..9876: note = derived and/or modified CDS sequence (opt3) from DENV-2__KC964093__SS-prME
  source 1..9876: mol_type = other RNA
accgcaggcgtgatcattatgatgatacccacagtagttgctttccacctgactacgcggaatggggaacctcatatgatcgtgagcaggcaggaaaagggaaaatccctcctttttaagaccgagaatggtgtaaacatgtgcacactgatggcaatggacttgggcgaattatgtgaggatactattacctacaattgcccactgcttcggcaaaacgaaccggaggacatcgattgttggtgcaattctacatcaacctgggtgacttatgggacatgtaccgccacgggagagcaccgccgagaaaaacgtagtgtcgcgctcgtgccccatgttggcatgggtctggagactagaaccgaaacatggatgagctccgagggggcttggaagcacgcccagaggattgagacttgggtgcttcggcatcctggattcaccatcatggcagccatactggcttacacaatcggcaccacgtattttcagcgcgtcttgattttcatcctcctgactgcagtggccccatctatgacaatgagatgcattggcatctcgaacagggactttgtagaaggggtttcaggaggtagctgggtggatatagtcctggagcacggcagttgtgtgaccactatggctaaaaataagcccacactcgacttcgaattaaccaagacggaggccaaacaccctgcgaccctgcggaagtactgcattgaagcaaaacttacaaacactaccacagcctcccgctgtccaactcagggggagccctctttgaatgaggaacaagataagcgatttgtgtgcaaacatagcatggtcgacagaggatggggcaacggttgtgggctgttcggaaagggcggcatcgttacctgcgctatgtttacatgcaagaaaaatatggaggggaaggtggtacagcctgaaaacctagagtataccattgtgatcactccacactccggagaagagaatgtcgtgggtaacgatacgggcaaacatgggaaggagatcaaagttacaccgcagtcaagtattaccgaagccgagctcactggatacggcaccgtgacaatggaatgtagccccaggaccggtctggacttcaatgagatggtccttctgcagatggaagataaggcatggttggtgcaccggcaatggtttctcgacctgcctttaccatggctgcccggggctgatactcagggctctaactggatacagaaagagacactcgtaacgttcaagaaccctcacgccaagaaacaggacgttgtggtccttggatcccaagagggcgcgatgcataccgccctgactggggcaacagaaatccagatgtcaagcggaaatttgctatttaccggtcacctgaagtgccgtctccgcatggacaaactgcagcttaagggcatgagttattctatgtgtacagggaaattcaaggctgtgaaggagattgccgaaactcaacatggaaccatcgtcataagagtgcagtacgagggcgatggttccccatgcaaaattcccttcgagatcatggacctggaaaagaggcacgttttggggcggctcatcacggtgaacccgattgtaaccgagaaagatagccctgtcaatatcgaagctgagcccccatttggcgactcgtacattataatcggagtggaacctggccagctgaagttatcttggttcaaaaaggggtcctcaattggacagatgtttgagacaactatgcgaggtgccaagcgcatggcaatcctgggcgataccgcctgggacttcgggagtctaggaggcgtttttacaagcatcggtaaagctctccatcaagtgttcggggcgatttatggcgcagccttttccggagtctcttggactatgaagatactgatcggcgtggtaattacctggatcgggatgaacagcagatcaacgagtctttccgtgagcttggttctggtcggagtggtgacactctacctgggcgtcatggttcaggctgattctggttgtgtggtgtcatggaaaaataaggagcttaaatgcgggagtggaattttcatcaccgacaacgtacacacttggacagaacagtataagtttcagcccgagagcccatccaagctggcctctgcaatacaaaaagcccacgaagagggcatctgtggtattaggtcggtcacccggttggaaaatctcatgtggaagcagatcactcccgagctgaaccatattttaagcgagaatgaagtgaaactgaccatcatgacaggcgatataaaggggattatgcaggctggaaaacgctccctaagacctcagccaacggagctcaagtactcatggaaagcctggggcaaggcaaagatgctgagtaccgaacttcacaaccatactttcttgatcgacgggccggagacagcggaatgccccaataccaacagggcttggaactctctggaggttgaggattatggatttggcgtgttcacaactaacatttggctcaaactgaaggaacgtcaagacgtcttttgtgacagcaaattaatgtccgccgcaatcaaggataatcgggccgtgcacgctgacatgggttactggatagagtcagccctgaacgatacctggaaaatcgaaaaggccagcttcattgaggttaagtcttgccactggcctaaatcccatacgctttggagtaacggggtgttggagagcgaaatgatcattccaaagaatttcgctggacccgtatctcagcacaactatcgacctggctaccatacacagaccgccggtccatggcacctcggcaaactggagatggactttgatttctgtgaagggactaccgtcgtggtgacagaggactgcggaaatagaggcccctccctaaggactaccacagcgtcagggaagctgatcacggaatggtgctgtcgcagttgcaccctcccgcctctgcggtacagaggagaggatggctgttggtatggtatggagataaggccacttaaagaaaaggaggaaaacttggtcaatagcctggttactgccgggcatggacagattgacaacttttcgttaggcgtgctcggtatggctctgttccttgaggaaatgctgcgcacacgagtaggcaccaagcacgcaatcttgctcgtggccgtctcctttgtgactctgatcacagggaatatgtctagccgggatctaggacgtgttatggtgatggtcggcgctaccatgacggacgatattgggatgggagtgacttacctggccctcctggcagcgttcaaagttagacccacctttgccgctggccttttgctgaggaagttaacatcaaaagagctcatgatgaccactatcggtattgtgctgcttagtcaatcctctatacctgagacaatcctggaactaaccgacgccctcgcactggggatgatggtcttgaagattgtacgcaacatggagaaatatcagctggctgtgacaatcatggccattttatgcgttcccaatgcagtgatcctccagaacgcctggaaggtcagctgtactaccctggctgtggtatccgtgtcaccacttctgttgacgagcagtcaacagaaggcggattggatacctctcgccctgacaatcaaaggactaaatcccaccgcaattttcctgactaccctttctcggacatccaagaaaagaagctggccactcaacgaagctatcatggccgtcggcatggtttcgattctggcctcatctttgctgaagaatgacatcccgatgactggccctttagtggctgggggactcctgaccgtgtgctacgtccttgcaggtaggagtgccgacctggagttggaacgagcggctgatgtgcgctgggaggagcaggccgaaatatccggcagctctcccattctcagcatcacgatctccgaggacgggggaatgtcaattaaaaacgaagaggaggaacagacactgaccatactaatccggactggcctgcttgttattagtggtctctttccagtaagcatccccattacagcagccgcttggtatctgtgggaggtgaagaaacaaagagcaggggtcttgtgggatgtgccttctccaccccctgttggaaaggccgaattagaggacggcgcgtacaggatcaagcagaaaggcatactggggtattcccagatcggagctggtgtgtacaaggaaggcaccttccacactatgtggcatgtcacacgtggggccgtgctcatgcacaaaggaaagcgcattgagccgtcatgggcagatgtcaagaaggacctgatcagttacggcggtgggtggaaacttgagggagaatggaaagagggcgaagagattcaggtcctggccttggaaccaggcaagaatccccgggctgtgcaaaccaaacctgggctatttaagacgaacactggaaccatcggtgccgttagcctggatttctccccaggcacatctgggtcgcccatagtggacaaaaagggaaaggtcgtgggcctctatggtaacggggttgtgaccagaagcggaacatacgtctcagcaattgctcagactgagaaatccatcgaggataatcctgaaatcgaggacgatatttttaggaagaaacgactgaccatcatggaccttcatccgggcgccggcaagacgaaacggtatttacccgcgatagtgcgcgaagccattaagagagggctgaggacactcatcttggcaccaactcgggtagtggctgccgagatggaagaggctctgcgaggactccctattagataccagacccccgcaatccgcgccgagcacacaggtagggaaatagttgatctgatgtgtcatgccaccttcactatgcgtcttctgagtccaattcgggtccctaactataatttgatcatcatggacgaggctcacttcaccgaccccgcgtctattgcagccagaggctacatcagcacaagggtggaaatgggggaggctgccggaatttttatgacggcaactccaccgggctcccgcgatcctttcccccagtcaaacgccccaataatggacgaggaacgagagatccccgaaagatcttggaatagcggtcacgagtgggtgaccgattttaaggggaaaacagtctggttcgtacctagtattaaggctggaaacgacatcgcggcctgcctacggaaaaatggcaagaaagtgatccaactgtccaggaagacctttgatagcgaatatgttaagactcgcacaaacgactgggatttcgtggtcaccacggacatttctgagatgggcgcaaattttaaagctgagcgtgtgatagatccaagacggtgtatgaagcccgttatcctcactgacggggaagagagggtgattttagccggacctatgccggtcacacattcatccgcagcccagcgccgaggtagagtgggccggaaccccaagaatgaaaacgatcagtacatctacatgggggagcccctggaaaatgacgaggactgcgctcactggaaggaggccaaaatgcttctggataacattaatacccctgaaggaatcatacccagtatgttcgagccagaaagggagcgcgtagacgcgatcgatggcgaatatagactcaggggtgaggcacggaagacctttgtggacttgatgcgtcgcggggatctgcctgtttggctcgcctaccgagtcgctgccgagggcattaactatgctgacagaaggtggtgtttcgatggagtgaaaaacaatcaaatcctggaagagaacgtggaagtcgagatttggactaaggagggcgaacggaagaaacttaagccccgctggctagacgcaagaatctacagcgatccactggccttgaaagagtttaaggagttcgctgccgggaggaaatcgttaacactgaatctcataaccgagatgggacggctgcctacattcatgactcagaaggcacgaaacgcgcttgacgatctggccgttctccatacggctgaagccggtggcagagcatataatcacgctttgtctgagctgccggagaccctagaaacactgctccttctgactttattggccaccgtgacagggggaatttttctgttcctcatgtccggcaagggtatcgggaaaatgaccctgggcatgtgctgcattatcactgcaagcgtacttctgtggtacgcccagatacagccccactggatcgctgcgtcaattatcctcgagtttttcttgattgtgctgttaatcccagaacctgagaagcaacgcacgccccaggacaaccagctaacctatgtcgccatagcaattctgacagtggttgctgccactatggccaatgaaatgggatttctcgagaaaaccaagaaagatttcggccttgggagtatcgcaacacagcaaccagagtctaacatcctggacttggacctgaggcctgcttccgcctggaccctctacgcggtggctactacatttattacgcccatgctgcggcatagcatcgaaaattcaagtgtcaacgtaagccttaccgccatagcaaatcaggccactgtgctcatgggactgggtaagggctggccgttgtccaagatggatattggggttccactgttagctatcggatgttactctcaggtgaaccctattacactaaccgcagccctgctccttctggtcgcgcactatgctatcataggccccggtttgcaggccaaagcaacccgtgaggcccaaaagagagctgccgcagggatcatgaaaaatccaacagtggacggcattactgtcatcgatctggaccccattccttacgatccgaagttcgaaaaacagctcggacaggtgatgctgcttgttttatgcgtgacgcaggtactgatgatgaggaccacatgggctctctgtgaggccttgactctggcgaccggccccatcagcacactatgggaagggaacccaggacgcttttggaataccactattgccgtgtccatggcaaacatcttccggggctcatatctggctggtgtcgggctcctattttctataatgaagaatacggccaacacacgaagaggaaccggcaacactggtgagaccctgggcgagaagtggaaaaataggttgaacgcactggggaagagtgagttccaaatttacaaaaagtcgggaatccaggaggttgaccgcacactcgctaaagaaggcatcaagagaggggaaactgatcatcacgccgtgagcagaggatccgccaaactgcgttggtttgtcgagaggaatttagtgacccctgaaggcaaggtaatggaccttggttgcgggcggggaggctggtcttattactgtggtggcctgaagaacgtgaaagaggttaaggggctcacaaaaggaggccccgggcatgaagaacctattccaatgtcaacgtatggatggaatctagtgcgcctgcagagcggcgtcgatgtgttcttcgcgccccctgaaaagtgcgacaccttgctgtgtgatataggtgagtccagtccaaaccccactgtcgaggctgggcgaacactcagagtgcttaatctggttgaaaactggttgaataacaatacccaattttgcatcaaagtactgaacccgtacatgccttctgtgattgagaagatggaagcactccagaggaagtacggaggcgccttagtccggaatccactgagccgcaactcaactcacgagatgtattgggtgtccaatgctagtggcaacatcgttagctctgtgaacatgatttccagaatgcttatcaataggttcacaatgcgacacaaaaaggccacctacgaacccgacgtcgatctggggtcaggaacgcggaacataggtatcgagagcgagattcctaatctagacatcattggcaaacgtatcgaaaagataaaacaggagcatgaaacctcgtggcactatgaccaggatcatccatacaagacatgggcatatcacgggtcttacgagactaagcaaaccggaagtgcctccagcatggtgaacggcgtagtgagactcctgacaaaaccctgggacgttattccgatggtcactcagatggctatgaccgatacaaccccttttggtcagcagcgcgtgttcaaggaaaaagtggacactaggacgcaagagcccaaggaggggaccaaaaagttgatgaagatcaccgcggaatggctgtggaaagagctcggaaagaaaaagactccacggatgtgtaccagagaagagtttacacgcaaagtcaggtcaaatgccgcacttggcgctatcttcacggatgagaacaagtggaaatccgcccgagaagcagttgaggactctggcttttgggaactggtggataaggagcggaatttacacctggaagggaagtgcgagacctgtgtatataacatgatgggaaaaagagagaagaaattgggtgagttcggcaaggccaaagggagcagggctatttggtacatgtggctcggagcccgctttctggagttcgaagcgctaggctttcttaatgaggaccattggttcagtcgtgaaaactccctgagcggtgtggagggggagggactccacaagctgggctacatattgcgggaagtctctaagaaagagggcggggcaatgtatgccgatgacactgctggatgggatacaagaatcaccctggaagacctcaagaatgaggaaatggtgactaaccatatggagggtgagcacaagaaacttgccgaagcaatttttaaactgacataccagaataaagttgtgagggtccagcgccctacaccacgaggcacagtgatggacatcatttcacggagagatcagagggggagtggacaagtagttacttatggcttaaacaccttcacgaatatggaggctcagctgatccgccagatggaaggtgagggggtgttcaagtccatacaacatttgaccgtcacagaggaaatcgccgtgaaaaactggctcactagagtgggacgggagaggctgagccgtatggctatttctggcgacgattgcgtcgttaagccactagacgatcgatttgcctcggcacttaccgcgctgaacgacatgggcaaagtgcgcaaggatatccagcagtgggaaccctcaagagggtggaatgactggacacaggtacctttctgcagccaccactttcatgagctcattatgaaagatggacgggtgctggtcgtgccatgtaggaaccaagacgaattgatcggtcgcgccagaatttcccagggcgctgggtggagtttacgggagactgcctgcctgggaaagtcttacgcacagatgtggagcctcatgtatttccacaggcgagatcttcgtctggctgccaatgcaatatgttccgccgttccgtcacattgggtgcccaccagtagaacgacatggtctatccacgcgacccacgagtggatgactacagaagacatgctaaccgtctggaaccgcgtgtggattcaggagaatccttggatggaagataagactccagtagagagctgggaagagatcccctacctgggcaaacgggaggaccaatggtgcggttccctcatcgggttgacctcaagggctacatgggccaagaacattcagacggcaataaatcaggttagaagcctgatcggaaacgaagagtataccgactacatgccttctatgaaacgctttcggagggaagagggcgaagccggcgtgctttggtga

SEQ ID NO: 14912 - RNA, 9876 nt, synthetic construct
  misc_feature 1..9876: note = derived and/or modified CDS sequence (opt3) from DENV-2__DQ448231__SS-prME
  source 1..9876: mol_type = other RNA
accgccggcgtgatcattatgctgatacccacagctatggcattccacctcactacgagaaacggggagcctcatatgatcgtcagcaggcaggaaaagggaaaatcccttctgtttaagaccgaggacggtgttaatatgtgcacattgatggccatggatttaggcgaactgtgtgaggacactattacctacaactgcccactactccggcaaaatgaaccggaggatatcgactgttggtgcaactctacatcaacctgggtgacttatgggacatgtaccgcgacgggagagcaccgccgagaaaaacgtagtgtagctctggtgccccatgtcggcatgggtcttgagactagaaccgaaacatggatgagctccgagggggcctggaagcacgcacagaggattgagacttggatcctgcggcatcctggattcaccataatggccgctatcttggcatacacaattggcaccacgtattttcagcgcgtgctcatcttcattctgctgactgccgttgctccatctatgacaatgagatgcatcggcatatcgaatagggattttgtggaaggggtctcaggaggtagctgggtggacattgtactcgagcacggcagttgtgttaccactatggccaaaaacaagcccacattagatttcgaactgatcaagaccgaggcgaaacagcctgcaacgcttcggaagtactgcattgaagccaaattgaccaatacaactaccgcttcccgctgtccaacacaaggggagccctctctgaacgaggaacaggacaagcgatttgtgtgcaaacacagcatggtcgatagaggatggggcaatggttgtgggctattcggaaagggcggcatcgtgacttgcgccatgtttacctgcaagaaaaacatggaggggaagatcgtgcagcctgaaaatctcgagtatacaattgtcgttaccccacattccggagaagagaacactgtgggtaatgacacgggcaaacacgggaaggagataaaagtaacaccgcagtcaagtatcaccgaagcagagctgactggatacggcaccgtgacaatggaatgtagccccaggaccggtcttgatttcaacgagatggtcctgttgcaaatggaaaataaggcttggctcgtgcatcggcagtggtttctggacttacctctgccatggctccccggggccgatactcagggctctaactggattcagaaagagacacttgttacgttcaagaaccctcacgcgaagaaacaagacgtggtcgtgctgggatcccaggagggcgccatgcacaccgcattgactggggctacagaaatccagatgtcaagcggaaatctactgtttaccggtcatctcaagtgccgtctgcgcatggacaaacttcaactgaagggcatgagttattctatgtgtacagggaaattcaaggtagttaaggagatagccgaaactcagcacggaaccattgtggtcagagtgcagtacgagggcgatggttccccatgcaaaatccccttcgagatcatggacttggaaaagaggcatgtcctcgggcggctgattacggtgaacccgatcgttaccgagaaagatagccctgtgaatattgaagctgagcccccatttggcgactcgtacataatcattggagtagaacctggccagttaaagctgtcttggttcaaaaaggggtcctcaatcggacaaatgtttgagacaactatgcgaggtgccaagcgcatggcaatcctaggcgataccgcctgggacttcgggagtctcggaggcgtctttacaagcattggtaaagctctgcaccaggtgttcggggcgatatatggcgcagccttttccggagtttcttggactatgaagatccttattggcgtggtcatcacctggattgggatgaacagcagatcaacgagtttgtccgtgagcctggtactcgtgggagttgtcacactgtaccttggcgtgatggtgcaggctgattctggttgtgtcgtttcatggaaaaataaggagctgaaatgcgggagtggaatcttcataaccgacaacgtgcatacttggacagaacagtataagtttcaacccgagagcccatccaagttggcctctgcaatccagaaagcccacgaagagggcatttgtggtatcaggtcggtgacccggctcgaaaatctgatgtggaagcagattactcccgagttaaaccacatcctgagcgagaatgaagtaaaactaaccataatgacaggcgatattaaggggatcatgcaggctggaaaacgctccctcagacctcaaccaacggagctgaagtactcatggaaaacctggggcaaggccaagattcttagtactgaaccgcataaccagacattcttgatcgacgggcccgagaccgcagaatgccctaatacaaacagggcgtggaattctctggaggtcgaggattatggatttggcgtgttcactaccaacatatggctcaaactgaaggaacgtcaggacgttttttgtgacagcaaattaatgtccgctgccatcaaggataatcgggcagtgcacgccgacatgggttactggattgagtcagctctgaacgatacgtggaaaatcgaaaaggccagcttcattgaggtcaagtcttgccattggccaaaatcccacacactttggagtaacggggtgttggagagcgaaatgatcatacccaagaatttcgcaggacctgtttctcagcacaactatcgaccaggctaccatacccaaactgctggtccctggcacctcggcaaactggagatggactttgatttctgtgaagggaccacagtggtagtcactgaggactgcggaaatagaggcccgtccctaaggaccacaacggcctcagggaagctgattaccgaatggtgctgtcgcagttgcactctccctccactgcggtacagaggagaggatggctgttggtatggtatggagatcaggccccttaaagaaaaggaggaaaacttggtgaatagcctggtgacagcggggcatggacagatcgacaacttttcgttaggcgtcctcggtatggccctgttccttgaggaaatgctgcgcacccgagttggcactaagcacgctgtgttgctcgtagcagtgtcctttatgacactgattaccgggaatatgtctttccgggatctaggacgtgtcatggtgatggttggcgccgctatgacggacgatatcgggatgggagtgacttacctggccctcctggcagcgtttaaagtcagacctaccttcgccgctggccttttgctgaggaagttaacaagcaaagagctcatgatgaccactattggtatagtgctgctttcacagagtacaatccccgagaccattctggaactaacagacgccctcgcactggggatgatgatcttgaagattgttcgcaacatggagaaatatcaactggctgtgactatcatggccatattatgcgtcccaaatgcagtaatcctccagaacgcctggaaggtgtcctgtaccattctggctgttgtgtctgtcagccctcttctgttgacgtcctcacagcagaaggcggattggatccccctcgccctgacaattaaaggactaaatccaaccgcaatctttctgactacccttagccggacaaacaagaaaagaagttggccgctcaatgaagctataatggccgtgggcatggtatctattctggcctccagcttgctgaagaacgacatccctatgactggccccttagtggctgggggactcctgaccgtctgctacgttcttacgggtaggtcggcagacctggagttggaacgagccgcggatgtgcgctgggaggaccaagctgagatctcaggctctagtccaattctctccataacaatcagcgaagatgggtctatgagcattaaaaatgaggaagaggagcagaccctgactatcctaattcggacaggactgcttgtgatctccggcctcttccccgtctcaatacctatcaccgccgcagcctggtatctgtgggaagtgaagaaacagagagctggtgttttgtgggacgtaccaagtccccctccggtggggaaggcagagttagaagatggagcctacaggattaagcagaaaggcatcctgggctatagccaaattggggcgggagtctacaaggagggtacttttcatacaatgtggcacgtgacccgtggcgctgttctcatgcacaaagggaagcgcatcgaaccatcttgggccgacgtgcggaaagatctgatatcctacggaggcggttggaagcttgagggggagtggaaggaaggagaggaagtccaggtgctggcattggagcccggcaaaaaccctagagccgtacagacgaagccaggcctattcaaaactaacaccgggacaattggagctgtctcactggactttagtcccggtaccagcggctcccctatcgtggataagaaagggaaggttgtgggactctatggcaatggtgtcgtgacaaggtctgggacttacgtttcggccatcgcacagaccgaaaagagcattgaggacaacccggagatcgaagatgacatattccgaaaaaagcggctgacgattatggatcttcatcccggagctggcaaaacaaagcgctatttaccagccatcgtgagagaggcgattaaaaggggcctgcggactctcatcttggcccctacccgagtcgtggcagctgaaatggaggaagccctgagagggctccccatacgctaccaaacaccagctattagggcagagcacaccggacgtgagatcgtagacctgatgtgtcatgccactttcaccatgcggcttctgtcacctgtgagagttcccaattataacttgatcattatggacgaagcccactttacagatccagcttccatcgcggcaaggggttacattagtacgcgcgtcgagatgggcgaagccgctgggatattcatgactgccaccccgcctggatctcgagacccctttccacagagcaatgcacccatcatggatgaggagagagaaattcctgagcggtcctggaactcaggccatgaatgggtgacagacttcaagggtaagaccgtgtggtttgtcccatctatcaaagccgggaatgatatcgctgcgtgcctaaggaagaacggaaaaaaggtaattcagctgagccgcaaaactttcgacagtgagtatataaagacacgtaccaatgattgggactttgtggttacgactgatatctccgaaatgggcgccaacttcaaggcagagagagtgattgacccccggaggtgtatgaaacctgtcatcctcacagatggcgaggaacgcgtgattttagctgggccgatgccagttacccacagctctgccgcacaacgaagaggacggatcggtaggaatcccaagaacgagaatgaccagtacatatacatgggcgaacctctggagaacgacgaagattgcgcccactggaaagaggctaagatgcttctggacaatatcaacacccccgaggggattatcccatcaatgtttgaacctgagcgcgaaaaagtggatgccattgacggagagtatagactcaggggcgaagcgcggaagactttcgtcgatttgatgcgtcgcggtgacctgcccgtgtggctcgcataccgagtagccgctgaggggatcaactatgccgatagaaggtggtgttttgacggcataaaaaataaccagattctggaggaaaatgtggaggttgaaatctggacaaaggagggagagcggaagaaacttaagccacgctggctagatgctagaatttactccgaccctctggcattgaaagaattcaaggagttcgccgctggcaggaaaagtttaaccctgaacctcatcacagaaatggggcggctgccgacttttatgacgcagaaggcccgaaatgcacttgataacctggcggtcctccataccgccgaggctggaggtagagcctataatcacgcattgagcgaactgcccgagacactagagactctgctccttctgaccttattggctacagtgaccggcgggatattcctgtttctcatgtcgggaaagggcatcggtaaaatgactctggggatgtgctgcattatcacggcctctattcttctgtggtacgcacaaatccagccacattggatagccgcttccattatcctcgaattctttttgatcgtgctgttaattcctgagcccgaaaagcagcgcaccccacaggacaaccaactaacatatgtcgttatcgcgatactgactgtggtagccgcaaccatggctaatgagatgggcttcctcgaaaaaacaaagaaagattttggacttggcagcattgccacccagcagcctgagtcaaacatcctggacattgacttgaggcccgccagtgcatggactctgtacgctgtggccacaacgttcatcaccccgatgctccggcactctatagagaattccagcgtcaacgtgtcactgactgcgatcgctaatcaggccacagttcttatggggctcggaaagggttggccactgagtaagatggatattggcgtgcctttgctggcaatcgggtgttacagccaagtcaaccccattaccttaaccgccgctctactgctccttgtagcacactatgccatcattggaccaggcctgcaggcgaaagctacacgtgaagcccagaagagagcagccgctggtatcatgaaaaatcccactgtggacgggataacggttattgatttggaccctatcccgtacgatcccaagtttgagaaacagctgggccaagtgatgctcctggtcctttgcgtgacccaggtcttaatgatgaggacaacttgggccctgtgtgaagcactcaccttggctacaggaccaatctccaccctgtgggagggcaaccctgggcgcttctggaatactacgattgccgtgtctatggcgaacatatttcggggaagctatctagccggcgcaggtctgctcttctccatcatgaagaacacaaccaatactcgaagagggaccggaaacacaggcgaaactcttggtgagaagtggaaaaataggctgaactcattgggcaagtctgagtttcagatttacaaacgcagtgggatccaagaagttgaccggaccctggctaaggagggaattaaaagaggcgaaacagatcatcacgccgtgtcgcgtgggagcgcaaagctcaggtggttcgtagagcggaatctggtgacgcccgagggaaaagtcgttgacttaggctgcggtcgcgggggatggtcctattactgtggcggtcttaagaacgtgcgagaagtcaagggcctgaccaaagggggacctggccatgaggaaccaatccccatgtctacttatgggtggaatctcgtgagactacagtcaggagtagatgtgttctttacacctccagagaagtgcgacaccctgttgtgtgatataggcgaaagctcccccaacccgactgttgaggctggtaggacactgcgggtgctcaatcttgtcgagaactggctgaataacaatacccagttctgcatcaaagtgttgaacccttacatgccaagtgtcattgaaaagatggagacgctgcagcgcaaatacgggggagccctcgtgagaaatcccttatctaggaacagcacccacgaaatgtattgggtttcaaacgcctccggcaatatcgtaagtagcgtgaacatgatttctcgaatgctgatcaatcggtttacaatgcgtcataagaaggcgacttacgagcctgacgtcgatcttggctccgggaccagaaacataggaattgaatcagagacaccaaatctggacatcatcggtaaacgcattgagaagataaaacaagaacacgagactagctggcactatgaccaggatcatccctacaagacctgggcttatcacggctcgtacgaaacaaaacagaccgggtctgcaagttccatggtgaacggagttgtgaggctactcactaagccgtgggacgtcatccctatggtgacgcagatggccatgacagataccactcccttcggccaacagcgggtatttaaggagaaagtggacaccagaacacaggaaccaaaggagggtacgaaaaagctgatgaaaattaccgctgagtggttgtggaaggaactggggaagaaaaagactcctcgcatgtgtacaagggaggaattcacccgaaaagttcggagcaatgccgcactcggagccatctttactgatgagaacaagtggaaatcagctagagaggcggtcgaagactccaggttctgggagcttgtggataaggaacgcaatctgcatttagagggcaaatgcgaaacatgtgtgtataacatgatgggcaagcgtgagaagaaaattggggagtttggaaaggccaaaggttctcgggcaatctggtacatgtggctgggcgctagattcttggaatttgaggccctcgggttcctgaatgaagaccactggtttagcagggagaacagtctatccggagtcgaaggcgagggtcttcacaagctggggtacatactccgcgaggttagcaaaaaggaaggaggcgcaatgtatgccgatgacaccgctggctgggatacacgaatcactctggaggacttgaagaatgaagagatggtgaccaaccatatggaaggggagcacaaaaagctggccgaggcgattttcaaactcacgtaccagaataaggtagtgcgggtccaaagacccaccccaaggggaacagtgatggacatcatttctcgcagagatcagcggggttcaggccaggttgggacttatggacttaacaccttcacaaacatgggcgcacaactgatcaggcagatggaaggtgagggggtgtttaaaggaattcagcatttaactgccaccgaagaggtcgctgtgcaggactggctggcccgtgtaggccgagagcgcttgagtagaatggcaatatccggcgatgactgcgttgtgaagcccctcgatgaccggttcgctagcgccctgacggctctaaatgatatggggaagatcaggaaagacattcaacagtgggaaccttctcgcggatggaacgattggacacaggtcccattttgctcgcaccatttccacgagcttatcatgaaggacggtagagtgctggtggtcccgtgtcggaatcaggatgaactcatcggcagggcccgaatttcacaaggggcaggatggagcctgcgtgagaccgcgtgcttgggcaaatcctacgcccagatgtggagtttaatgtattttcacagacgcgacctgcggctcgctgccaacgcaatatgttctgctgttcccagccattgggtgcctacttccaggacaacctggtcaatccacgccagacatgaatggatgactaccgaggatatgcttacagtatggaatcgcgtgtggattcaggagaacccatggatggaagacaagacgcccgtcgagagttgggaagagatcccttacctgggtaaacgggaagaccagtggtgcgggtctctaattggactgaccagcagggcaacttgggccaagaatatccaaacagcgataaaccaggtgcgatccctcatcggctcagaggagtataccgattacatgccaagcatgaagagattccggagggaagaggaagaggctggcgttttgtggtga

SEQ ID NO: 14913 - RNA, 9876 nt, synthetic construct
  misc_feature 1..9876: note = derived and/or modified CDS sequence (opt3) from DENV-2__JX470186__SS-prME
  source 1..9876: mol_type = other RNA
accgccggaatcattataatgatgatccccaccgtgatggctttccacctgactacgcgaaacggggagcctcatatgattgtcagcaggcaggaaaagggaaaatccctcctttttaagaccgagaatggtgttaacatgtgcaccctgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtggccccatctatgacaatgcggtgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaacaccctgcgacgctgcggaagtactgcattgaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaagatcgtccagcctgaaaacctagagtatacaattgttataaccccacactccggagaagagaatgccgtgggtaacgatactggcaaacatgggaaggagatcaaagtaacgccgcagtcaagtattacagaagcagagctcaccggatacggcactgtgaccatggaatgtagccccaggacaggtctggacttcaatgagatggtccttctgcagatggaaaacaaggcttggttggcccaccggcaatggtttctcgatctgcctttaccatggctgcccggggcggacacccagggctctaactggatccagaaagagactctcgtgacattcaagaatcctcacgccaagaaacaggatgttgtggtccttggatcccaagagggcgcaatgcatacggctctgaccggggccactgaaatacagatgtcaagcggaaacttgctatttacaggtcacctgaagtgccgtctccgcatggacaaactgcagcttaagggcatgagttattctatgtgtaccgggaaattcaaggtggtaaaggagattgctgaaacacaacatggaactatcgttatcagagtgcagtacgagggcgacggttccccatgcaaaattcccttcgagatcatggatctggaaaagaggcacgtcttggggcggctcattaccgtgaatccgatagtcacggagaaagacagccctgtgaacatcgaagccgagcccccatttggcgattcgtacattatcatcggagttgaacctggccagctgaagttatcttggttcaaaaaggggtcctcaattggacagatgtttgagaccacaatgcgaggtgcaaagcgcatggccatactgggcgacactgcttgggatttcgggagtctaggaggcgtgtttaccagcatcggtaaagcgctccatcaagtattcggggcaatttatggcgccgctttttccggagtctcttggacaatgaagatcctgattggcgtggttatcacttggatagggatgaatagcagatcaaccagtctttccgtgagcttggtcctggtgggagtagtgacgctctacctgggcgttatggtccaggccgactctggttgtgtggtgtcatggaaaaacaaggagcttaaatgcgggagtggaatcttcattacagataatgtccacacctggactgaacagtataagtttcagcccgagagcccatccaagctggcatctgccatccaaaaagctcacgaagagggcatttgtggtatcaggtcggttacacggttggaaaacctcatgtggaagcagataacccccgagctgaatcatattttaagcgagaacgaagtgaaactgactatcatgaccggcgacattaaggggatcatgcaggccggaaaacgctccctaagacctcagccaacagagctcaagtactcatggaaagcatggggcaaggcgaagatgctgagtacggaacttcacaatcataccttcttgatagatgggccggagactgctgaatgccccaacacaaatagggcctggaactctctggaggtggaggactatggatttggcgtattcaccacaaatatctggctcaaaatgaaggaacgtcaagatgtcttttgtgacagcaaactgatgtccgcagccattaaggactcacgggctgtgcacgccgatatgggttactggatcgagagcgcattaaacgacacttggaaaattgaaaaggcttctttcatcgaggttaagtcctgccactggcctaaaagtcataccctgtggagcaacggggtgcttgagtctgaaatgataattccaaagaatttcgccggacccgtctcccagcacaactatcgacctggctaccatacgcagacagcgggtccatggcacttgggcagactcgagatggattttgacttctgtgaagggaccactgtggttgtgaccgaggattgcggaaataggggcccctcactgcgcacaactaccgccagtgggaaactaatcacagaatggtgctgtcggagctgcacgctgccgcctctcagatacaggggagaggacggctgttggtatggtatggagatccgcccactgaaggaaaaagaggaaaaccttgtaaattcgttggtcaccgctgggcatggacagattgataacttttccctgggcgtgttaggtatggcactcttcctggaggaaatgcttcgaactcgggtgggcacaaagcacgccatcctgttggtcgctgtttcttttgtgaccctcattactgggaatatgagcttccgtgacctgggaagagtaatggtgatggtcggcgccacaatgaccgatgacatagggatgggagtgacgtacctagcactgctcgcggcctttaaggttaggcccactttcgctgccggcctgcttttgcgcaaactgacctcaaaggagttaatgatgacaaccatcggtattgtgctcctgagtcaagcaactatccctgagacaattcttgaactgaccgatgctctagccctcgggatgatggtcctgaaaatcgtgcggaacatggagaagtatcagttggcagttacaataatggccatcctgtgcgtgcccaatgctgtcattttacagaacgcgtggaaagtatcctgtactaccctcgccgtggtttctgtgagcccactgcttctgacgtcctcacaacagaaggcagactggatccctttggctctcacaattaagggactgaatcccaccgccatctttctaactaccctgagcagaacaaacaaaaagaggagttggccacttaatgaagccataatggctgtcggcatggtgtctattctcgcatccagcctgttgaaaaacgatatcccgatgactggccctctggtagccgggggattactcaccgtgtgctacgtcctgacgggtcgatcggcggaccttgagctggaacgcgctgccgacgttcggtgggaggagcaggcagaaatctcaggctctagtcccattttgtccataacaatcagcgaggatgggtctatgagcattaagaatgaagaggaggaacagaccctcactatcctgattagaacaggactactggtggtgtccggccttttcccagtctcaacccccatcactgccgctgcatggtatctctgggaggtgaaaaagcaaagggccggtgttctgtgggacgtacctagtccaccccctgtggggaaagcggaattggaggatggagcttaccgtataaagcagaagggcatcttaggctatagccagattggggccggagtctacaaagaaggtacatttcacaccatgtggcatgtgacgcgcggcgcagttctgatgcacaaggggaaacggatcgagccgtcttgggccgacgtgaagaaagatctcatttcctacggaggcggttggaagctggagggggaatggaaggagggagaagaggtccaggtgcttgctctggaaccaggcaaaaaccccagagccgtacaaactaagcctggcttgttcaaaaccaacacagggaccatcggagcagtctcactagactttagtccaggtacaagcggctcccccatagtggataagaaagggaaggttgtgggactgtatggcaatggtgtcgtgactaggtctgggacctacgtttcggctattgcccagacggaaaagagcatcgaggacaaccctgaaatcgaggatgacattttccggaaaaagagactcacaatcatggatctgcatccgggagcgggcaaaactaagcgctatcttcccgccatagtgagagaagcaattaaaaggggcttacggaccctgatcctcgctccaacacgagtcgtggccgctgagatggaagaggcattgagagggctgcctattcgctaccagacccccgccatcagggccgagcacactggacgtgaaatagtagacctcatgtgtcatgctaccttcacaatgcggctgctttcaccaattagagtgcctaattataacctgatcatcatggatgaggcgcactttacggaccccgcatccattgccgctaggggttacatcagtactcgcgttgaaatgggcgaggccgcagggattttcatgaccgccacaccaccgggatctcgagacccttttccccagagcaatgctccaataatggatgaggaaagagagatccccgaacggtcctggaactcaggccacgagtgggtcaccgacttcaagggtaagactgtgtggtttgtgccttctattaaagcggggaatgatatcgccgcatgcttgaggaagaacggcaaaaaggtcatccaactaagccgcaaaacattcgacagtgaatatattaagacccgtacgaatgattgggactttgtagtgactacagatatatccgagatgggcgctaacttcaaggccgagagagttatcgacccacggaggtgtatgaaacccgtgattctgaccgatggcgaagaacgcgtcatcctcgcagggcctatgccggtgacccatagctctgccgctcagcgaagaggacgggttggtaggaatccaaagaacgaaaatgaccagtacatttacatgggcgagcccttagaaaacgatgaggactgcgcccactggaaagaggcgaagatgctgcttgacaatatcaacactcctgaagggataatcccctcaatgtttgagccagaacgcgagaaagtggatgcaattgacggagaatatagactgaggggcgaggcccggaagacattcgtcgatctcatgcgtcgcggtgacttgcctgtgtggctggcttaccgagtagccgctgaggggatcaactatgcagatagaaggtggtgttttgacggcgtgaaaaataaccaaattctcgaagagaatgttgaagtcgagatctggaccaaggagggagaacggaagaaactgaagccccgctggcttgatgccagaatatactccgacccactagctctgaaagagttcaaggagttcgccgcaggcaggaaaagtttgacattaaacctgattactgagatggggcggctccctacgtttatgacccagaaggcgcgaaatgccctggataaccttgctgtgctgcatacagccgaagcaggaggtagagcttataatcacgccctcagcgagttgccggagactctggaaaccctactgctccttacactgttagcaaccgtgactggcgggatcttcttgtttctgatgtcgggaaagggcattggtaaaatgacgctcgggatgtgctgcatcataaccgcctctatcctgctttggtacgctcagattcagccccactggatcgcggcctccattatcctggagttctttctcatagtcttgctgattccagaacctgagaagcaacgcacaccccaggacaaccagttaacttatgttgtgatcgcaatcctaaccgtagtggctgccacaatggccaatgaaatgggcttcctggagaaaaccaagaaagattttggactcggcagcattactacacagcaaccagagaacaatatccttgacatagatctgaggcctgcatcagcttggacgttgtacgccgtcgcgaccactttcattacacccatgctgcggcatagtatcgaaaactcttccgtgaatgttagcctcaccgctattgccaaccaggcaaccgtgctgatggggcttggaaagggttggccgctctcaaagatggacatcggcgtcccactgttggccatagggtgttacagtcaggtaaatcctatcacactgactgctgcattactactgctcgtggcccactatgcgattatcggacccggccttcaggctaaagccacgcgtgaggcacaaaagagagccgctgccggtattatgaaaaacccaaccgttgacgggatcacagtgattgatctggaccccatcccttacgatccgaagtttgaaaaacagttgggccaggtcatgctgctcgtgctgtgcgtcactcaggtgcttatgatgaggaccacatgggcattatgtgaggctctgaccctcgccactggacccataagcacgttgtgggaaggcaatccagggcgcttctggaacacaaccattgcggtttccatggccaacatctttcggggatcttatctggcaggcgctggtctactgttcagcatcatgaagaatactgccaacacccgaagagggacaggaaatactggcgagaccctcggtgagaagtggaaaaacaggcttaatgcactgggcaagtccgaatttcaaatttacaaaaagtcagggatacaggaggtggaccgcacattggctaaagaaggaatcaagcggggcgagacggatcatcacgccgtatctagagggagtgccaaactgcgttggttcgtggagaggaacctcgtcacccctgaaggaaaggttgtggacctgggctgcggtagaggcgggtggtcgtattactgtgggggtttaaagaatgtcaaagaggtgaagggccttactaaagggggacccggccatgaggaacctattccaatgagcacatatgggtggaacctggtacgcctccagtccggagtggatgttttctttacaccccctgaaaagtgcgacactctactgtgtgatatcggcgagtcttcaccaaatcccacagtggaggcgggtcgaaccttgagagtcctgaacctcgtggaaaattggcttaacaataacacgcaattctgcattaaagtcctgaatccgtacatgcctagcgtgatcgagaagatggaggctttgcagaggaagtacgggggagcactggttcggaacccactctcccgcaacagtacccacgagatgtattgggtatctaatgccagcggcaacatagtgtcatccgtcaatatgatcagtagaatgttaattaacaggtttacaatgcgacacaaaaaggctacttacgaacccgacgtggatctgggcagcgggacccggaatatcggaattgagtctgagacacctaaccttgacatcataggtaaacgtattgaaaagatcaaacaggagcatgaaacttcctggcactatgatcaggaccatccatacaagacctgggcctatcacggctcatacgagacaaagcaaaccgggagcgcatcgtctatggttaatggagtggtcagactgctaactaaaccctgggacgtgatcccgatggtaacgcagatggccatgacagataccactcctttcggccagcagcgcgtgtttaaggaaaaagttgacaccaggacacaagagcccaaggagggtacgaaaaagctcatgaagattaccgctgaatggctgtggaaagagttggggaagaaaaagactccacggatgtgtacaagagaagagttcacccgcaaagtcaggagtaacgcggccctgggagcaatatttactgatgagaataagtggaaatccgctcgagaagccgtggaggacagcggcttctgggaactcgtggataaggagcggaaccttcacctggaaggcaagtgcgagacatgtgtctataatatgatggggaaaagagagaagaaattaggagaatttggtaaggcaaaaggctcaagggccatctggtacatgtggctgggggctcgcttcttggagtttgaagccctcggattcctgaacgaggaccattggttttcccgtgaaaattctctaagcggcgttgagggtgaggggcttcacaagctgggatacattctccgggatgtgagtaagaaagaaggcggcgcgatgtatgcagacgataccgccgggtgggacacaagaatcactctggaggatttgaagaacgaagagatggtaaccaatcatatggaaggagagcacaaaaagctggctgaggccattttcaaactcacgtaccagaacaaggtggtcagggtgcagcgccctacaccccgaggtacagttatggacatcatatcccggagagaccagaggggcagcgggcaagtggtcacttatggacttaacaccttcacaaatatggaagcacagctgatccgccagatggagggcgaaggtgtgtttaagtctattcaacagttaactgtaaccgaggagatcgctgttaaaaactggctggtgagagtcgggcgggaaaggttgtcacgtatggccattagtggagatgactgcgtggtgaagccactcgatgaccgattcgcttccgccctgacggcactaaatgatatgggcaaagtccgcaaggacatccagcagtgggagcccagcagaggctggaacgattggacacaagttcctttttgctctcatcacttccacgaacttattatgaaagacgggcgggtgctggtagtgccatgtaggaatcaggatgagctcataggacgcgcgagaatctcgcagggtgccggctggtcactgcgggaaaccgcttgcttgggaaagagctacgcccagatgtggtccttaatgtattttcataggcgagacctgcgtctcgcagctaacgccatttgtagtgcagtcccgtctcactgggtgcccactagcagaacaacctggtccatccatgccactcacgagtggatgaccacagaggatatgcttacggtttggaatcgcgtgtggatccaagaaaacccttggatggaggacaagaccccagtcgaatcatgggaggaaattccctacctgggaaaacgggaggatcagtggtgcggcagtctaataggtctgacttctagggcgacatgggctaagaatatccagaccgccattaaccaggtgagaagcctcatcgggaatgaggaatatactgactacatgccttccatgaaacgcttccggagggaggaagaggaagcaggagtattgtggtga

SEQ ID NO: 14914 - RNA, 9876 nt, synthetic construct
  misc_feature 1..9876: note = derived and/or modified CDS sequence (opt3) from DENV-2__KU517846__SS-prME
  source 1..9876: mol_type = other RNA
accgccggaatcattataatgatgatccccaccgtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactcggaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtggccccatctatgacaatgagatgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaacaccctgcgacgctgcggaagtactgcattgaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaagatcgtccagcctgaaaacctagagtatacaattgttataaccccacactccggagaagagaatgccgtgggtaacgatactggcaaacatgggaaggagatcaaagtaacgccgcagtcaagtattacagaagcagagctcaccggatacggcactgtgaccatggaatgtagccccaggacaggtctggacttcaatgagatggtccttctgcagatggaaaacaaggcttggttggtgcaccggcaatggtttctcgatctgcctttaccatggctgcccggggccgacacccagggctctaactggatccagaaagagactctcgttacattcaagaatcctcacgcgaagaaacaggatgtggtcgtgcttggatcccaagagggcgccatgcatacggcactgaccggggctactgaaatacagatgtcaagcggaaacttgctatttacaggtcacctgaagtgccgtctccgcatggacaaactgcagcttaagggcatgagttattctatgtgtaccgggaaattcaaggtagttaaggagattgccgaaacacaacatggaactatcgtgatcagagtccagtacgagggcgacggttccccatgcaaaattcccttcgagatcatggatctggaaaagaggcacgtgttggggcggctcattaccgtcaatccgatagtgacggagaaagacagccctgttaacatcgaagctgagcccccatttggcgattcgtacattatcatcggagtggaacctggccagctgaagttatcttggttcaaaaaggggtcctcaattggacagatgtttgagaccacaatgcgaggtgccaagcgcatggcaatactgggcgacactgcctgggatttcgggagtctaggaggcgtatttaccagcatcggtaaagctctccatcaagtcttcggggcgatttatggcgcagccttttccggagtgtcttggacaatgaagatcctgattggcgttgtgatcacttggatagggatgaatagcagatcaaccagtctttccgtcagcttggtgctggtaggaatcgtgacgctctacctgggcgttatggtccaggctgactctggttgtgtggtgtcatggaaaaacaaggagcttaaatgcgggagtggaattttcatcacagataatgtccacacctggactgaacagtataagtttcagcccgagagcccatccaagctggcctctgcaattcaaaaagcccacgaagagggcatctgtggtataaggtcggttacacggttggaaaacctcatgtggaagcagattacccccgagctgaatcatatcttaagcgagaacgaagtgaaactgactattatgaccggcgacatcaaggggataatgcaggctggaaaacgctccctaagacctcagccaacagagctcaagtactcatggaaagcctggggcaaggcaaagatgctgagtacggaacttcacaatcataccttcttgatcgatgggccggagactgcggaatgccccaacacaaatagggcttggaactctctggaggtggaggactatggatttggcgtattcaccacaaatatttggctcaaactgaaggaacgtcaagatgtcttttgtgacagcaaattaatgtccgccgcaatcaaggacaaccgggccgtgcacgctgatatgggttactggattgagtcagccctgaacgacacttggaaaatcgaaaaggccagcttcatagaggttaagtcttgccactggcctaaatcccataccctttggagtaatggggtgttggagagcgaaatgattatcccaaagaacttcgctggacccgtctctcagcacaattatcgacctggctaccatacgcagacagccggtccatggcacctcggcagactggagatggattttgacttctgtgaagggaccactgtggttgtgaccgaggattgcggaaacaggggcccctccctacgcacaactaccgcgtcagggaaactgatcacagaatggtgctgtcggagttgcacgctcccgcctctgagatacaggggagaggacggctgttggtatggtatggagattcgcccacttaaggaaaaagaggaaaatttggtaaacagcctggtcaccgccgggcatggacagatcgataatttttcgttaggcgtgctcggtatggctctgttccttgaggaaatgctgcgaactcgggtgggcacaaagcacgcaattttgctcgtcgccgtttcctttatgaccctgataactgggaacatgtctttccgtgacctaggaagagtgatggtaatggtgggcgctacaatgaccgatgacatcgggatgggagtcacgtacctggccctcctggcagcgtttaaggtgaggcccactttcgccgctggccttttgctgcgcaaattaaccagcaaggagctcatgatgacaaccattggtatcgttctgctttcacaaagtactattcctgagacaatcctggaactaaccgatgccctcgcactggggatgatggtgttgaaaatagtccggaatatggagaagtatcagctggctgtgacaatcatggccattttatgcgttcccaacgcagtgatcctccagaatgcctggaaagtctcctgtactattctggctgtagtgtctgttagcccacttctgttgacctcctcacaacagaaggcggactggatccctctcgccctgacgataaagggactaaaccccacagcaatttttctgaccactcttagcagaaccagtaaaaagaggtcttggccactcaatgaagctatcatggccgtgggcatggtctccatcctggccagctcgttgctgaaaaacgatattccgatgacaggccctttagtggctgggggactcctgactgtatgctacgtgcttaccggtcgatcagcagacctggagttggaacgcgccgcggacgtccggtgggaggagcaggctgaaatatctggcagttcccccatcctcagcattacgatctctgaggatgggagcatgtccattaagaatgaagaggaggaactgacactaaccatcctgataagaactggacttctcgttatctcaggcctgttcccagtgagtattcccatcacagccgcagcctggtatttgtgggaggtgaaaaagcagagggctggtgtcttatgggacgtgcctagcccaccccctgttgggaaagcagaactggaggatggagcctaccgtattaagcaaaagggcatcctcggctattctcagataggggcgggagtatacaaagaaggtacctttcacactatgtggcatgtgacacgcggcgctgtcctgatgcacaaggggaaacggattgagccgtcctgggccgacgtgaagaaagatcttatctcatacggaggcggttggaagctggagggggaatggaaggagggagaagaggttcaggtgttggcactagaaccaggcaaaaaccccagagccgtccagaccaagcctggcctgttcaaaacgaacactgggaccatcggagctgtgagtctcgactttagcccaggtacatccggctctcccattgtagataagaaagggaaggtcgtgggactgtatggcaatggtgttgtgaccaggtcggggacatacgtcagcgccatcgcacaaactgagaagtcaatagaggacaaccctgaaattgaggatgacatcttcagaaagaagcggcttaccattatggatttacatccgggagctggcaaaacgaagcgctatctgcccgccatcgtgagagaagcgataaaaaggggcctccggacattgattctggccccaactcgagttgtggcagctgagatggaagaggccctcagagggctgcctatccgctaccagacccccgctatcagggcagagcacacaggacgtgaaattgtcgaccttatgtgtcatgccaccttcactatgcggctgttgtccccaatcagagtgcctaattataacctaattataatggatgaggcccactttaccgaccccgctagtatcgcggcaaggggttacatttctacacgcgtagaaatgggcgaggccgctgggatcttcatgacggccactccaccgggaagccgagacccttttccccagtccaatgcaccaatcatggatgaggaaagagagattcccgaacggtcatggaactctggccacgagtgggtgaccgacttcaagggtaagacagtttggtttgtccctagcataaaagccgggaatgatatcgctgcgtgcctgaggaagaacggcaaaaaggtgattcagctcagtcgcaaaaccttcgactccgaatatatcaagactcgtacaaatgattgggactttgtggtcaccacggatattagcgagatgggcgccaacttcaaggcagagagagtaatcgacccacggaggtgtatgaaacccgtgatattaactgatggcgaagaacgcgttatcctggctgggcctatgccggtgacacattcttcagccgcacaacgaagaggacgggtcggtaggaatccaaagaacgaaaatgaccagtacatttacatgggcgagccccttgaaaacgatgaggactgcgcccactggaaagaggctaagatgctgctcgacaatatcaacacccctgaagggattatcccctccatgtttgagccagaacgcgagaaagtggatgccatagacggagaatatagattgaggggcgaggcgcggaagaccttcgttgatctgatgcgtcgcggtgacctccctgtgtggctggcataccgagtcgccgctgaggggattaactatgccgatagaaggtggtgttttgacggcgtgaaaaataaccagatccttgaagagaatgtagaagtggagatttggactaaggagggagaacggaagaaactaaagccccgctggctggatgctagaatctacagtgacccattggcattaaaagagttcaaggagttcgccgctggcaggaaaagcctgacactcaacctgataaccgagatggggcggcttcctacatttatgactcaaaaggcccgaaatgcactggataacctcgcggttttgcatacggccgaagctggaggtagagcctataatcacgcactgtcggagctaccggagaccctggaaacactccttctgttaactttgctggctaccgtcacaggcgggatcttcctctttctgatgtctggaaagggcattggtaaaatgacccttgggatgtgctgcatcattactgcctccatcctgctctggtacgcacagatacagccccactggattgccgctagcatcatcttggagttctttctgattgtgttactaatcccagaacctgagaagcagcgcacgccccaagacaaccagctgacctatgtggtcatagcgattctcacagttgtggccgcaactatggctaatgaaatgggcttccttgagaaaaccaagaaagattttggactgggctcaatcacaacccagcagccagagagtaacattttggacatcgatctgaggcctgcctctgcctggactctctacgcagtagctacaacgttcataacccccatgctgcggcattccatcgaaaatagctcagtgaacgtcagtcttactgccattgcgaatcaagctacagtgctcatggggctgggaaagggttggccgttgagcaagatggacatcggcgttccactgttagccattgggtgttactcccaggtgaaccctatcaccctaaccgcagccctgctccttctggtcgctcactatgcaattatcggacccggcttgcaggccaaagcgacacgtgaggctcagaagagagccgcagccggtataatgaaaaatccaactgtagacgggattacggtgatcgatctggaccccatcccttacgatccgaagtttgaaaaacaactcggccaggttatgctgcttgtgttatgcgtcacccaggtgctgatgatgaggacaacttgggctctctgtgaggccttgaccctggcaacaggacccatttctaccctatgggaaggcaacccagggcgcttctggaatactacgatagctgtcagcatggccaacatctttcggggatcctatctggcgggcgccggtctccttttctcaattatgaagaacacagcaaatacccgaagagggactggaaacaccggcgagacactgggtgagaagtggaaaaataggttgaacgctctgggcaagtctgaatttcagatctacaaaaagagtgggattcaagaggtggaccgcactctcgccaaagaaggaatcaagcggggcgagaccgatcatcacgcagtttcgagagggagcgctaaactgcgttggttcgtggagaggaatttagtaacacctgaaggaaaggtggtcgaccttggctgcggtagaggcgggtggtcctattactgtgggggtctgaagaacgttaaagaggtgaagggcctcacgaaagggggacccggccatgaggaacctataccaatgtctacctatgggtggaatctagtccgcctgcagtcaggagtggatgtattctttactccccctgaaaagtgcgacacattgctgtgtgatatcggcgagagctccccaaaccccaccgtggaggccggtcgaactctcagagttcttaatctggtggaaaactggttgaataacaatacacagttctgcattaaagtcctgagtccgtacatgccttctgtgatcgagaagatggaagccctccaaaggaagtacgggggagcgttagtccggaacccactgagccgcaattcaacccacgagatgtattgggtgtccaacgctagtggcaacattgttagctctgtaaatatgatctccagaatgcttataaacaggtttacgatgcgacacaaaaaggcaacctacgaacccgacgtggatctgggctcagggacacggaatattggaatcgagagcgagactcctaacctagacatcattggtaaacgtatagaaaagatcaaacaggagcatgaaacctcgtggcactatgatcaggaccatccatacaagacatgggcctatcacggctcttacgagactaagcagaccgggagtgcttccagcatggtcaatggagtggttagactcctgacaaaaccctgggacgtgattccgatggtcacccaaatggccatgactgatacgacacctttcggccagcagcgcgtgtttaaggaaaaagtagacaccaggactcaggagcccaaggagggtaccaaaaagttgatgaagatcacagcagaatggctgtggaaagagctcgggaagaaaaagacgccacggatgtgtaccagagaagagttcactcgcaaagtgaggtcaaacgccgctcttggagcgatttttacagatgagaataagtggaaatccgcccgagaagcagttgaggactctggcttctgggaactggtcgataaggagcggaacttacacctggaaggcaagtgcgagacctgtgtgtataatatgatggggaaaagagagaagaaattgggagaatttggtaaggctaaaggcagcagggccatctggtacatgtggctcggggcacgcttcctggagtttgaagccctaggattccttaacgaggaccattggtttagtcgtgaaaattccctgagcggcgtggagggtgaggggctccacaagctgggatacatattgcgggatgtctctaagaaagaaggcggcgctatgtatgccgacgatactgcggggtgggacacaagaatcaccctggaggatctcaagaacgaagagatggttacaaatcatatggaaggagagcacaagaaacttgcagaggccattttcaggctgacttaccaaaacaaagtggtacgcgtgcagcgacctacaccccggggtacggtcatggacatcatttcaagaagggaccagcgcggcagtggacaggtggttacctatggattaaatacattcactaacatggaagctcaactgatcagacagatggagggcgaaggtgtgtttaaatccattcagcatttgaccgtcacagaggagatagccgtgaagaactggctcgaacgggtagggagggagcgtctgagccgaatggcaatctctggagatgactgcgttgtgaaaccactagatgaccgcttcgcttcggcccttactgctctgaatgatatgggcaagattagaaaagacatccaacagtgggaaccctcacggggctggaacgattggacccaggtccctttttgcagccaccacttccatgagctcatcatgaaggacgggagggtgctggtggtcccatgtcgcaatcaggatgaattgattggacgagcacggatatcccaaggtgcaggctggagtttaagggagacggcgtgcctggggaaatcttacgcccagatgtggagcctcatgtattttcaccgacgtgaccttagactggctgccaacgcaatctgttccgctgttccgtcacattgggtgcccacaagtcgcaccacttggtctattcacgccacacacgagtggatgaccactgaagatatgctaaccgtatggaatcgggtgtggatccaggagaacccttggatggaagacaagacaccagtcgagagctgggaagagattccctacctgggaaagagggaggatcagtggtgcggctccctcatcggtttgacgtcaagagcaacctgggccaaaaatatacaaactgcgatcaaccaggtgcgcagcctgattgggaatgaagagtatacagactacatgccttctatgaagcggttcaggcgagaagaggaagaggctggagttctttggtga

SEQ ID NO: 14915 - RNA, 9876 nt, synthetic construct
  misc_feature 1..9876: note = derived and/or modified CDS sequence (opt3) from DENV-2__KJ830750__SS-prME
  source 1..9876: mol_type = other RNA
accgccggcgtgatcattatgctgatacccactgctatggcattccacctcactacgcgtaacggggagcctcatatgatcgtctccaagcaggaaaaaggaaagtcccttctgtttaaaaccgaggacggtgttaatatgtgcacattgatggccatggatttaggcgaactgtgtgaggacactattacctacaactgcccactactcagacaaaatgaaccggaggatatcgactgttggtgcaactctacatcaacctgggtgacttatgggacatgtaccgcgacgggagagcaccggcgcgaaaagcgaagtgtggctctggtgccccatgtcggcatgggtcttgagactcgtaccgaaacatggatgagctccgagggggcctggaaacacgcacagagaattgagacttggatcctgaggcatcctggattcaccataatggccgctatcttggcatacacaattggcaccacgtattttcagcgggtgctcatcttcattctgctgactgccgttgctccatctatgacaatgcgctgcatcggcatatcgaatagagattttgtggaaggggtctcaggaggtagctgggtggacattgtactcgagcacggcagttgtgttaccactatggccaagaacaagcccacattagatttcgaactgatcaaaaccgaggcgaagcagcctgcaacgcttaggaaatactgcattgaagccaagttgaccaatacaactaccgcttcccggtgtccaacacaaggggagccctctctgaacgaggaacaggacaaacgctttgtgtgcaagcacagcatggtcgatcgaggatggggcaatggttgtgggctattcggaaagggcggcatcgtgacttgcgccatgtttacctgcaaaaagaacatggaggggaaaatcgtgcagcctgaaaatctcgagtatacaattgtcgttaccccacattccggagaagagaacgcagtgggtaatgacactggcaagcacgggaaagagataaaggtaacgccgcagtcaagtatcacagaagctgagctgaccggatacggcactgtgaccatggaatgtagccccagaacaggtcttgatttcaacgagatggtcctgttgcaaatggaaaataaagcctggctcgtgcataggcagtggtttctggacttacctctgccatggctccccggggcggatattcagggctctaactggatccagaaggagacccttgttactttcaagaaccctcacgccaaaaagcaagacgtggtcgtgctgggatcccaggagggcgcaatgcacacagctttgacgggggccaccgaaatacagatgtcaagcggaaatctactgtttactggtcatctcaaatgccggctgcgtatggacaaacttcaactgaaaggcatgagttattctatgtgtacagggaagttcaaggtagttaaagagattgctgaaacccagcacggaacaatcgtggtccgcgtgcagtacgagggcgatggttccccatgcaagatccccttcgagattatggacttggagaagcggcatgtcctcgggaggctgatcactgtgaacccgattgttaccggcaaggatagccctgtgaatatagaggccgaacccccatttggagactcgtacatcattatcggcgtagagcctgggcagttaaaactgtcttggttcaagaagggatcctcaatcggtcaaatgtttgaaacgaccatgcggggcgcaaaacgaatggccattctaggggatacagcttgggacttcggaagtctcggcggtgtctttactagcatagggaaggcgctgcaccaggtgttcggcgcaatctatggagccgctttttccggcgtttcttggaccatgaaaattcttatcggggtggtcattacatggatcggaatgaacagccgctcaacaagtttgtccgtgagcctggtactcgtgggcgttgtcaccctgtaccttggtgtgatggtgcaggccgattctgggtgtgtcgtttcatggaagaataaagagctgaagtgcggaagtggcatattcatcacggacaacgtgcatacatggaccgagcagtataagtttcaacccgaaagcccatccaaattggcatctgccattcagaaggctcacgaggaaggtatctgtggcattagatcggtgactaggctcgagaatctgatgtggaaacagatcacacccgaattaaaccacatactgagcgagaatgaggtaaagctatccattatgaccggggatatcaaaggaattatgcaggccggcaagcggtcactccgccctcaaccaactgaactgaaatacagttggaagacctgggggaaggcaaaaatgctttctacagagccgcataaccagacgttcttgatcgacggacccgaaaccgcggagtgccctaatactaacagagcttggaatagcctggaagtcgaggattatggctttggtgtgttcacaaccaacatatggctcaagctgaaagagaggcaggacgtttcctgtgactcaaagttaatgagcgccgcaatcaaagataatcgtgccgtgcacgctgacatggggtactggattgaatctgccctgaacgatacatggaagatcgagaaggcatcctttattgaagtcaaaagttgccattggccaaagagccacactctttggtctaacggagtgttggagtccgagatgatcatacccaaaaatttcgctggccctgtttcacagcacaactatcggccaggttaccatacccaaacggccggcccctggcacctcgggaagctggaaatggacttcgatttttgtgagggaacaaccgtggtagtcactgaagactgcggcaatcgagggccgagtctaagaaccacaactgcgagcggaaaactgattaccgagtggtgctgtaggtcgtgcacactccctccactgcgctaccggggcgaagatggttgttggtatgggatggagatcagaccccttaaggagaaggaagagaacttggtaaattccctggtgacggccggacatggccagatcgacaacttctctttaggtgtcctcggcatggctctgtttcttgaagagatgctgaggacccgcgttgggactaaacacgcagtgttgctcgtagccgtgagcttcatgacactgattaccggaaatatgtcatttcgagatctaggccgggtcatggtgatggttggggctgccatgactgacgatatcggaatgggcgtgacatacctggcactcctggcggccttcaaggtccgtcctacctttgctgccggtcttttgctgagaaaattaacgagtaaggaactcatgatgactaccattgggatagtgctgctttcccagtctacaacccccgagagcatcctggagctaactgacgcactcgctctgggaatgatgattttgaaaatcgttaggaacatggaaaagtatcaactggccgtgacaattatggcaatcttatgcgtcccaaatgccgtaatactccagaacgcttggaaggtgtcctgtaccatcctggcggccgtttcagtgagccctcttctgttgacaagttctcagcagaaagcagattggattcccctcgctctgactatcaagggcctaaatccaaccgccattttcctgacgacactttcccgcaccaacaaaaagcggagctggccgctcaatgaggccatcatggctgtcggcatggtgtcgatactggcatcatctttgctgaaaaacgacattcctatgactgggcccttagtagccggaggtctcctgaccgtgtgctacgtccttacaggcagaagtgcggacctggaattggagaaggctgccgatgttaggtgggaagaccaagcagagatctccgggagctctccaatcctcagcattactatatccgaggatggatcaatgagtatcaaaaatgaagaggaagaacagaccctgacgattctaatccgaacaggcctgcttgtgattagcggtctctttcccgtgtctatccctataaccgccgctgcatggtatctgtgggaggtcaagaagcagcgcgccggggtgttgtgggacgttccatcaccccctccggtaggaaaagcggaattagaggatggcgcttaccggatcaagcagaaaggcattctggggtatagccaaatcggagccggtgtgtacaaggaaggcactttccatacaatgtggcacgtcaccagaggggcagtgctcatgcacaaaggaaagaggattgagccaagttgggccgacgttcgtaaggatctgatcagctacggcggtgggtggaaacttgaaggagagtggaaggagggcgaagaggtgcaggtcctggctttggaacccggcaaaaaccctcgcgccgtgcagactaagccagggctatttaaaacaaacaccggaacgataggtgcagtatccctggacttctctcccggcacttcggggagccctattgtcgataagaagggaaaagtggttggcctctatggtaatggggtggtcacccggtcaggaacatacgtgtccgctatcgcccagaccgagaagagtatcgaagacaacccggagattgaggatgacatctttaggaaaaagaggctgacaataatggatcttcatcccggcgcgggcaaaactaagcgatatttaccagccattgttcgggaagcaatcaagcgcgggctgagaaccctcattttggctcctacgagggtggtcgccgctgagatggaagaggcactgcggggactccccatccgataccaaacaccagccataagagccgaacacactggtcgcgagattgtggacctgatgtgtcatgctaccttcacaatgaggcttctgtctcctgtacgtgtgcccaattataacttgatcatcatggacgaggcgcacttcaccgatccagcaagcattgccgctcggggctacatctccactagagttgaaatgggggaggccgcaggaatttttatgaccgccacaccgcctggctcaagggaccccttcccacagtctaatgctcccataatggatgaagaacgcgagatccctgaacgaagctggaacagtggtcatgagtgggtcacggactttaaagggaagactgtgtggttcgtgccatccattaaagcgggaaatgatatcgccgcatgcctaagaaagaacggcaaaaaggtcatccagctgagccggaagacctttgactctgaatatattaaaacaaggaccaatgattgggacttcgtagtgactacagatatatcagagatgggcgctaactttaaggccgaacgcgttatcgacccccgtagatgtatgaaacctgtgattctcaccgatggggaggagcgggtcatcttagcaggaccgatgccagtgacgcactccagtgccgctcaaaggcgcggtcgaattggcagaaatcccaagaacgaaaatgaccagtacatctacatgggggagcctctggaaaacgacgaggattgcgcccactggaaagaagcgaagatgcttctggacaatataaacactcccgagggaatcattccaagcatgttcgagcctgaacgggagaaagttgatgcaatcgacggcgaatataggctccgcggtgaggccagaaagacatttgtggatttgatgaggagaggggacctgcccgtctggctcgcttaccgtgtggccgctgaaggcattaactatgcagatcgccgatggtgtttcgacggaatcaagaataaccagatactggaggagaatgtagaagtggagatttggaccaaagaaggcgagagaaagaaacttaagccaaggtggctagatgcccggatctactcggaccctctggctttgaaagagtttaaggagttcgccgcagggcgcaagtctttaaccctgaacctcattactgagatgggaagactgccgacattcatgacccagaaagcgaggaatgcccttgataacctggctgttctccatacagccgaagcagggggacgggcttataatcacgccttgtccgagctgcccgaaactctagagacgctgctccttctgaccttattggcaacagtcactgggggaatctttctgttcctcatgagcggcaagggtatagggaaaatgaccctgggcatgtgctgcatcattacagcctcaatccttctgtggtacgctcaaattcagccacattggatcgcggccagtataattctcgagtttttcttgatcgtgctgttaatccctgaacccgagaagcagcgaaccccacaggacaaccaactaacttatgtggtcattgcaatcctgacggttgtggctgccaccatggccaatgaaatgggatttctcgagaaaacaaagaaggatttcggccttgggtctatagcaattcagcagcctgaatccaacatcctggacattgacttgagacccgctagcgcctggactctgtacgcggtagctaccacatttatcaccccgatgctccgccactcaatagagaatagtagcgtgaacgtctccctgactgccatcgcaaatcaggccacagtgcttatgggactcggtaaaggctggccactgtctaagatggatattggggttcctttgctggctatcggatgttacagccaagtgaaccccattacgttaaccgcagccctactgctccttgtcgcgcactatgctatcattggcccaggtctgcaggccaaagcaactagggaggcccagaagcgggctgccgcagggatcatgaaaaatcccacagtagacggcgtgaccgttatagatttggaccctattccgtacgatcccaagttcgaaaagcagctgggacaagtgatgctcctggtcctttgcgtgacccaggtcttaatgatgcgtacaacttgggctctgtgtgaggccctcacgttggcgaccggcccaatctccacactgtgggaagggaaccctggaagattttggaatactaccatcgccgtgtcaatggcaaacattttcaggggctcttatctagctggtgccgggctgctctttagtataatgaaaaacacaaccaatactcgccggggaacgggcaacacaggtgagacccttggcgaaaagtggaaaaatcgactgaactcgttgggtaagagcgagttccagatctacaaaagatccggcattcaagaggttgacaggactctggcaaaggaaggcatcaaacgcggggagaccgatcatcacgctgtgtctcggggatcagccaagctcagatggtttgtagaacgtaatctggtgacacccgagggcaaggtcgttgacttaggttgcgggaggggaggctggagctattactgtggtggccttaaaaacgtgcgggaggtcaaggggctgactaaaggaggccctgggcatgaggaaccaattcccatgtccacctatggatggaatctcgtgcgcctacagagtggcgtagatgtgttcttcacacctccagaaaagtgcgacacgctgttgtgtgatatcggtgagtctagccccaacccgaccgttgaagccgggcgaactctgagagtgctcaatcttgtcgagaactggctgaataacaatacacagttttgcataaaagtgttgaacccttacatgccatcagtcatcgagaagatggaaaccctgcagaggaagtacggaggcgcgctcgtgcggaatcccttatcccgcaacagtactcacgagatgtattgggttagcaacgcttctggcaatattgtatcctcagtgaacatgatcagcagaatgctgattaataggttcacaatgcgacataaaaaggcaacctacgaacctgacgtcgatcttgggtcgggaacgcggaacatcggtatagagtctgaaaccccaaatctggacattatcggcaaacgtatcgagaagattaaacaagagcacgaaacaagttggcactatgaccaggatcatccctacaagacttgggcctatcacgggtcctacgagaccaagcagacaggaagcgcttcatccatggtgaacggcgttgtgagactactcactaaaccgtgggacgtcatacctatggtgacccagatggccatgacagataccactccctttggtcaacagcgcgtattcaaggaaaaagtggacacgaggacacaggagccaaaggaagggaccaaaaagctgatgaagatcactgcagagtggttgtggaaagagctgggaaagaaaaagacccctcggatgtgtacaagagaagagtttgcccgcaaagttaggtctaatgctgcgctcggcgccattttcacggatgaaaacaagtggaaaagcgcacgagaggctgtcgaggacagtcggttttgggaacttgtggataaggagagaaatctgcatttagaaggcaagtgcgagacctgtgtgtataacatgatggggaaaagggaaaagaaaatcggagagttcggtaaggccaaaggctcccgcgcaatttggtacatgtggctgggggccagatttttggagttcgaagctctcggatttctgaatgaggaccactggttcagccgggaaaactctctatcaggcgtcgagggtgaagggcttcacaagctgggatacatcctcagagaggttagtaagaaagagggcggcgccatgtatgcggatgacactgcagggtgggatacaaggataaccctggaagacttgaagaatgaggaaatggtgactaaccatatggagggagaacacaaaaagctggccgaggctatctttaaactcacataccagaataaggtagtgcgcgtccaacgacccaccccacggggtacagtgatggacattatctccagaagggatcagcgcggcagcgggcaggttggaacttatggccttaacaccttcacgaacatgggtgcccaactgattagacagatggagggggaaggagtgttcaagggcatccagcatttaaccgcaacagaggaagtcgctgtgcaggactggctggcccgggtaggcagggagcgtttgtctcgaatggctatttcgggggatgactgcgttgtgaaacccctcgatgaccgctttgcctcagcactgactgcgctaaatgatatgggaaaggtcagaaaagacatacaacagtgggagcctagccggggttggaacgattggacccaggtgccattctgctcccaccattttcacgaacttatcatgaaggacggcagggtgctggtcgttccgtgtcgcaatcaggatgagctcattgggagagcccggatcagtcaaggagctggctggtctctgagggaaacagcctgcttgggtaaaagctacgcacagatgtggtccttaatgtatttccaccgacgtgacctgagactcgctgccaacgcaatctgttcagccgtgcccagtcattgggtacctacttctcgcaccacgtggagcattcacgcggggcatgagtggatgacaaccgaagatatgcttactgtgtggaatcgggtctggatacaggagaacccatggatggaggacaagacacccgtggaatcctgggaggaaatcccttacctgggaaagagggaggaccagtggtgcggctcactaattggcctgaccagcagagctacttgggcccgcaatatccaaaccgcaattaaccaggttcggtctctcatcgggtccgaagagtatacagattacatgccaagtatgaaaaggtttcgaagagaggaagaggaagccggagtgttgtggtga

SEQ ID NO: 14916 - RNA, 9876 nt, synthetic construct
  misc_feature 1..9876: note = derived and/or modified CDS sequence (opt3) from DENV-2__FM210231__SS-prME
  source 1..9876: mol_type = other RNA
agcgcaggaatgatcattatgctgatccccaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacactatcacttacaaatgcccactgctcaggcaaaacgaaccggaggatattgactgttggtgcaattctacctcaacatgggtgacctatggaacttgtacgaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactgccgagtgccccaatacaaacagagcatggaatagtctggaagtggaggattacggatttggcgtgttcaccacaaacatctggctcaagctgaaagaaaagcaggacgcgttttgtgactctaagttaatgagcgctgccattaaagataatagggcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaaactcattaccgagtggtgctgtagatcctgcacactgccgcctcttaggtatcgcggagaggacggctgttggtacggtatggaaatacggccattgaaggagaaagaagagaatctggtgaactcattagttacggcggggcacggacaggtggataatttcagtctcggcgtactgggtatggccctttttctggaagagatgttgagaaccagggtcggcactaagcatgctatcctcctggtggcagtgagcttcgtcacactaattaccgggaacatgtcgtttaaagacctgggacgcgttgtggtaatggtgggcgccactatggctgatgacatcgggatgggagtcacatatctcgccctgcttgcagcgttcaaggtgcgacccacctttgccgctggcttgctgttacggaagctcacgtccaaagagctgatgatgactaccattggtatcgttcttctgtctcaaagcacaatacctgaaaccgtgctagagctcactgatgccctggcattggggatgatggtcctgaagatcgtgcgtaatatggaaaaataccagttagctgttacaattatggccatcctctgcgtgcccaacgcagtcgtactgcagaatgcctggaaggtgtcatgtaccattcttgctgttgtgagtgtctccccactgttgctcacatctagccagcagaagactgactggatccctctggcgctaaccataaagggactgaaccccacggccattttccttacaaccctctccagaactaataaaaagaggtcatggccactgaacgaggcaatcatggctgtgggcatggtaagcatcttggccagttctctgttaaagaatgacattccgatgaccggccctctcgtggccgggggactgcttacagtctgctatgttctgactggtcgctccgctgatttggaactcgagcgggcaaccgacgtgaaatgggaggatcaggccgaaataagcggctcgtcacccatcctgtctattacgatcagtgaggacgggtccatgagcattaagaacgaagaggaggaacagacactaaccatcctgataagaactggacttctcgtgatctctggcctgtttccaattagcatccccattacagcggctgcctggtacttgtgggaggtcaaaaagcagagggccggtgtgttatgggatgttccttccccaccccctatggggaaagccgaactggaggacggagcttatcgaatcaagcaaaagggcatactcggctactcacagattggggcaggagtatacaaagaaggtaccttccacactatgtggcatgtgacacgcggcgccgtcctgatgcacaaggggaaacggatcgagccgagttgggcggatgtgaagaaagaccttatcagctatggaggcggttggaagctggagggggaatggaaggagggagaagaggttcaggtgttggctctagaaccaggcaaaaatcccagagccgtccagaccaagcctggcctgtttaaaacgaacactgggaccattggagcagtgtctctcgatttctccccaggtacatcaggcagtcccatcatagacaagaaagggaaggtagtcggactgtacggcaacggtgtggttaccaggagcggggcctatgtgtccgctattgcccaaacagagaagtctatcgaggataatcctgaaattgaggacgatatctttcgtaaacgccggcttactataatggacttacacccgggagcaggcaagaccaaaagatacctgcccgctattgtcagggaagccatcaagcgaggcctccggacgttgatcctggcgccaacacgcgtggttgccgcagagatggaagaggctctcagagggctgcctattaggtatcagactcccgccatcaaagctgagcataccggacgggaaattgtggaccttatgtgtcacgcaacattcaccatgcgactgttgtcgccagtcagagtgcctaactacaatctaataatcatggatgaggcccatttcactgaccccgccagcattgctgcgcgcggttatatctcaaccagggtagaaatgggcgaggcagccgggatctttatgacagctacgccaccgggatcccgtgatcctttcccccagagtaacgccccaattatagacgaggaacgggagatccccgaaagatcttggaatagcggccacgagtgggtgactgattttaagggtaagaccgtttggttcgtcccttccattaaagcagggaacgacatcgccgcttgcctgaggaagaatggcaagaaggtgattcaactctcacgcaaaacatttgattctgaatacgtgaagacccgaactaacgactgggatttcgtcgtaacaaccgacatcagcgagatgggcgcgaattttaaagccgagagagtgatagatccacggaggtgtatgaagcccgttatcttaacggacggcgaagaacgcgtgattctggcagggcctatgccggtcactcatagttccgctgcccagcgtagaggacggatcggtaggaacccaaagaatgaaaacgaccagtacatttatatgggcgagccccttgaaaatgatgaggactgcgcacactggaaagaggccaagatgctgctcgataacatcaatacacctgaagggataattcccagcatgttcgagccagaacgcgagaaagtggacgctatcgatggagaataccgattgagaggcgaggcccggaagacctttgttgacctgatgaggcgcggtgatctccctgtgtggctggcgtataaagtcgcagccgaggggattaactacgctgacagaaggtggtgtttcgatggcatcaagaacaatcagatacttgaagagaacgtggaagtagagatctggaccaaggagggagaacggaaaaagctaaaaccccgttggctggacgcccgcatttattctgatccattggctttaaaggagtttaaagagttcgcagccggccgaaagtcactgactctcaatctgatcacagagatggggagacttcctaccttcatgacacaaaagactagggacgctctggataacctcgccgtgttgcacacggcagaagcgggaggtcgggcctacaatcatgctctgtccgagctaccggagaccctggaaacactccttctgttaactttgctggccaccgttacaggcgggatttttctcttcctgatgagtggacgcggcatcggtaaaatgacccttgggatgtgctgcataattactgcaagcatcctgctctggtatgctcagatccagccccactggattgccgcatcgatcatattggagtttttcctgattgtcttactaatcccagaacctgagaagcagagaacgccccaagacaaccagctgacctacgtggtgattgccatcctcacagtcgttgctgcgactatggccaatgaaatgggctttcttgagaaaaccaagaaagacctgggattgggctctatagtgacacagcagccagagtccaacatcctggatattgacctcaggcctgcaagcgcttggaccctgtacgccgtagccactacattcgtgacgcccatgcttcggcattcaatcgaaaatagttctgtcaacgtgtccctcaccgcaattgctaatcaagccactgttctgatggggttgggaaagggttggccgctgagcaagatggatatcggcgtgccattactagcgattgggtgttattcacaggtcaaccctatcacactgaccgctgccctccttctgttggtagcacactacgccataattggacccggcctgcaggctaaagcaacccgagaggcccagaagagagcggctgccggtatcatgaaaaatccaacagtggacgggatcactgttattgatctcgaccccataccttatgatccgaagtttgaaaaacaactgggccaggtgatgcttttaatcctgtgcgtcacacaggtgctcatgatgcgcaccacatgggcattgtgtgaggccctgactctagctaccggacccattagtacactgtgggaaggcaacccagggaggttctggaataccactatcgccgtcagcatggcaaacatttttcggggatcctacctcgctggcgccggtcttctgttctctatcatgaagaatacgacaaacacccgtagagggactggaaacataggcgagaccttgggtgagaaatggaaaagcaggctgaatgcgctcggcaagtccgaatttcaaatctataaaaagtcagggattcaggaggtggaccgcacactggccaaagaaggaatcaagcggggcgagactgatcaccatgcagtttctcgagggagtgctaaattaagatggttcgtggagaggaacatggtaacccctgaaggaaaggtggtcgaccttggctgcggtcgcgggggatggtcgtactattgtggcggtctaaagagcgttcgggaggtgaaaggcctcacaaaagggggacccggccacgaagaacctattccaatgtccacgtacgggtggaatctagtcagactgcagtctggagtggatgtatttttcataccccctgaaaaatgcgacaccttgctgtgtgatataggcgagtcaagcccaaaccccactgtggaggccggtcgtacactcagggttcttaatctggtggaaaactggttgaataacaatacccagttctgcattaaggtcctgaacccgtacatgccttccgtgatcgagaaaatggaagcactccaacggaagtatgggggagctttagtccgcaatccactgagtcgaaactctactcatgagatgtactgggtgagcaatgcctcaggcaacatcgtttccagtgtaaatatgattagcagaatgcttataaacaggtttacaatgcggcacaagaaagccacctatgaacccgacgtggacctgggctctgggacgcgcaacatcggaattgagtccgagatccctaatctagatattatcggtaagagaatagagaagatcaagcaggagcatgaaacctcatggcactacgaccaggatcacccatataaaacatgggcgtaccatggcagctatgagactaagcagaccgggtcggcttctagtatggtcaacggagtggttaggctcctgacaaagccctgggacgtgttgccgactgtcacccaaatggcaatgacagataccactcctttcggccagcagcgagtgtttaaagaaaaggtagacacgcggacacaggagcccaaagagggtaccaagaaactgatgaagattactgccgaatggctctggaaagagcttgggaagaagaaaaccccacgtatgtgtacaagagaagagttcacgcgcaaggtgaggtccaatgctgccctgggagcaatctttaccgatgagaacaaatggaaaagcgcccgggaagctgttgaggactcaagattctgggaattagtcgataaagagcgcaatctgcacttggaaggcaagtgcgagacttgtgtgtacaacatgatgggcaagagggagaaaaagctcggggaatttggaaaagcgaagggttcccgagccatttggtacatgtggctgggcgcacggttcctagagtttgaagctcttgggttcctgaatgaggaccattggttttctagagaaaacagcctcagtggagtggagggcgagggtctgcacaaattggggtatatcctgagggatgtctccaagaaggaaggaggcgccatgtacgcagacgacacagccggctgggatacccgcattactctcgaggaccttaaaaatgaagagatggttacaaaccacatggaaggggagcataagaaactggctgaggccatattcaagttaacctatcaaaataaagtggtacgtgtgcagcggcctacacccagaggaactgtcatggatatcattagcaggcgcgaccagcgaggttctggccaagtggggacctacggactgaacacgtttaccaatatggaagcgcagttgatccggcagatggagggcgaaggtgttttcaagaacatccagcacctcacagtgactgaggaggtcgcagtgcaaaattggctggccagagtagggagggaacgcctatcaagaatggctattagtggagatgactgcgttgtgaagccacttgatgaccggttcgccaacgcactgaccgctctcaacgatatgggcaaaataaggaaggacatccagcagtgggagccctccaaaggctggaatgattggacacaggtccctttttgcagccatcacttccatgaactgattatgaaggacgggcgtgtgttggtggtcccatgtcgaaaccaagatgagttaatcggacgcgccagaatttctcagggtgctggctggtcgctgcgggaaactgcctgcctcgggaaatcatatgcacagatgtggagccttatgtactttcacaggcgcgacctgagactagcggccaatgctatctgttccgccgttccgagtcactgggtgcccacctctcggacgacatggagcatacatgcaaagcacgagtggatgaccactgaggacatgctgacagtatggaacagggtgtggatccgagaaaatccttggatggaggataagaccccagtcgaatcctgggaggaaattccctatctcggaaaacgtgaggaccagtggtgcggctcattgatcggtctgacaagtagagctacctgggccaagaacattcaagcagccatcaatcaggtgcgctctcttatagggaacgaggaatacacagattacatgcctagcatgaaacggttcaggagagaggaagaggaagcgggagttctgtggtga

SEQ ID NO: 14917 - RNA, 9876 nt, synthetic construct
  misc_feature 1..9876: note = derived and/or modified CDS sequence (opt3) from DENV-2__FM210239__SS-prME
  source 1..9876: mol_type = other RNA
accgccggcgtgataattatgctgatacccacagctatggcattccacctcactacgaggaatggggaacctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccaggacagaaacttggatgagtagcgagggagcttggaaacacgcccagaggatcgagacctggatactgcggcatcctggcttcacaatcatggcagccattttggcttacaccgtgggcacgactcactttcagcgcgcactcatcttcattctgctggccgctgttgccccatccatgacaatgagatgcatcgggatatctaacagggattttgtggaaggagtctcgggtggctcatgggtggacattgtactcgagcacgggagctgtgttaccactatggcgaagaataagcccacattagatttcgaactgatcaaaaccgaggcaaagcagcctgccacgcttcggaaatattgcattgaagctaagttgaccaacacaactaccgagagtcgctgtccaacacaaggagagccctccctgaatgaagaacaggacaaacgatttgtgtgcaagcattctatggtcgatagaggctggggtaacgggtgtggactattcggcaagggcgggatcgtgacttgcgccatgtttacctgcaaaaagaatatggaaggaaaaatcgtgcagcctgagaacctcgaatacacaattgtcataaccccacacagcggtgaggagcatgcagttggcaatgacactgggaagcacggaaaagaaatcaagattacgccgcagtcccccatcacagaggctgaactgaccggctatggtactgtgaccatggagtgttcacctaggacagggcttgatttcaacgaaatggtactgttgcaaatggaggacaaagcctggctcgtgcaccggcagtggtttctggatttaccactgccctggctccctggcgcggacacccagggaagtaattggatacagaaggagactcttgtcacattcaagaacccacatgccaaaaagcaagacgtggttgtgctgggcagccaggaaggggcaatgcacacggctttgaccggagccactgagattcagatgtcttccggtaatctactgtttacaggccatctcaaatgccgtctgcgcatggataaacttcaactgaaagggatgtcatacagcatgtgtaccggaaagttcaagatcgtcaaagaaatcgctgagacacagcacggcactattgtgatcagagtacagtatgagggtgacgggagtccctgcaagattccgttcgaaataatggatttggagaaaaggcatgttctcggccggctgatcaccgtgaaccctattgtcacggaaaaggactctcccgtgaacatcgaggccgaaccaccttttggagattcctacatcattataggcgtcgagcccgggcagttaaaactgaattggttcaagaagggaagctcgatcggtcaaatgtttgagaccacaatgcgaggcgcaaaacgcatggccattctaggggacactgcttgggatttcggatctctcggcggtgtgtttacctccatcgggaaggcgctgcaccaggttttcggcgcaatttacggagccgctttttcaggcgtgagttggacaatgaaaatccttataggggtaatcattacttggatcggaatgaacagcagatccacctctttgagcgtctcactggtgctcgttggcgtgattacgctgtatcttggtgccatggtccaggcagacagtgggtgtgtggtatcctggaagaataaagaactgaagtgcggaagcggcatcttcataacagataacgtgcacacctggactgagcagtacaagtttcaaccagaatctccctcaaaattggccagtgctattcagaaggcccatgaggaaggtatctgtggcattaggagcgttacacggctcgagaatctgatgtggaaacagatcacccctgagttaaaccacatactgtccgaaaatgaggtcaagctaactatcatgaccggggacattaaaggaatcatgcaggcaggcaagcgctctctcagaccacaaccgacagaactgaaatattcgtggaagacgtgggggaaggcgaaaatgcttagcaccgagtcccataaccagactttcttgattgatggacccgaaacagctgagtgccctaataccaacagggcctggaactcactggaggtggaagactacggctttggtgtgttcacaactaacatctggctcaagctgcgtgagaaacaggacgtcttttgtgatagtaagttaatgtctgcagccataaaagacaatcgggctgttcacgccgatatggggtattggattgaaagcgcactgaacgacacctggaagatggagaaggcttccttcatcgaggtgaaatcatgccactggccaaagagccatacgctttggtctaatggagtgttggaatccgagatgatcattcccaaaagtttcgccggccctgtaagccagcacaactaccgaccaggttattacacacaaaccgcgggcccctggcatctcgggaagctggaaatggattttgacttctgtgagggaactaccgtcgtggttacagaagattgcggcaacagagggccgtctctaaggactaccacagcctccggaaaactgatcacggagtggtgctgtcgctcatgcaccctccctccactgcggtacagaggcgaggacggttgttggtatgggatggaaattaggccccttaaggagaaggaagagaatttggtgaacagtctggtcactgctggacacggccagatagataattttagcttaggtgtgctcggcatggcactgttccttgaagagatgctgcgcacacgagttgggaccaaacatgccatcttgctcgtgactgtatcgtttgtcacactgattaccggaaacatgtccttccgggacctaggccgtgtgatggtgatggtcggggctgccatgacggatgacatcggaatgggcgttacttacctggcactcctggcggcctttaaggtgagacctaccttcgctgccggtcttttgctgaggaaattaacatctaaggagctcatgatggcaaccattgggatcgctctgcttagccagtcaactatacccgaaacaatcctggagctaaccgatgccctcgcactgggaatgatggtattgaaaattgtgcgcaatatggaaaagtatcaactggccgtcacaatcatggctattagttgcgtgccaaacgcggttatcttacagaatgcctggaaggtgtcctgtactatactcgcagctgtctctgtgagccctctgcttctgacctcctcacagcagaaagccgactggattcccttggccctcacgatcaagggcctgaacccaacagctatctttctaaccactctgagccggaccagtaaaaagagatcttggccgcttaatgaggcaattatggccgttggcatggtgtccatactcgcgagctcgctgttgaaaaacgacatccctatgacagggcccctggtcgctggaggtttactcactgtatgctacgtgctgaccggcaggtcagccgatcttgaactggagcgagcaacggacgttaagtgggaggatcaagccgaaatttctgggagttccccaatcttgagcattacaatcgctgaggacggatctatgagcatcaagaatgaagaggaggaacagaccctcactatcctgattcgcacaggcctactggtgatctccggtcttttccccgtctcaattcctatcaccgcagccgcgtggtatctctgggaggtgaagaagcagcgggctggggtactgtgggatgtgccaagtccccctccggtcggaaaagccgaattggaggacggcgcatacagaataaagcagaaaggcattttagggtatagccaaatcggagccggtgtttacaaggaaggcacttttcacacaatgtggcacgtgaccagaggggctgtgctgatgcatcgtggaaaacgcatcgagccatcttgggccgatgtcaagaaggacctcatttcctacggcggtgggtggaaactggagggagaatggaaggagggcgaagaggtgcaggttcttgcactggaacccggcaaaaaccctcgggctgtacagacgaagccagggttgttcaaaactaataccggaacaatcggtgccgtgtcactagattttagtcccggcaccagcgggtcccctatagtcgacagaaagggaaaggtggttggcctgtatggtaacggggtggtcacaaggtctggagcgtacgtgtcggccattgcacagactgagaaaagcatcgaggataatccggaaattgaggacgatatcttccgaaagaaacggctcaccataatggacctgcaccccggcgctggcaagacgaaacgctatcttccagccattgtaagagaagctatcaagagggggttacggacactgatcctcgcacctactcgagtcgtggccgccgagatggaagaggctttgagaggactgcccattcgctaccaaaccccagcgatcagggcagagcatacaggtcgtgaaattgttgacctcatgtgtcacgccaccttcactatgcggctgctttcacctgtgagagtccccaactataacctgataatcatggatgaggctcattttaccgacccagcctccattgcagccaggggctacatcagtacacgcgtggaaatgggggaggctgcgggaatcttcatgacggccactccgcctggctctcgagatccctttccacagagcaatgcacccattatggacgaggaaagagagatacctgaacggtcctggaactcaggtcacgagtgggttaccgatttcaaggggaaaacagtgtggtttgtcccatctatcaaggctggaaatgacattgccgcatgcttgaggaaaaacggcaagaaagtgatccagctaagccgcaagaccttcgatagtgaatatgtaaagactcgtacaaatgactgggattttgtggttaccacggacatttccgagatgggcgccaacttcaaagctgagagagtcatcgatccccggaggtgtatgaagcctgtgatactgactgacggggaagaacgcgtgatcctcgccggaccgatgccagtcacacacagctctgcggcacaacgaagaggtcggattggcaggaatcccaaaaacgaaaatgaccagtacatctacatgggggagcctttagaaaacgatgaggactgcgcccattggaaggaggctaaaatgctgcttgataatattaacacccccgaaggaatcataccatcaatgtttgagcctgaacgcgagaaggtagacgccattgatggcgaatatagactgaggggtgaggctcggcgtaccttcgtggacctcatgcgccgaggggatttgcccgtttggctggcatacagagtggccgctgagggcatcaattatgccgacaggcggtggtgttttgatggagtcaaaaacaatcagattctcgaagagaacgtggaagttgagatctggactaaggagggcgaacgcaagaaactgaagccaagatggcttgacgcaaggatatactccgatcctctagcgctgaaagagttcaaggagttcgccgctgggcggaaaagtttgacattaaacctgatcaccgagatgggacgactcccgacatttatgactcagaaggccagagacgcactggataatcttgctgtgctgcacacggccgaagccggtggacgcgcatataaccatgctctcagcgagttgcccgagaccctggaaacactactgctccttactctgttagcgaccgtcacagggggaattttcttgtttctgatgtcgggcaagggtgtggggaaaatgaccctcggcatgtgctgcatcattactgcctctatcctgctttggtacgcacaaatacagccacactggattgctgcctccatcatcctggagttctttctcattgtattgctgatccctgaacccgagaagcagaggacgccacaggacaatcaattaacctatgtggttatagccattctaacagtcgtggcagctactatggccaacgaaatgggattcctggagaaaaccaagaaagacctcggccttgggagcatcgcgacacaggagcctgaatcaaatattctggatatcgacttgcggcccgctagtgcctggaccctgtacgcagtggccactacatttgtcacgccgatgctccgtcactctatagagaactccagcgttaatgtgtcactgaccgctatcgcaaaccaggccactgtacttatgggactcggtaagggctggccactgagtaagatggatattggggtgcctttgctggcgatcggatgttacagccaggtcaatcccattacattaaccgctgccctactgctccttgtggcacattatgccatcattggcccaggtctgcaagctaaagccaccagagaagcacagaagagggctgccgcggggatcatgaaaaaccccacagttgacggcgtgactgtcatagatttggaccctattccgtacgatcccaagttcgagaaacagctgggacaggtaatgctcctgatcctttgcgtgacgcaagttttaatgatgcgcaccacatgggccctgtgtgaagcactcactttggctaccggcccaatctccacactgtgggaggggaatcctggacggttttggaacaccactattgccgtgtctatggcaaatatattccgaggcagctatctagctggtgccgggctgctcttttccatcatgaagaacacgacaaataccagaaggggaactggcaacattggtgagacccttggcgaaaagtggaaatcacgcctgaatgccttggggaagtctgagttccagatctacaaaaagagtggcattcaggaagtcgaccggacactggcgaaagagggcatcaagagaggggagactgatcaccatgctgtgtcgcgtggaagcgcaaaactcaggtggtttgtcgaacggaacatggtgacccccgagggcaaggttgtggacctgggttgcgggcgcggaggctggtcctattactgtggtggcttaaaggatgtacgagaagtgaaagggcttacaaagggaggccctgggcacgaggaaccaatacccatgtctacgtatggatggaacctggtcagactccaatcaggcgttgacgtgttcttcacccctccagagaaatgcgatactctactgtgtgacatcggtgagagctcccccaatccgacaattgaagccgggaggaccttgcgggtcctgagtctcgtggagaactggcttaataacgacactcagttttgcatcaaggtactgaatccttacatgccatctgtgattgagaaaatggagacattgcagcgcaagtacggaggcgctctggttagaaaccccctcagcagaaattcaacccatgaaatgtattgggtgtccaacgccacgggcaatatcgtcagtagcgtgaacatgatatctcgaatgttaattaatcggttcaccatgaagcacaaaaaggcaacatacgagcctgatgtcgacctggggtccggaactcgtaacatcggtatcgagtcagaaattccaaatcttgatataatcggcaaaagaattgagaagatcaaacaggaacacgagaccagctggcattatgaccaagatcacccctacaagacatgggcctatcatgggtcgtacgaaactaagcagaccggatctgctagttccatggtgaacggcgttgtacgcctgctaacaaaaccgtgggacgtggtccctatggtgacccagatggcgatgactgatacgacaccctttggtcagcaaagggttttcaaggagaaagtggacacccggactcaggagccaaaggaagggaccaaaaagctcatgaagattacagccgagtggctgtggaaagaattgggaaagaaaaagacgcctagaatgtgtacccgcgaggagtttactaggaaagtccgaagcaatgcagctctgggcgccatcttcacagatgaaaacaagtggaaatcagcacgggaggccgtggaagactccagattttgggagctcgtagataaggaaaggaaccttcacctggagggcaagtgcgagacctgtgtgtataatatgatggggaaacgcgaaaagaaattaggagagttcggtaaggctaaaggctctcgtgccatatggtacatgtggctgggggcgcggtttttggagttcgaggcactcggatttctgaacgaagaccactggttcagcagagagaatagtctatccggcgttgagggtgaagggcttcataagctgggatacatcctcagggacgtcagcaagaaagagggcggcgccatgtatgctgatgacactgccgggtgggatacacgcattaccctggaagacttgaagaacgaggaaatggtgacaaatcacatggagggagagcataaaaagctggcagaagctatctttaaactcacttaccagaacaaggtggtccgagttcagcggcccaccccaagaggtacggtgatggatattatctctaggcgcgaccaaagaggctcagggcaggtaggaacctatggccttaatacattcactaacatggaggcccagctgattcggcaaatggaaggtgagggggtgttcaagagtatacagaggttaaccgtcacagaggaaatcgctgtgcagaattggctggcccgtgttggacgagagcgcttgtccagaatggcaattagcggcgatgactgcgtggtcaaacccctcgatgaccggtttgcgtctgccctgactgctctaaacgatatgggcaaggtgaggaaagacatccagcaatgggaaccttcgcgcgggtggaatgattggacccaggtaccattctgctcacaccattttcacgagcttatcatgaaggacggaagagttctggtggtcccgtgtcggaaccaggacgaactcattggtagggcccgaataagccagggcgcagggtggtccctgaaagagacggcttgcttgggaaagagttacgcccaaatgtggtctttaatgtatttccaccgtagagatctgcgcctcgcagccaatgcgatctgtagcgctgtgccctcccattgggtgcctacatcacggaccacttggagtattcacgccaagcatgagtggatgacaaccgaagacatgcttactgtctggaacagggtttggatccaggagaatccatggatggaagataaaacccccgtggagtcttgggaagaggtaccttacctgggcaagagagaggaccagtggtgcggtagcctaattgggctgacatcccgcgcaacgtgggccaaaaacatccagaccgctataaaccaagtgcggtcactcatcggaaatgaagagtatactgattacatgccaagcatgaagaggtttcgaagagaagaggaagaggccggcgtcttgtggtga

SEQ ID NO: 14918 - RNA, 9876 nt, synthetic construct
  misc_feature 1..9876: note = derived and/or modified CDS sequence (opt3) from DENV-2__FM210232__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgcccagaggatcgagacctggatactgcggcatcctggcttcacaatcatggcagccattttggcttacaccgtgggcacgactcactttcagcgcgcactcatcttcattctgctggccgctgttgccccatccatgacaatgagatgcatcgggatatctaacagggattttgtggaaggagtctcgggtggctcatgggtggacattgtactcgagcacgggagctgtgttaccactatggcgaagaataagcccacattagatttcgaactgatcaaaaccgaggcaaagcagcctgccacgcttcggaaatattgcattgaagctaagttgaccaacacaactaccgagagtcgctgtccaacacaaggagagccctccctgaatgaagagcaggacaaacgatttgtgtgcaagcattctatggtcgatagaggctggggtaacgggtgtggactattcggcaagggcgggatcgtgacttgcgccatgtttacctgcaaaaagaatatggaaggaaaaatcgtgcagcctgagaacctcgaatacacaattgtcataaccccacacagcggtgaggagcatgcagttggcaatgacactgggaagcacggaaaagaaatcaagattacgccgcagtcccccatcacagaggctgaactgaccggctatggtactgtgaccatggagtgttcacctaggacagggcttgatttcaacgaaatggtactgttgcaaatggaggacaaagcctggctcgtgcaccggcagtggtttctggatttaccactgccctggctccctggcgcggacacccagggaagtaattggatacagaaggagactcttgtcacattcaagaacccacatgccaaaaagcaagacgtggttgtgctgggcagccaggaaggggcaatgcacacggctttgaccggagccactgagattcagatgtcttccggtaatctactgtttacaggccatctcaaatgccgtctgcgcatggataagcttcaactgaaagggatgtcatacagcatgtgtaccggaaagttcaagatcgtcaaagaaatcgctgagacacagcacggcactattgtgatcagagtacagtatgagggtgacgggagtccctgcaagattccgttcgaaataatggatttggagaaaaggcatgttctcggccggctgatcaccgtgaaccctattgtcacggaaaaggactctcccgtgaacatcgaggccgaaccaccttttggagattcctacatcattataggcgtcgagcccgggcagttaaaactgaattggttcaagaagggaagctcgatcggtcaaatgtttgagaccacaatgcgaggcgcaaaacgcatggccattctaggggacactgcttgggatttcggatctctcggcggtgtgtttacctccatcgggaaggcgctgcaccaggttttcggcgcaatttacggagccgctttttcaggcgtgagttggacaatgaaaatccttataggggtaatcattacttggatcggaatgaacagcagatccacctctttgagcgtctcactggtgctcgttggcgtgattacgctgtatcttggtgccatggtccaggcagacagtgggtgtgtggtatcctggaagaataaagaactgaagtgcggaagcggcatcttcataacagataacgtgcacacctggactgagcagtacaagtttcaaccagaatctccctcaaaattggccagtgctattcagaaggcccatgaggaaggtatctgtggcattaggagcgttacacggctcgagaatctgatgtggaaacagatcacccctgagttaaaccacatactgtccgaaaatgaggtcaagctaactatcatgaccggggacattaaaggaatcatgcaggcaggcaagcgctctctcagaccacaaccgacagaactgaaatattcgtggaagacgtgggggaaggcgaaaatgcttagcaccgagtcccataaccagactttcttgattgatggacccgaaacagctgagtgccctaataccaacagggcctggaattcactggaggtggaagactacggctttggtgtgttcacaactaacatctggctcaagctgcgtgagaaacaggacgtcttttgtgatagtaagttaatgtctgcagccataaaagacaatcgggctgttcacgccgatatggggtattggattgaaagcgcactgaacgacacctggaagatggagaaggcttccttcatcgaggtgaaatcatgccactggccaaagagccatacgctttggtctaatggagtgttggaatccgagatgatcattcccaaaagtttcgccggccctgtaagccagcacaactaccgaccaggttattacacacaaaccgcgggcccctggcatctcgggaagctggaaatggattttgacttctgtgagggaactaccgtcgtggttacagaagcctgcggcaacagagggccgtctctaaggactaccacagcttccggaaaactgatcacggagtggtgctgtcgctcatgcaccctccctccactgcggtacagaggcgaggatggttgttggtatgggatggaaattaggccccttaaggagaaggaagagaatttggtgaacagtctggtcactgcaggacacggccagatagacaattttagcttaggtgtgctcggcatggccctgttccttgaagagatgctgcgcacacgagttgggaccaaacatgctatcttgctcgtgactgtatcgtttgtcacactgattaccggaaacatgtccttccgggatctaggccgtgtgatggtgatggtcggggccgcaatgacggacgatatcggaatgggcgttacttacctggcgctcctggccgcttttaaggtgagacctaccttcgccgcaggtcttttgctgaggaaattaacatctaaggagctcatgatggctaccattgggatcgccctgcttagccagtcaactatacccgaaacaatcctggagctaaccgacgcactcgccctgggaatgatggtattgaaaattgtgcgcaatatggaaaagtatcaactggctgtcacaatcatggcgattagttgcgtgccaaacgccgttatcttacagaatgcatggaaggtgtcctgtactatactcgctgccgtctctgtgagccctctgcttctgacctcctcacagcagaaagccgattggattcccttggctctcacgatcaagggcctgaacccaacagcaatctttctaaccactctgagccggaccagtaaaaagagatcttggccgcttaatgaggccattatggcggttggcatggtgtccatactcgctagctcgctgttgaaaaacgacatccctatgacagggcccctggtcgccggaggtttactcactgtatgctacgtgctgaccggcaggtcagcagaccttgaactggagcgagccacggatgttaagtgggaggaccaagctgaaatttctgggagttccccaatcttgagcattacaatcgcagaggatggatctatgagcataaaaaatgaagaggaggaacagaccctcactatcctgattcgcacaggcctactggtgatctccggtcttttccccgtctcaattcctatcaccgccgcggcttggtatctctgggaggtgaagaagcagcgggccggggtactgtgggacgtgccaagtccccctccggtcggaaaagcagaattggaggatggcgcctacagaataaagcagaaaggcattttagggtatagccaaatcggagctggtgtttacaaggaaggcacttttcacacaatgtggcacgtgaccaggggggccgtgctgatgcatcgtggaaaacgcatcgagccatcttgggcagacgtcaagaaggatctcatttcctacggcggtgggtggaaactggagggagaatggaaggagggcgaagaggtgcaggttcttgctctggaacccggcaaaaaccctcgggccgtacagacgaagccagggttgttcaaaactaataccggaacaatcggtgcggtgtcactagactttagtcccggcaccagcgggtcccctatagtcgatagaaagggaaaggtggttggcctgtatggtaacggggtggtcacaaggtctggagcctacgtgtcggcaattgctcagactgagaaaagcatcgaggacaatccggaaattgaggatgacatcttccgaaagaaacggctcaccataatggatctgcaccccggcgccggcaagacgaaacgctatcttccagctattgtaagagaagcaatcaagagggggttacggacactgatcctcgcccctactcgagtcgtggccgctgagatggaagaggcgttgagaggactgcccattcgctaccaaaccccagcaatcagggccgagcatacaggtcgtgaaattgttgacctcatgtgtcacgctaccttcactatgcggctgctttcacctgtgagagtccccaactataacctgataatcatggacgaggcccattttaccgatccagcatccattgccgctaggggctacatcagtacacgcgtggaaatgggggaggcggccggaatcttcatgacggcaactccgcctggctctcgagacccctttccacagagcaatgctcccattatggatgaggaaagagagatacctgaacggtcctggaactcaggtcacgagtgggttaccgacttcaaggggaaaacagtgtggtttgtcccatctatcaaggccggaaatgatattgcagcctgcttgaggaaaaacggcaagaaagtgatccagctaagccgcaagaccttcgacagtgaatatgtaaagactcgtacaaatgattgggactttgtggttaccacggatatttccgagatgggcgctaacttcaaagccgagagagtcatcgacccccggaggtgtatgaagcctgtgatactgactgatggggaagagcgcgtgatcctcgcgggaccgatgccagtcacacacagctctgcagcccaacgaagaggtcggattggcaggaatcccaaaaacgaaaatgaccagtacatctacatgggggagcctttagaaaacgacgaggattgcgctcattggaaggaggccaaaatgctgcttgacaatattaacacccccgaaggaatcataccatcaatgtttgagcctgaacgcgagaaggtagatgctattgacggcgaatatagactgaggggtgaggcacggaaaaccttcgtggatctcatgcgtcgcggggacttgcccgtttggctggcctaccgagtggctgccgagggcatcaattatgcagatagaaggtggtgttttgacggagtcaagaacaatcagattctcgaagagaacgtggaagttgagatctggactaaggagggcgaacggaaaaagctgaaaccacgctggcttgatgcgagaatatactccgaccctctagccctgaaggagttcaaagaattcgctgccgggaggaagagtttgacattaaacctgatcaccgagatgggacggctcccgacatttatgactcagaaggcacgagatgctctggacaatcttgccgtgctgcacacggcagaagccggtggcagagcttataaccatgcgctcagcgagttgcccgagaccctggaaacactactgctccttactctgttagccaccgtcacagggggaattttcttgtttctgatgtcgggcaaaggtgtggggaagatgaccctcggcatgtgctgcatcattactgcatctatcctgctttggtacgctcaaatacagccacactggattgccgcctccatcatcctggagttctttctcattgtattgctgatccctgaacccgagaaacagcgcacgccacaggataatcaattaacctatgtggttatagcaattctaacagtcgtggctgccactatggcgaacgaaatgggattcctggagaagaccaaaaaggacctcggccttgggagcatcgctacacaggagcctgaatcaaatattctggacatcgatttgaggcccgccagtgcatggaccctgtacgccgtggctactacatttgtcacgccgatgctccggcactctatagagaactccagcgttaatgtgtcactgaccgcaatcgccaaccaggcgactgtacttatgggactcggtaagggctggccactgagtaaaatggacattggggtgcctttgctggctatcggatgttacagccaggtcaatcccattacattaaccgccgcactactgctccttgtggcccattatgctatcattggcccaggtctgcaagccaaggcaacccgtgaagctcagaaaagagccgcggccgggatcatgaagaaccccacagttgatggcgtgactgtcatagacttggatcctattccgtacgaccccaaattcgagaagcagctgggacaggtaatgctcctgatcctttgcgtgacgcaagttttaatgatgaggaccacatgggcactgtgtgaagctctcactttggccaccggcccaatctccacactgtgggaggggaatcctggacgcttttggaacaccactattgcagtgtctatggctaatatattccggggcagctatctagccggtgccgggctgctcttttccatcatgaagaacacgacaaatacccgaagaggaactggcaacattggtgagacccttggcgaaaaatggaagtcaaggctgaatgcgttggggaaatctgagttccagatctacaagaaaagtggaattcaggaagtcgatcgcacactggctaaggagggcatcaaacggggggagactgaccaccatgcagtgtcgagaggaagcgccaagctccgttggtttgtcgaaaggaacatggtgacccccgagggcaaggttgtggatctgggttgcgggcggggaggctggtcctattactgtggtggcttaaaagacgtacgcgaagtgaaggggcttacaaaaggaggccctgggcacgaggaaccaatacccatgtctacgtatggatggaacctggtccgactccaatcaggcgttgatgtgttcttcacccctccagagaagtgcgacactctactgtgtgatatcggtgagagctcccccaatccgacaattgaagctgggagaaccttgagggtcctgagtctcgtggagaactggcttaataacgacactcagttttgcatcaaagtactgaatccttacatgccatctgtgattgaaaagatggagacattgcagcggaagtacggaggcgccctggttcgcaaccccctcagcagaaattcaacccatgaaatgtattgggtgtccaacgcaacgggcaatatcgtcagtagcgtgaacatgatatctaggatgttaattaatcgattcaccatgaaacacaagaaagccacatacgagcctgacgtcgatctggggtccggaactcggaacatcggtatcgagtcagaaattccaaatcttgacataatcggcaagcgtattgagaaaatcaagcaggaacacgagaccagctggcattatgatcaagaccacccctacaagacatgggcttatcatgggtcgtacgaaactaaacagaccggatctgcgagttccatggtgaacggcgttgtaagactgctaacaaagccgtgggatgtggtccctatggtgacccagatggccatgactgacacgacaccctttggtcagcaacgcgttttcaaagagaaggtggataccaggactcaggagccaaaagaagggaccaagaagctcatgaaaattacagcagagtggctgtggaaggaattgggaaaaaagaaaacgcctcggatgtgtaccagagaggagtttactcgcaaggtcaggagcaatgctgccctgggcgcaatcttcacagacgaaaacaaatggaagtcagcccgagaggctgtggaagattcccggttttgggagctcgtagacaaggaaagaaaccttcacctggagggcaaatgcgagacctgtgtgtataatatgatggggaagagggaaaaaaagttaggagagttcggtaaagccaagggctctcgcgcgatatggtacatgtggctgggggcacgttttttggaattcgaggccctcggatttctgaacgaagatcactggttcagccgggagaatagtctatccggcgttgagggtgaagggcttcataagctgggatacatcctcagagacgtcagcaaaaaggagggcggcgctatgtatgccgacgatactgcagggtgggacacaaggattaccctggaagatttgaaaaacgaggaaatggtgacaaatcacatggagggagagcataagaaactggctgaagccatctttaagctcacttaccagaacaaggtggtccgcgttcagcgacccaccccacggggtacggtgatggacattatctctagaagggatcaacgcggctcagggcaggtaggaacctatggccttaatacattcactaacatggaggctcagctgattagacaaatggaaggtgagggggtgttcaaaagtatacagcacttaaccgtcacagaggaaatcgccgtgcagaattggctggcacgggttggaagggagcgtttgtcccgaatggcgattagcggcgacgattgcgtggtcaagcccctcgacgatcgctttgcctctgctctgactgccctaaacgacatgggcaaagtgagaaaggatatccagcaatgggaaccttcgcgggggtggaatgactggacccaggtaccattctgctcacatcactttcacgagcttatcatgaaagatggaagggttctggtggtcccgtgtcgcaaccaggacgaactcattggtagagcacggataagccagggcgctgggtggtccctgaaggagacggcctgcttgggaaagagttacgcacaaatgtggtctttaatgtatttccataggcgagacctgcgtctcgccgcgaatgctatctgtagcgccgtgccctcccactgggtgcctacatcaagaaccacttggagtattcatgcaaaacacgagtggatgacaaccgaagatatgcttactgtctggaaccgcgtttggatccaggagaatccatggatggaagacaagacccccgtggagtcttgggaagaggtaccttacctgggcaaacgggaggatcagtggtgcggtagcctaattgggctgacatccagggccacgtgggctaagaacatccagaccgccataaaccaagtgagatcactcatcggaaatgaagagtatactgactacatgccaagcatgaaacgctttcggagggaagaggaagaggcaggcgtcttgtggtga

SEQ ID NO: 14919 - RNA, 9876 nt, synthetic construct
  misc_feature 1..9876: note = derived and/or modified CDS sequence (opt3) from DENV-2__FM210233__SS-prME
  source 1..9876: mol_type = other RNA
agcgcaggaatgatcattatgctgataccaaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacacgatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatatacgggggatcatgcaagccggaaaacgctcgctcagacctcagccaaccgagctgaagtacagctggaagacatggggcaaagctaagatgctttccacggaatcatataaccagaccttcttgattgacgggccggagactgccgagtgccccaatacaaacagggcatggaatagtctggaagtggaggattacggatttggcgtgttcaccacaaacatctggctcaaactgaaggaaaaacaggacgcgttttgtgactctaagttaatgagcgctgccattaaggataatcgtgcagtacatgccgacatgggttattggatggagtccgctctgaacgatacttggaaaatcgagaaggcctcattcatagaagtcaaaaattgccactggcctaagagccataccctttggtctaacggggtgttggagtccgaaatgattatccccaagaacctcgcaggacccgttagtcaacacaattaccggcctggctaccacacgcagatcgctggtccatggcatctgggcaagctagagatggacttcgatttttgtgacgggacaaccgtgattgtcactgaagattgcggaaaccgaggccccagcctgagaaccacaactgcctctgggaagctcatcaccgagtggtgctgtaggtcctgcacactgccgcctcttcgctatcggggagaggacggctgttggtacggtatggaaattagaccattgaaagagaaggaagagaatctggtgaactcattagttacggcggggcacggacaggtggataatttcagtctcggcgtactgggtatggccctttttctggaagagatgttgaggacccgcgtcggcactaaacatgctatactcctggtggcagtgagcttcgtcacactaatcaccgggaacatgtcgtttaaggacctgggacgagttgtggtaatggtgggcgccactatggctgatgacattgggatgggagtcacatatctcgccctgcttgcagcgttcaaagtgcggcccacctttgccgctggcttgctgttacgtaagctcacgtccaaggagctgatgatgactaccatcggtattgttcttctgtctcaaagcacaatccctgaaaccgtgctagagctcactgatgccctggcattggggatgatggtcctgaaaatagtgagaaatatggaaaagtaccagttagctgttacaatcatggccattctctgcgtgcccaacgcagtcatcctgcagaatgcctggaaagtatcatgtaccattcttgctgtggttagtgtgtccccactgttgctcacatctagccagcaaaagactgactggatccctctggcgctaaccataaaaggactgaaccccacggccattttccttacaaccctctccaggactaataagaaacgctcatggccactgaacgaggcaatcatggctgtcggcatggtgagcatcttggccagttctctgttaaagaatgacattccgatgaccggccctctcgtagccgggggactgcttacagtgtgctatgtcctgactggtcggtccgctgatttggaactcgagagagcaaccgacgttaagtgggaggatcaggccgaaataagcggctcgtcacccatcctgtctattacgatcagtgaggacgggtccatgagcattaaaaacgaagaggaggaacagacactaaccatcctgataaggactggacttctcgtgatctctggcctgtttccaattagcatccccattacagcggctgcctggtacttgtgggaggtgaagaaacagcgagccggtgtcttatgggatgtgccttccccaccccctatggggaaggccgaactggaggacggagcttatcgcatcaaacaaaagggcatactcggctactcacagattggggcaggagtttacaaggaaggtaccttccacactatgtggcatgtaacacggggcgccgtgctgatgcacaaagggaagagaatcgagccgagttgggcggatgtcaaaaaggaccttatcagctatggaggcggttggaaactggagggggaatggaaggagggagaagaggtgcaggttttggctctagaaccaggcaagaatcccagggccgtgcagaccaaacctggcctgtttaagacgaacactgggaccattggagcagtctctctcgatttctccccaggtacatcaggcagtcccatcatagacaaaaaggggaaagtggtaggactgtacggcaacggtgtcgtgacccgtagcggggcctatgtttccgctattgcccaaacagagaagtctatcgaggataatcctgaaattgaggacgatatctttcgcaagcggagacttactataatggacttacacccgggagcaggcaaaaccaagaggtacctgcccgctattgtgcgagaagccatcaaacggggcctccgcacgttgatcctggcgccaacaagagtcgtggccgcagagatggaagaggctctcagggggctgcctattcggtatcagactcccgccatccgagctgagcataccggaagagaaattgttgaccttatgtgtcacgcaacattcaccatgcgcctgttgtcgccagtgagggtccctaactacaatctaataatcatggatgaggcccatttcactgaccccgccagcattgctgcgcgtggttatatctcaacccgggtggaaatgggcgaggcagccgggatctttatgacagctacgccaccgggatccagagatcctttcccccagagtaacgccccaattatagacgaggaaagggagatccccgaacgctcttggaatagcggccacgagtgggtaactgattttaagggtaaaaccgtgtggttcgttccttccattaaggcagggaacgacatcgccgcttgcctgcgaaagaatggcaaaaaggtcattcaactctcaagaaaaacatttgattctgaatacgtgaagacccggactaacgactgggatttcgtggtcacaaccgacatcagcgagatgggcgcgaattttaaagccgagagggtaatagatccacgccgttgtatgaagcccgtgatcttaacggacggcgaagagagagttattctggcagggcctatgccggtgactcatagttccgctgcccagcggaggggacgcatcggtcgaaaccccaaaaatgaaaacgaccagtacatttatatgggcgagccccttgaaaatgatgaggactgcgcacactggaaggaggccaagatgctgctcgataacatcaatacacctgaagggataattcccagcatgttcgagccagaaagagagaaagtcgacgctatcgatggagaataccggttgaggggcgaggcccgcaagacctttgtggacctgatgagaaggggtgatctccctgtttggctggcgtataaagtggcagccgaggggattaactacgctgaccggcgttggtgtttcgatggcatcaagaacaatcagatacttgaagagaacgtcgaagtggagatctggaccaaagagggagaacgcaagaagctaaaaccccgatggctggacgccagaatttattctgatccattggctttaaaggagtttaaagagttcgcagccggcaggaagtcactgactctcaatctgatcacagagatggggcggcttcctaccttcatgacacagaaaactcgcgacgctctggataacctcgccgtattgcacacggcagaagcgggaggtagagcctacaatcatgctctgtccgagctaccggagaccctggaaacactccttctgttaactttgctggccaccgtgacaggcgggatttttctcttcctgatgagtggaaggggcatcggtaagatgacccttgggatgtgctgcataattactgcaagcatcctgctctggtatgctcagatccagccccactggattgccgcatcgatcatattggagtttttcctgattgttttactaatcccagaacctgagaagcagcggacgccccaagacaaccagctgacctacgtcgtgattgccatcctcacagtggtcgctgcgactatggccaatgaaatgggctttcttgagaaaaccaagcgagacctgggattgggctctatagcaacacagcagccagagtccaacatcctggatattgacctcagacctgctagcgcctggaccctgtacgccgttgcaactacattcgtgacgcccatgcttcgccattcaatcgaaaatagttctgtaaacgtgtccctcaccgctattgccaatcaagcgactgtcctgatggggttgggaaaaggttggccgctgagcaagatggatatcggcgtgccattactagctattgggtgttattcacaggttaaccctatcacactgaccgccgcactccttctgttggtggcccactacgctataattggacccggcctgcaggcaaaagccaccagggaggcgcagaagcgggctgccgcaggtatcatgaagaatccaacagtcgacgggatcactgtaattgatctcgaccccataccttatgatccgaaatttgaaaagcaactgggccaggtgatgcttttaatcctgtgcgttacacaggtgctcatgatgcgtaccacatgggccttgtgtgaggctctgactctagccaccggacccattagtacactgtgggaaggcaacccagggagattctggaataccactatcgcagtcagcatggctaacatttttaggggatcctacctcgccggcgcgggtcttctgttctctatcatgaaaaatacgacaaacacccgccgggggactggaaacataggcgagaccttgggtgagaagtggaaaagccgactgaatgccctcggcaagtccgaatttcaaatctataaaaagtcagggattcaggaggtggacagaacactggcaaaggaaggaatcaaaaggggcgagactgatcaccatgctgtctctcgcgggagtgccaagttacggtggttcgtggagagaaacatggttacccctgaaggaaaagtggtagaccttggctgcggtcgtgggggatggtcgtactattgtggcggtctgaagaatgtgagggaggtcaaaggcctcacaaaagggggacccggccacgaagaacctattccaatgagcacgtacgggtggaacctagttcggctgcagtccggagtggatgtctttttcatcccacctgaaaagtgcgacaccttgctgtgtgatataggcgagtcttcaccaaatcccactgtggaggcaggtcgcacactccgagtacttaacctggtggaaaattggttgaacaataacacccagttctgcattaaagttctgaatccgtacatgcctagcgtgatcgagaagatggaagctctccaaagaaaatatgggggagccttagtcaggaacccactgtcccggaatagtactcatgagatgtactgggtgtctaacgccagcggcaatatcgtctcatccgtgaacatgattagtcgcatgcttataaacagatttacaatgaggcacaagaaagcgacctatgaacccgacgttgacctgggcagcgggacgcgaaatatcggaattgagtctgagatccctaacctagatattatcggtaagcggatagaaaagatcaaacaggagcatgaaacctcctggcactacgaccaggatcacccatataagacatgggcttaccatggctcatatgagactaaacagaccgggagcgcatcgtctatggtaaatggagtggtccgtctcctgacaaagccctgggacgtgttgccgactgttacccaaatggccatgacagataccactcctttcggccagcagagagtgtttaaagaaaaggtcgacacgcgcacacaggagcccaaggagggtaccaaaaagctgatgaaaattactgctgaatggctctggaaggagcttgggaaaaagaaaaccccaaggatgtgtacacgggaagagttcacgagaaaggtgcgcagtaacgccgcactgggagccatctttaccgatgagaataagtggaaatccgctagggaagcggtagaggacagccgattctgggaattagtggataaggagcggaacctgcacttggaaggcaaatgcgagacttgtgtttacaatatgatgggcaagagagagaaaaagctcggggaatttggaaaggccaaaggttcaagggcaatttggtacatgtggctgggcgctcgcttcctagagtttgaagcccttgggttcctgaacgaggaccattggttttcccgtgaaaattctctcagcggagtcgagggcgagggtctgcacaagttggggtatatcctgcgggatgtgagtaaaaaggaaggaggcgcaatgtacgccgacgacacagctggctgggataccagaattactctcgaggaccttaaaaacgaagagatggtgacaaatcacatggaaggggagcataagaagctggccgaggcgatattcaaattaacctatcaaaacaaggtcgttagggtgcagcgccctacaccccgaggaactgtaatggatatcatttcccggagagaccagaggggtagcggccaagtggggacctacggactgaatacgtttaccaacatggaagcacagttgatccgccagatggagggcgaaggtgtcttcaaaaatatccagcacctcacagtgactgaggaggttgccgtgcataactggctggctagagtcgggcgggaaaggctatctcgtatggccatttcaggagatgactgcgtggtaaagccacttgatgaccgattcgcaaacgctctgaccgccctcaatgatatgggcaaaatacgcaaggacatccaacagtgggagcccagtaagggctggaacgattggacacaggttcctttttgctcccaccatttccacgaactgattatgaaagacgggagagtgttggtcgtgccatgtcggaatcaggatgagttaatcggaagggctcgcattagccaaggtgccggctggtctctgagagaaactgcatgcctcgggaagtcgtatgcgcagatgtggtcacttatgtactttcaccggagggacctgcgactagccgctaacgccatctgtagcgcagtgccgtcccattgggtccccaccagtcgtacgacatggtctatacacgctaaacatgagtggatgaccactgaggacatgctgacagtttggaatagagtgtggatccgcgaaaacccttggatggaggataagaccccagtagaaagctgggaggaaattccctatctcggaaaacgggaggaccagtggtgcggctccttgatcggtctgacttcaagggccacctgggcaaagaatattcaggccgcgatcaaccaagtgagaagtcttatagggaatgaggaatacacagattacatgccttctatgaagcgcttccggagggaggaagaggaagctggagtcctgtggtga

SEQ ID NO: 14920 - RNA, 9876 nt, synthetic construct
  misc_feature 1..9876: note = derived and/or modified CDS sequence (opt3) from DENV-2__FM210241__SS-prME
  source 1..9876: mol_type = other RNA
accgccggagtgatcattatgctgatacccacggctatggcattccacctcactacgaggaacggggagcctcatatgatcgtcgggaggcaggaaaagggtaaaagccttctgtttaagaccgaggacggagttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagacccggacagaaacttggatgagtagcgagggagcttggaaacacgcccagaggatcgagacctggatactgcggcatcctggcttcacaatcatggcagccattttggcttacaccatcggcacgactcactttcagcgcgcactcattttcatcctgctgacagccgtggctccatccatgaccatgagatgcatagggatttctaacagggattttgttgaaggagtgtcgggtggctcatgggtcgacatcgtgctcgagcacgggagctgtgtaactacaatggccaagaataagcccaccttagatttcgaactgattaaaacggaggcgaagcagcctgcaacccttcggaaatattgcatcgaagccaagttgacaaacactaccacagagagtcgctgtccaactcaaggagagccctccctgaatgaagaacaggacaaacgatttgtttgcaagcattctatggtggatagaggctggggtaacgggtgtggactattcggcaagggcgggatcgtcacatgcgctatgtttacatgcaaaaagaatatggaaggaaaaattgtgcagcctgagaacctcgaatacaccatagtgatcactccacacagcggtgaggagcatgccgtcggcaatgacacggggaagcacggaaaagaaattaagatcacaccgcagtcctcaataaccgaggcagaactgactggctatggtaccgttacaatggagtgtagtcccaggaccgggcttgatttcaacgaaatggtgctgttgcaaatggaggacaaggcttggctcgtacaccggcagtggtttctggatttacctctgccatggctccccggcgccgacactcagggaagcaattggattcagaaggagacacttgtgacgttcaagaaccctcatgcgaaaaagcaagacgtcgtggttctgggctctcaggaaggggccatgcacaccgcattgactggagctacagagatccagatgtcctcaggtaatctactgtttaccggccatctcaaatgccgtctgcgcatggataaacttcaactgaaagggatgagctacagtatgtgtacaggaaagttcaagatcgtgaaagaaattgccgagactcagcacggcaccatcgtcattagagtgcagtatgagggtgacgggtctccatgcaagatacccttcgaaatcatggatttggagaaaaggcatgtactcggccggctgattacggttaacccgatcgtgaccgaaaaggactcccctgtcaacatcgaggctgaacccccatttggagatagctacattataatcggcgtggagcctgggcagttaaaactgaattggttcaagaagggatcgtctattggtcaaatgtttgagacaactatgcgaggcgccaaacgcatggcaatcctaggggacaccgcctgggatttcggatccctcggcggtgtctttacatcaattgggaaggctctgcaccaggtgttcggcgcgatctacggagcagcctttagtggcgttagctggactatgaaaatacttatcggggctattatcacctggattggaatgaactccagatctacgagcttgtcagtgagtctggtactcgtcggcgtgatcacactgtatcttggtgccatggttcaggcagactccgggtgtgtggtcagctggaagaataaagaactgaagtgcggatctggcatattcattaccgataacgtgcacacttggacagagcagtacaagtttcaacccgaatcaccaagtaaattggccagcgctatccagaaggcccatgaggaaggtatttgtggcatcaggtccgtaacccggctcgagaatctgatgtggaaacagataactcccgagttaaaccacatcctgtctgaaaatgaggtgaagctaaccattatgacaggggacatcaaaggaattatgcaggcaggcaagcgctcgctcagacctcaaccaacggaactgaaatatagctggaagacctgggggaaggcgaaaatgctttccactgagtcacataaccagacattcttgatcgatggaccggaaaccgctgagtgccccaatacaaacagggcctggaatagtctggaggttgaagactacggctttggtgtcttcactaccaacatatggctcaagctgcgtgagaaacaggacgtgttttgtgattctaagttaatgagcgcagccattaaagacaatcgggctgtgcacgccgatatggggtattggatcgaatccgcactgaacgacacgtggaagatggagaaggcttcattcatcgaggtcaaaagctgccactggcctaagtctcatacactttggtccaatggagttttggaaagtgagatgattatcccaaagagcttcgccggccccgtgtctcagcacaactaccgacctggttattacacccaaactgcgggcccatggcatctcgggaagctggaaatggattttgacttctgtgagggaaccacagtggtagtcactgaagattgcggcaacagagggccctccctaaggaccacaacggcctcaggaaaactgattaccgagtggtgctgtcgcagttgcactctcccgcctctgcggtacagaggcgaggacggttgttggtatgggatggaaataaggccacttaaggagaaggaagagaatttggtgaacagcctggttacagctggacacggccagatcgataatttttcgttaggtgtgctcggcatggcactgttccttgaagagatgctgcgcacccgagtcgggactaaacatgccattttgctcgtggctgtttcctttgtgacactgatcaccggaaacatgtctttccgggacctaggccgtgtaatggtcatggtgggggccacgatgactgatgacattggaatgggcgtgacctacctggcactcctggcggcctttaaggtcagacccacattcgctgccggtcttttgctgaggaaattaaccagcaaggagctcatgatggcaactatcgggatagctctgctttcacagagtacaatccctgaaaccattctggagctaacagatgccctcgcactgggaatgatggttttgaaaatcgtgcgcaatatggaaaagtatcaactggccgtaactattatggctatctcctgcgtgcccaacgcggtcatattacagaatgcctggaaggtgtcttgtaccattctcgcagctgttagcgtgtccccactgcttctgacgtcaagccagcagaaagccgactggatccctttggccctcacaatcaagggcctgaaccccaccgctatttttctaactaccctgagtcggacatctaaaaagagatcctggccacttaatgaggcaataatggccgtcggcatggtgagcatcctcgcgtcgtcactgttgaaaaacgacattccgatgactgggcctctggttgctggaggtttactcaccgtgtgctacgtcctgacgggcaggtctgccgatcttgaactggagcgagcaacagacgtaaagtgggaggatcaagccgaaatcagtgggtccagccccattttgtctatcaccataagcgaggacggatccatgtcaatcaaaaatgaagaggaggaacagactctcacaattctgatccgcaccggcctactggtgattagtggtcttttcccagttagcatccccataactgctgcagcctggtatctctgggaggtgaagaagcagcgggcgggggtcctgtgggatgtgccttctccaccccctgtaggaaaagctgaattggaggacggcgcctacagaattaagcagaaaggcatcttagggtattcccaaatcggagctggtgtgtacaaggaaggcacatttcacaccatgtggcacgtcacgagaggggcagttctgatgcatcgtggaaaacgcattgagccgtcatgggcagatgtgaagaaggacctcatcagttacggcggtgggtggaaactggagggagaatggaaggagggcgaagaggtgcaggtccttgccctggaaccaggcaaaaacccccgggcagtgcagactaagcctgggttgttcaaaaccaatacaggaaccataggtgctgttagcctagatttttccccaggcacatctgggtcgcccattgtagacagaaagggaaaggtggtcggcctgtatggtaacggggtggttactaggagcggagcctacgtgtcagcgatcgcccagaccgagaaatccattgaggataatcctgaaatcgaggacgatatattccgaaagaaacggctcacgattatggacctgcacccgggcgcaggcaagacaaaacgctatcttcccgctatcgtcagagaagccatcaagagggggttacggactctgattctcgctccaacccgagtggtagcagccgagatggaagaggccttgagaggactgcctatccgctaccaaacacccgctattagggcggagcataccggtcgtgaaatagtcgacctcatgtgtcacgcaactttcaccatgcggctgcttagtccagtgagagttcctaactataacctgatcattatggatgaggcccattttacagaccccgcttctatcgccgcaaggggctacatcagcacgcgcgtggaaatgggggaggccgctggaattttcatgactgcgaccccaccgggctcccgagatccttttccccagtcaaatgccccaataatcgacgaggaaagagagattcccgaacggtcttggaacagcggtcacgagtgggtcacagatttcaaggggaaaaccgtgtggtttgttcctagtatcaaggcaggaaatgacattgctgcctgcttgaggaaaaacggcaagaaagtgatccagctatcccgcaagactttcgatagcgaatatgtcaagacacgtaccaatgactgggattttgtggtaacgactgacatatctgagatgggcgcaaacttcaaagccgagagagtgatcgatccacggaggtgtatgaagcccgttattctgacagacggggaagaacgcgtcatcctcgctggacctatgccggtgacccactcatccgccgcgcaacgaagaggtcggattggcaggaatcccaagaacgaaaatgaccagtacatctacatgggggagcccttagaaaacgatgaggactgcgcacattggaaggaggccaaaatgctgcttgataatataaacacccctgaaggaattatccccagtatgtttgagccagaacgcgagaaggtggacgctattgatggcgaatatagactgaggggtgaggcccggaaaactttcgtcgacctcatgcgtcgcggggatttgcctgtatggctggcttaccgagtggcagccgagggcatcaattatgctgacagaaggtggtgttttgatggagttaagaacaatcagatactcgaagagaacgtggaagtcgagatctggacaaaggagggcgaacggaaaaagctgaaaccccgctggcttgacgccagaatttacagcgatccactagcactgaaggagttcaaagagttcgcggccgggaggaagtcgttgaccttaaacctgatcacagagatgggacggctccctacttttatgacgcagaaggctcgagacgccctggataatcttgcagtgctgcacaccgctgaagccggtggcagagcatataaccatgccctctctgagttgccggagacactggaaactctactgctccttaccctgttagctacagttaccgggggaattttcttgtttctgatgtccggcaaaggtgtggggaagatgactctcggcatgtgctgcatcataacggcgagcattctgctttggtacgcccaaatccagccccactggatcgcagcttcaattatcctggagttctttctcatagtcttgctgattccagaacctgagaaacagcgcaccccacaggacaatcaattaacatatgtggtaatcgccattctaactgtggttgccgcaaccatggctaacgaaatgggattcctggagaagaccaagaaagacctcggccttgggagtatcgccacccaggagccagaatctaatatactggatatcgacttgaggcctgcgtccgcttggactctgtacgccgtcgcaacaacgtttgtgacccccatgctccggcacagcattgagaactcaagtgtgaatgtcagcctgactgccatcgctaaccaggcaacagttcttatgggactcggtaagggctggccgctgtccaaaatggatattggggtgccattgctggccatcggatgttactctcaggtaaatcctattaccttaaccgcggctctactgagcctcatcgcccattatgcaataattggccccggtcttcaagccaaggctacacgtgaagcccagaaaagagcagctgccgggatcatgaagaacccaactgtggacggcatcacggtcattgatctggaccccataccttacgatccgaaattcgagaagcagttgggacaggtgatgctgctcatcctgtgcgttacccaagtgcttatgatgaggacaacttgggcgttatgtgaagccctgaccctcgcaacaggccccatttccaccttgtgggaggggaatccaggacgcttttggaacactacgatcgctgtctcaatggccaatattttccggggctcttatctggccggtgctgggctactgtttagtatcatgaagaacacaaccaatactcgaagaggaaccggcaacataggtgagacactcggcgaaaaatggaagtcgaggcttaatgccctggggaaaagcgagttccagatctacaagaaatccggcattcaggaagtagaccgcactttggccaaggagggcatcaaaagaggggaaaccgatcaccatgcggtgtctagaggatcagctaagctgcgttggtttgttgaaaggaacatggtgacacctgagggcaaggtcgtggacctcggttgcgggcggggaggctggagctattactgtggtggcctgaaaaacgtccgcgaagtgaaggggttaacgaaaggaggccccgggcacgaggaacctattccaatgtccacctatggatggaatcttgttcgactgcaaagtggcgtggatgtattcttcactccccctgagaagtgcgacacactcctatgtgatatcggtgagtctagcccaaaccccaccatagaagcagggagaactctgagggtgttgtcactggtcgagaattggctcaacaatgacacacagttttgcattaaagttcttaacccgtacatgccttccgtgatcgaaaagatggagaccctgcagcggaagtacggaggcgccttggtccgcaatccactgagtagaaacagcacgcatgaaatgtattgggtgtctaatgctaccggcaacatcgtatcctcagtgaatatgattagcaggatgctcataaaccgattcacaatgaaacacaagaaagccacttacgagcccgacgttgatttagggtcgggaacccggaatatcggtattgagtctgaaatccctaacctggacattatcggcaagcgtatagagaaaatcaagcaggaacacgagacaagttggcattatgatcaagaccacccatacaagacttgggcatatcatgggtcctacgaaaccaaacagacaggaagcgcctcatccatggtgaatggcgtcgtgagacttctgaccaagccctgggatgtcgtgccgatggttactcagatggctatgacggacacaaccccttttggtcagcaacgcgtattcaaagagaaggtggatactaggacccaggagcccaaagaagggacaaagaagctaatgaaaattacggcggagtggctctggaaggaactgggcaaaaagaaaaccccacggatgtgtactagagaggagtttacacgcaaggtcaggtctaacgccgcattgggcgctatcttcaccgacgaaaacaaatggaaaagcgcccgagaggcagtggaagatagtcggttttgggagctggttgacaaggaaagaaatctccaccttgagggcaaatgcgagacttgtgtgtataacatgatggggaagagggagaaaaagctgggagagttcggtaaagccaagggctcccgcgctatttggtacatgtggttaggggcccgttttctggagttcgaggcgttgggatttctcaatgaagatcactggttcagccgggagaactctctgtcaggcgtcgagggtgaagggctacataaacttggatacatcctgagagacgtgagtaaaaaggagggcggcgcaatgtatgccgacgatacagctgggtgggacaccaggattacactcgaagatctgaaaaatgaggaaatggtaactaaccacatggagggagagcataagcgcttggccgaagcaatatttaaactgacctaccagaataaggtggttcgagtccagcggcctacgcccagaggtaccgtgatggacatcatttccaggcgcgatcaaagaggcagcggacaggtgggaacatatggcctcaacactttcaccaatatggaggctcagttcatccggcaaatggaaggtgaggggatctttaagtctattcagcaccttacagtcactgaggaaatagccgttcagaactggctggctagggtgggacgtgagcgattatcgcgcatggccatctcaggcgacgattgcgtagtgaaaccactggacgatagattcgcaagcgcgttgaccgccctcaatgacatgggcaaggtccggaaagatattcagcaatgggaaccctccaaggggtggaacgactggacacaggtgcctttttgcagtcatcacttccacgagctgatcatgaaagatggaagggttctagtggtcccatgtcgcaatcaggacgaacttattggtagagctcggatctctcagggcgccgggtggagcctgaaggagacagcatgcctcggaaagtcctacgctcaaatgtggtcactgatgtattttcataggcgagacttgcgtttagccgcaaacgccatatgtagtgcggtgccgtctcactgggtacccaccagcagaactacatggtccatccatgctaaacacgagtggatgaccactgaagatatgctgaccgtttggaatcgcgtgtggattcaggagaacccttggatggaagacaagacaccagtcgagtcatgggaagaggtgccctacctcggcaaacgggaggatcagtggtgcggtagccttatcgggctgacgtctagggccacctgggcaaagaacattcagactgccatcaatcaagtgagatccctaataggaaacgaagagtatacagactacatgcctagtatgaaacgcttccggagggaagaggaagaggctggcgtcctgtggtga

SEQ ID NO: 14921 - RNA, 9876 nt, synthetic construct
  misc_feature 1..9876: note = derived and/or modified CDS sequence (opt3) from DENV-2__FM210242__SS-prME
  source 1..9876: mol_type = other RNA
agcgcaggaatgatcattatgctgatccccaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacactatcacttacaaatgcccactgctcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactgccgagtgccccaatacaaacagagcatggaatagtctggaagtggaggattacggatttggcgtgttcaccacaaacatctggctcaagctgaaagaaaagcaggacgcgttttgtgactctaagttaatgagcgctgccattaaagataatagggcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaaactcattaccgagtggtgctgtagatcctgcacactgccgcctcttaggtatcgcggagaggacggctgttggtacggtatggaaatacggccattgaaggagaaagaagagaatctggtgaactcattagttacggcggggcacggacaggtggataatttcagtctcggcgtactgggtatggccctttttctggaagagatgttgagaaccagggtcggcactaagcatgctatcctcctggtggcagtgagcttcgtcacactaattaccgggaacatgtcgtttaaagacctgggacgcgttgtggtaatggtgggcgccactatggctgatgacatcgggatgggagtcacatatctcgccctgcttgcagcgttcaaggtgcgacccacctttgccgctggcttgctgttacggaagctcacgtccaaagagctgatgatgactaccattggtatcgttcttctgtctcaaagcacaatacctgaaaccgtgctagagctcactgatgccctggcattggggatgatggtcctgaagatcgtgcgtaatatggaaaaataccagttagctgttacaattatggccatcctctgcgtgcccaacgcagtcgtactgcagaatgcctggaaggtgtcatgtaccattcttgctgttgtgagtgtctccccactgttgctcacatctagccagcagaagactgactggatccctctggcgctaaccataaagggactgaaccccacggccattttccttacaaccctctccagaactaataaaaagaggtcatggccactgaacgaggcaatcatggctgtgggcatggtaagcatcttggccagttctctgttaaagaatgacattccgatgaccggccctctcgtggccgggggactgcttacagtctgctatgttctgactggtcgctccgctgatttggaactcgagcgggcaaccgacgtgaaatgggaggatcaggccgaaataagcggctcgtcacccatcctgtctattacgatcagtgaggacgggtccatgagcattaagaacgaagaggaggaacagacactaaccatcctgataagaactggacttctcgtgatctctggcctgtttccaattagcatccccattacagcggctgcctggtacttgtgggaggtcaaaaagcagagggccggtgtgttatgggatgttccttccccaccccctatggggaaagccgaactggaggacggagcttatcgaatcaagcaaaagggcatactcggctactcacagattggggcaggagtatacaaagaaggtaccttccacactatgtggcatgtgacacgcggcgccgtcctgatgcacaaggggaaacggatcgagccgagttgggcggatgtgaagaaagaccttatcagctatggaggcggttggaagctggagggggaatggaaggagggagaagaggttcaggtgttggctctagaaccaggcaaaaatcccagagccgtccagaccaagcctggcctgtttaaaacgaacactgggaccattggagcagtgtctctcgatttctccccaggtacatcaggcagtcccatcatagacaagaaagggaaggtagtcggactgtacggcaacggtgtggttaccaggagcggggcctatgtgtccgctattgcccaaacagagaagtctatcgaggataatcctgaaattgaggacgatatctttcgtaaacgccggcttactataatggacttacacccgggagcaggcaagaccaaaagatacctgcccgctattgtcagggaagccatcaagcgaggcctccggacgttgatcctggcgccaacacgcgtggttgccgcagagatggaagaggctctcagagggctgcctattaggtatcagactcccgccatcaaagctgagcataccggacgggaaattgtggaccttatgtgtcacgcaacattcaccatgcgactgttgtcgccagtcagagtgcctaactacaatctaataatcatggatgaggcccatttcactgaccccgccagcattgctgcgcgcggttatatctcaaccagggtagaaatgggcgaggcagccgggatctttatgacagctacgccaccgggatcccgtgatcctttcccccagagtaacgccccaattatagacgaggaacgggagatccccgaaagatcttggaatagcggccacgagtgggtgactgattttaagggtaagaccgtttggttcgtcccttccattaaagcagggaacgacatcgccgcttgcctgaggaagaatggcaagaaggtgattcaactctcacgcaaaacatttgattctgaatacgtgaagacccgaactaacgactgggatttcgtcgtaacaaccgacatcagcgagatgggcgcgaattttaaagccgagagagtgatagatccacggaggtgtatgaagcccgttatcttaacggacggcgaagaacgcgtgattctggcagggcctatgccggtcactcatagttccgctgcccagcgtagaggacggatcggtaggaacccaaagaatgaaaacgaccagtacatttatatgggcgagccccttgaaaatgatgaggactgcgcacactggaaagaggccaagatgctgctcgataacatcaatacacctgaagggataattcccagcatgttcgagccagaacgcgagaaagtggacgctatcgatggagaataccgattgagaggcgaggcccggaagacctttgttgacctgatgaggcgcggtgatctccctgtgtggctggcgtataaagtcgcagccgaggggattaactacgctgacagaaggtggtgtttcgatggcatcaagaacaatcagatacttgaagagaacgtggaagtagagatctggaccaaggagggagaacggaaaaagctaaaaccccgttggctggacgcccgcatttattctgatccattggctttaaaggagtttaaagagttcgcagccggccgaaagtcactgactctcaatctgatcacagagatggggagacttcctaccttcatgacacaaaagactagggacgctctggataacctcgccgtgttgcacacggcagaagcgggaggtcgggcctacaatcatgctctgtccgagctaccggagaccctggaaacactccttctgttaactttgctggccaccgttacaggcgggatttttctcttcctgatgagtggacgcggcatcggtaaaatgacccttgggatgtgctgcataattactgcaagcatcctgctctggtatgctcagatccagccccactggattgccgcatcgatcatattggagtttttcctgattgtcttactaatcccagaacctgagaagcagagaacgccccaagacaaccagctgacctacgtggtgattgccatcctcacagtcgttgctgcgactatggccaatgaaatgggctttcttgagaaaaccaagaaagacctgggattgggctctatagcaacacagcagccagagtccaacatcctggatattgacctcaggcctgctagcgcctggaccctgtacgccgtggcaactacattcgtaacgcccatgcttcggcattcaatcgaaaatagttctgtgaacgtctccctcaccgctattgccaatcaagcgactgtgctgatggggttgggaaagggttggccgctgagcaagatggatatcggcgttccattactagctattgggtgttattcacaggtgaaccctatcacactgaccgccgcactccttctgttggtcgcccactacgctataattggacccggcctgcaggcaaaagccacccgagaggcgcagaagagagctgccgcaggtatcatgaaaaatccaacagtagacgggatcactgtgattgatctcgaccccataccttatgatccgaagtttgaaaaacaactgggccaggttatgcttttaatcctgtgcgtgacgcaggtcctcatgatgcgcaccacatgggccttgtgtgaggctctgactctagccaccggacccattagtacactgtgggaaggcaacccagggaggttctggaataccactatcgcagtgagcatggctaacatttttcggggatcctacctcgccggcgcgggtcttctgttctctatcatgaagaatacgacaaacacccgtagagggactggaaacataggcgagaccttgggtgagaaatggaaaagcaggctgaatgccctcggcaagtccgaatttcaaatctataaaaagtcagggattcaggaggtcgaccgcacactggcaaaagaaggaatcaagcggggcgagactgatcaccatgctgtgtctcgagggagtgccaaattaagatggttcgttgagaggaacatggtgacccctgaaggaaaggtagtggaccttggctgcggtcgcgggggatggtcgtactattgtggcggtctaaagagcgtccgggaggttaaaggcctcacaaaagggggacccggccacgaagaacctattccaatgtccacgtacgggtggaatctagtgagactgcagtctggagtcgatgtgtttttcataccccctgaaaaatgcgacaccttgctgtgtgatataggcgagtcaagcccaaaccccactgtagaggcaggtcgtacactcagggtgcttaatctggttgaaaactggttgaataacaatacccagttctgcattaaggtgctgaacccgtacatgccttccgtcatcgagaaaatggaagctctccaacggaagtatgggggagccttagtgcgcaatccactgagtcgaaactctactcatgagatgtactgggtcagcaatgcctcaggcaacatcgtgtccagtgttaatatgattagcagaatgcttataaacaggtttacaatgcggcacaagaaagcgacctatgaacccgacgtagacctgggctctgggacgcgcaacatcggaattgagtccgagatccctaatctagatattatcggtaagagaatagagaagatcaagcaggagcatgaaacctcatggcactacgaccaggatcacccatataaaacatgggcttaccatggcagctatgagactaagcagaccgggtcggcatctagtatggtgaacggagtcgtgaggctcctgacaaagccctgggacgttttgccgactgtgacccaaatggccatgacagataccactcctttcggccagcagcgagtctttaaagaaaaggtggacacgcggacacaggagcccaaagagggtaccaagaaactgatgaagattactgctgaatggctctggaaagagcttgggaagaagaaaaccccacgtatgtgtacaagagaagagttcacgcgcaaggtaaggtccaatgccgcactgggagccatctttaccgatgagaacaaatggaaaagcgctcgggaagcggtggaggactcaagattctgggaattagttgataaagagcgcaatctgcacttggaaggcaagtgcgagacttgtgtctacaacatgatgggcaagagggagaaaaagctcggggaatttggaaaagccaagggttcccgagcaatttggtacatgtggctgggcgctcggttcctagagtttgaagcccttgggttcctgaatgaggaccattggttttctagagaaaacagcctcagtggagtggagggcgagggtctgcacaaattggggtatatcctgagggatgtgtccaagaaggaaggaggcgcaatgtacgccgacgacacagctggctgggatacccgcattactctcgaggaccttaaaaatgaagagatggtcacaaaccacatggaaggggagcataagaaactggccgaggcgatattcaagttaacctatcaaaataaagttgtgcgtgtacagcggcctacacccagaggaactgtgatggatatcattagcaggcgcgaccagcgaggttctggccaagtcgggacctacggactgaacacgtttaccaatatggaagcacagttgatccggcagatggagggcgaaggtgtgttcaagaacatccagcacctcacagttactgaggaggtggccgtccaaaattggctggctagagtggggagggaacgcctatcaagaatggccattagtggagatgactgcgtagttaagccacttgatgaccggttcgcaaacgctctgaccgccctcaacgatatgggcaaaataaggaaggacatccagcagtgggagccctccaaaggctggaatgattggacacaggtgcctttttgcagccatcacttccatgaactgattatgaaggacgggcgtgtcttggtggtgccatgtcgaaaccaagatgagttaatcggacgcgctagaatttctcagggtgccggctggtcgctgcgggaaactgcatgcctcgggaaatcatatgcgcagatgtggagccttatgtactttcacaggcgcgacctgagactagccgctaatgccatctgttccgcagtcccgagtcactgggttcccacctctcggacgacatggagcatacatgctaagcacgagtggatgaccactgaggacatgctgacagtgtggaacagggtatggatccgagaaaatccttggatggaggataagaccccagtggaatcctgggaggaaattccctatctcggaaaacgtgaggaccagtggtgcggctcattgatcggtctgacaagtagagccacctgggcaaagaacattcaagccgcgatcaatcaggtccgctctcttatagggaacgaggaatacacagattacatgcctagcatgaaacggttcaggagagaggaagaggaagctggagtgctgtggtga

SEQ ID NO: 14922 - RNA, 9876 nt, synthetic construct
  misc_feature 1..9876: note = derived and/or modified CDS sequence (opt3) from DENV-2__FM210243__SS-prME
  source 1..9876: mol_type = other RNA
accgccggcgtgatcattatgctgatacccaccgctatggcattccacctcactacgaggaacggggagcctcatatgatcgtcggaaggcaggaaaagggtaaaagccttctgtttaagaccgaggacggcgttaatatgtgcaccttgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagacccggacagaaacttggatgagtagcgagggagcttggaaacacgcccagaggatcgagacctggatactgcggcatcctggcttcacaatcatggcagccattttggcttacaccgtgggcacgactcactttcagcgcgcactcatcttcattctgctggccgctgttgccccatccatgacaatgagatgcatcgggatatctaacagggattttgtggaaggagtctcgggtggctcatgggtggacattgtactcgagcacgggagctgtgttaccactatggcgaagaataagcccacattagatttcgaactgatcaaaaccgaggcaaagcagcctgccacgcttcggaaatattgcattgaagctaagttgaccaacacaactaccgagagtcgctgtccaacacaaggagagccctccctgaatgaggaacaggacaaacgatttgtgtgcaagcattctatggtcgatagaggctggggtaacgggtgtggactgttcggcaagggcgggatcgtgacttgcgccatgtttacctgcaaaaagaatatggaaggaaaaatcgtgcagcctgagaacctcgaatacacaattgtcataaccccacacagcggtgaggagcatgcagttggcaatgacactgggaagcacggaaaagaaatcaagattacgccgcagtcctcaatcacagaggctgaactgaccggctatggtactgtgaccatggagtgtagtcccaggacagggcttgatttcaacgaaatggtactgttgcaaatggaggacaaagcctggctcgtgcaccggcagtggtttctggatttacctctgccatggctccccggcgcggacacccagggaagcaattggatacagaaggagactcttgtcacattcaagaaccctcatgccaaaaagcaagacgtggttgtgctgggctctcaggaaggggcaatgcacacggctttgaccggagccactgagattcagatgtcctcaggtaatctactgtttacaggccatctcaaatgccgtctgcgcatggataaacttcaactgaaagggatgagctacagtatgtgtaccggaaagttcaagatcgtcaaagaaatcgctgagacacagcacggcactattgtgatcagagtacagtatgagggtgacgggtctccatgcaagattcccttcgaaataatggatttggagaaaaggcatgttctcggccggctgatcaccgtgaacccgattgtcacggaaaaggactcccctgtgaacatcgaggccgaacccccatttggagatagctacatcattataggcgtcgagcctgggcagttaaaactgaattggttcaagaagggatcgtctatcggtcaaatgtttgagaccacaatgcgaggcgcaaaacgcatggccattctaggggacactgcttgggatttcggatccctcggcggtgtgtttacctcaatcgggaaggcgctgcaccaggttttcggcgcaatttacggagccgcttttagtggcgtgagctggacaatgaaaatccttataggggtaatcattacttggatcggaatgaactccagatctaccagcttgtcagtcagtctggtgctcgttggcattatcacgctgtatcttggtgccatggtgcaggcagactccgggtgtgtcgtgagctggaagaataaagaactgaagtgcggatctggcatattcattacagataacgtacacacctggactgagcagtacaagtttcaacccgaatcaccaagtaaattggccagcgctatccagaaggcccatgaggaaggtatttgtggcatcaggtccgtgacacggctcgagaatctgatgtggaaacagataacccccgagttaaaccacatcctgtctgaaaatgaggttaagctaactattatgaccggggacatcaaaggaattatgcaggcaggcaagcgctcgctcagacctcaaccaacagaactgaaatatagctggaagacgtgggggaaggcgaaaatgctttccaccgagtcacataaccagactttcttgatcgatggaccggaaacagctgagtgccccaataccaacagggcctggaatagtctggaggtcgaagactacggctttggtgtgttcacaactaacatatggctcaagctgcgtgagaaacaggacgtgttttgtgattctaagttaatgagcgcagccattaaagacaatcgggctgtccacgccgatatggggtattggatcgaatccgcactgaacgacacctggaagatggagaaggcttcattcatcgaggttaaaagctgccactggcctaagtctcatacgctttggtccaatggagtgttggaaagtgagatgattatcccaaagagcttcgccggccccgtgtctcagcacaactaccgacctggttattacacacaaaccgcgggcccatggcatctcgggaagctggaaatggattttgacttctgtgagggaactaccgtagtcgtgacagaagattgcggcaacagagggccctccctaaggactaccacagcctcaggaaaactgattacggagtggtgctgtcgcagttgcaccctcccgcctctgcggtacagaggcgaggacggttgttggtatgggatggaaataaggccacttaaggagaaggaagagaatttggttaacagcctggtgactgctggacacggccagatcgataatttttcgttaggtgtcctcggcatggcactgttccttgaagagatgctgcgcacacgagtggggaccaaacatgccattttgctcgttactgtgtcctttgtaacactgatcaccggaaacatgtctttccgggacctaggccgtgtcatggtgatggtgggggctgccatgacggatgacattggaatgggcgtcacttacctggcactcctggcggcctttaaggttagacccaccttcgctgccggtcttttgctgaggaaattaacaagcaaggagctcatgatggcaaccatcgggatagctctgctttcacagagtactatccctgaaacaattctggagctaaccgatgccctcgcactgggaatgatggtgttgaaaatcgtacgcaatatggaaaagtatcaactggccgtgacaattatggctatctcctgcgtccccaacgcggtgatattacagaatgcctggaaggtttcttgtactattctcgcagctgtgagcgtctttccactgcttctgacctcctcacagcagaaagccgactggatccctttggccctcacgatcaagggcctgaaccccacagctattttcctaaccactctgagccggaccagtaaaaagagatcttggccacttaatgaggcaataatggccgtgggcatggtttccatcctcgcgagctcgctgttgaaaaacgacattccgatgacagggcctctggtggctggaggtttactcactgtctgctacgtactgaccggcaggtcagccgatcttgaactggagcgagcaacggacgtgaagtgggaggatcaagccgaaatctctgggagttcccccattttgagcatcacaatagctgaggacggatctatgagcatcaaaaatgaagaggaggaacagaccctcactattctgatccgcacaggcctactggttatttccggtctttttccagtgtcaatccccataaccgcagccgcgtggtatctctgggaggtcaagaagcagcgggctggggtgctgtgggatgtacctagtccaccccctgtgggaaaagccgaattggaggacggcgcatacagaattaagcagaaaggcatcttagggtatagccaaatcggagccggtgtctacaaggaaggcactttccacacaatgtggcacgttaccagaggggctgtgctgatgcatcgtggaaaacgcattgagccgtcttgggccgatgtgaagaaggacctcatctcctacggcggtgggtggaaactggagggagaatggaaggagggcgaagaggtccaggtgcttgcactggaaccaggcaaaaacccccgggctgttcagacgaagcctgggttgtttaaaactaataccggaacaataggtgccgtatcactagatttcagtccaggcaccagcgggtcccccattgtggacagaaagggaaaggtcgtgggcctgtatggtaacggggttgtgacaaggtctggagcgtacgtctcggccatcgcacagactgagaaaagcattgaggataatcctgaaatcgaggacgatatattccgaaagaaacggctcaccattatggacctgcacccgggcgctggcaagacgaaacgctatcttcccgccatcgtgagagaagctatcaagagggggttacggacactgattctcgcaccaactcgagtagtcgccgccgagatggaagaggctttgagaggactgcctatccgctaccaaacccccgcgattagggcagagcatacaggtcgtgaaatagtggacctcatgtgtcacgccacctttactatgcggctgctttcaccagttagagtgcctaactataacctgatcattatggatgaggctcatttcaccgaccccgcctccatcgcagccaggggctacatcagtacacgcgtcgaaatgggggaggctgcgggaatttttatgacggccactccaccgggctctcgagatcctttcccccagagcaatgcaccaataatggacgaggaaagagagatccccgaacggtcctggaactcaggtcacgagtgggtgaccgattttaaggggaaaacagtttggttcgtgccttctattaaggctggaaatgacatcgccgcatgcttgaggaaaaacggcaagaaagtcattcagctaagccgcaagacctttgatagtgaatatgtgaagactcgtacaaatgactgggatttcgtagtgaccacggacatctccgagatgggcgccaactttaaagctgagagagttatagatccacggaggtgtatgaagcccgtcatcctgactgacggggaagaacgcgtgattctcgccggacctatgccggtgacacacagctctgcggcacaacgaagaggtcggatcggcaggaatcccaaaaacgaaaatgaccagtacatttacatgggggagcccttagaaaacgatgaggactgcgcccattggaaggaggctaaaatgctgcttgataatatcaacacccctgaaggaataattccctcaatgttcgagccagaacgcgagaaggtcgacgccatcgatggcgaatatagactgaggggtgaggctcggaaaacctttgtagacctcatgcgtcgcggggatttgcctgtgtggctggcataccgagttgccgctgagggcattaattatgccgacagaaggtggtgtttcgatggagtgaagaacaatcagatcctcgaagagaacgtcgaagtggagatatggactaaggagggcgaacggaaaaagctgaaaccccgctggcttgacgcaagaatctactccgatccactagcgctgaaggagttcaaagaatttgccgctgggaggaagagtttgacattaaacctgattaccgagatgggacggctccctacattcatgactcagaaggcccgagacgcactggataatcttgctgttctgcacacggccgaagcaggaggtagagcctataaccatgctctcagcgagttgccggagaccctggaaacactactgctccttactctgttagcgaccgtgacagggggaatctttttgttcctgatgtcgggcaaaggtgtcgggaagatgaccctcggcatgtgctgcattatcactgcctctatactgctttggtacgcacaaattcagccccactggatcgctgcctccatcattctggagtttttcctcatcgtgttgctgataccagaacctgagaaacagcgcacgccccaggacaatcaattaacctatgtagtgattgccatcctaacagttgtcgcagctactatggccaacgaaatgggatttctggagaagaccaaaaaggacctcggccttgggagcattgcgacacaggagccagaatcaaatatcctggatatagacttgaggcctgctagtgcctggaccctgtacgcagtggccactacattcgtgacgcccatgctccggcactctatcgagaactccagcgtcaatgtttcactgaccgctattgcaaaccaggccactgtgcttatgggactcggtaagggctggccgctgagtaaaatggatatcggggtaccattgctggcgattggatgttacagccaggtgaatcctatcacattaaccgctgccctactgctccttgtcgcacattatgccattatcggccccggtctgcaagctaaggccacccgtgaagcacagaaaagagctgccgcggggataatgaagaacccaacagtggacggcattactgttatcgatttggaccccatcccttacgatccgaaatttgagaagcagctgggacaggtgatgctcctgattctttgcgtcacgcaagtattaatgatgaggaccacatgggccctgtgtgaagcactcactttggctaccggccccatatccacactgtgggaggggaatccaggacgcttctggaacaccactatcgccgtgtctatggcaaatatttttcggggcagctatctagctggtgccgggctactcttctccatcatgaagaacacgacaaatacccgaagaggaactggcaacattggtgagacccttggcgaaaaatggaagtcaaggctgaatgccttggggaaatctgagtttcagatctacaagaaaagtggaatacaggaagttgaccgcacactggcgaaggagggcatcaaaagaggggagactgatcaccatgctgtgtcgagaggaagcgcaaagctccgttggttcgtcgaaaggaacatggtgacccctgagggcaaggtcgtggacctgggttgcgggcggggaggctggtcctattactgtggtggccttaaaaacgttcgcgaagtgaaggggctaacaaaaggaggccccgggcacgaggaacctattccaatgtctacgtatggatggaatctggtacgactccaatcaggcgtggatgtcttctttacaccacctgagaagtgcgacactctactgtgtgatatcggtgagagctccccaaaccccacaattgaagccgggagaaccttgagggttctgagtctcgtggagaattggcttaacaatgacactcagttctgcatcaaagtcctgaacccgtacatgccttctgtgatagaaaagatggagacattgcagcggaagtacggaggcgctctggtacgcaatccactcagcagaaactcaacccatgaaatgtattgggtgtccaatgccacgggcaacattgttagtagcgtgaatatgatctctaggatgttaatcaaccgatttaccatgaaacacaagaaagcaacatacgagcccgacgtcgatctggggtccggaactcggaatattggtatagagtcagaaatccctaaccttgacattatcggcaagcgtattgagaaaatcaagcaggaacacgagaccagctggcattatgatcaagaccacccatacaagacatgggcctatcatgggtcgtacgaaactaaacagaccggatctgctagttccatggtgaatggcgtcgtgagactgctaacaaagccctgggatgttgtaccgatggtgacccagatggcgatgactgacacgacacctttcggtcagcaacgcgtctttaaagagaaggtggataccaggactcaggagcccaaagaagggaccaagaagctcatgaaaataacagccgagtggctgtggaaggaattgggcaaaaagaaaacgccacggatgtgtaccagagaggagttcactcgcaaggttaggagcaacgcagctctgggcgccatctttacagacgaaaacaaatggaagtcagcacgagaggccgtggaagattcccggttctgggagctcgtcgacaaggaaagaaatcttcacctggagggcaaatgcgagacctgtgtgtataacatgatggggaagagggagaaaaagttaggagagtttggtaaagctaagggctctcgcgccatttggtacatgtggctgggggcgcgtttcttggaatttgaggcactcggattcctgaatgaagatcactggtttagccgggagaacagtctatccggcgtagagggtgaagggcttcataagctgggatacatcctcagagacgtgagcaaaaaggagggcggcgccatgtatgctgacgatactgccgggtgggacacaaggattaccctggaagatttgaaaaatgaggaaatggttacaaaccacatggagggagagcataagaaactggcagaagctatcttcaagctcacttaccagaataaggtcgtgcgcgtgcagcgacctacaccccggggtacggtcatggacattatatctagaagggatcaacgcggctcagggcaggttggaacctatggccttaacacattcactaatatggaggcccagctgatcagacaaatggaaggtgaggggatttttaaaagtatccagcacttaaccgtgacagaggaaatcgctgtacagaactggctggcccgggtgggaagggagcgtttgtcccgaatggcaattagcggcgacgattgcgtcgtgaagccactcgacgatcgcttcgcgtctgccctgactgctctaaatgacatgggcaaagttagaaaggatatacagcaatgggaaccctcgcgggggtggaacgactggacccaggtgcctttttgctcacatcacttccacgagcttatcatgaaagatggaagggtcctggtggtaccatgtcgcaatcaggacgaactcattggtagagcccggatcagccagggcgcagggtggtccctgaaggagacggcttgcttgggaaagagttacgcccaaatgtggtctttaatgtattttcataggcgagacctgcgtctcgcagccaacgcgatttgtagcgctgttccgtcccactgggtgcccacatcaagaaccacttggagtatccatgccaaacacgagtggatgacaaccgaagatatgcttactgtctggaatcgcgtgtggatacaggagaacccttggatggaagacaagaccccagtggagtcttgggaagaggtcccctacctgggcaaacgggaggatcagtggtgcggtagcctaatcgggctgacatccagggcaacgtgggccaagaacattcagaccgctatcaatcaagttagatcactcattggaaacgaagagtatactgactacatgcctagcatgaaacgcttccggagggaagaggaagaggccggcgtgttgtggtga

SEQ ID NO: 14923 - RNA, 9876 nt, synthetic construct
  misc_feature 1..9876: note = derived and/or modified CDS sequence (opt3) from DENV-2__FM210244__SS-prME
  source 1..9876: mol_type = other RNA
accgccggcgtgatcattatgctgatacccacagctatggcattccacctcactacgaggaacggggaacctcatatgatcgtcgggaggcaggaaaagggtaaaagccttctgtttaagaccgaagacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgcccagaggatcgagacctggatactgcggcatcctggcttcacaatcatggcagccattttggcttacaccgtgggcacgactcactttcagcgcgcactcatcttcattctgctggccgctgttgccccatccatgacaatgagatgcatcgggatatctaacagggattttgtggaaggagtctcgggtggctcatgggtggacattgtactcgagcacgggagctgtgttaccactatggcgaagaataagcccacattagatttcgaactgatcaaaaccgaggcaaagcagcctgccacgcttcggaaatattgcattgaagctaagttgaccaacacaactaccgagagtcgctgtccaacacaaggagagccctccctgaatgaagaacaggacaaacgatttgtgtgcaagcattctatggtcgatagaggctggggtaacgggtgtggactattcggcaagggcgggatcgtgacttgcgccatgtttacctgcaaaaagaatatggaaggaaaaatcgtgcagcctgagaacctcgaatacacaattgtcataaccccacacagcggtgaggagcatgcagttggcaatgacactgggaagcacggaaaagaaatcaagattacgccgcagtcccccatcacagaggctgaactgaccggctatggtactgtgaccatggagtgttcacctaggacagggcttgatttcaacgaaatggtactgttgcaaatggaggacaaagcctggctcgtgcaccggcagtggtttctggatttaccactgccctggctccctggcgcggacacccagggaagtaattggatacagaaggagactcttgtcacattcaagaacccacatgccaaaaagcaagacgtggttgtgctgggcagccaggaaggggcaatgcacacggctttgaccggagccactgagattcagatgtcttccggtaatctactgtttacaggccatctcaaatgccgtctgcgcatggataaacttcaactgaaagggatgtcatacagcatgtgtaccggaaagttcaagatcgtcaaagaaatcgctgagacacagcacggcactattgtgatcagagtacagtatgagggtgacgggagtccctgcaagattccgttcgaaataatggatttggagaaaaggcatgttctcggccggctgatcaccgtgaaccctattgtcacggaaaaggactctcccgtgaacatcgaggccgaaccaccttttggagattcctacatcattataggcgtcgagcccgggcagttaaaactgaattggttcaagaagggaagctcgatcggtcaaatgtttgagaccacaatgcgaggcgcaaaacgcatggccattctaggggacactgcttgggatttcggatctctcggcggtgtgtttacctccatcgggaaggcgctgcaccaggttttcggcgcaatttacggagccgctttttcaggcgtgagttggacaatgaaaatccttataggggtaatcattacttggatcggaatgaacagcagatccacctctttgagcgtctcactggtgctcgttggcgtgattacgctgtatcttggtgccatggtccaggcagacagtgggtgtgtggtatcctggaagaataaagaactgaagtgcggaagcggcatcttcataacagataacgtgcacacctggactgagcagtacaagtttcaaccagaatctccctcaaaattggccagtgctattcagaaggcccatgaggaaggtatctgtggcattaggagcgttacacggctcgagaatctgatgtggaaacagatcacccctgagttaaaccacatactgtccgaaaatgaggtcaagctaactatcatgaccggggacattaaaggaatcatgcaggcaggcaagcgctctctcagaccacaaccgacagaactgaaatattcgtggaagacgtgggggaaggcgaaaatgcttagcaccgagtcccataaccagactttcttgattgatggacccgaaacagctgagtgccctaataccaacagggcctggaactcactggaggtggaagactacggctttggtgtgttcacaactaacatctggctcaagctgcgtgagaaacaggacgtcttttgtgatagtaagttaatgtctgcagccataaaagacaatcgggctgttcacgccgatatggggtattggattgaaagcgcactgaacgacacctggaagatggagaaggcttccttcatcgaggtgaaatcatgccactggccaaagagccatacgctttggtctaatggagtgttggaatccgagatgatcattcccaaaagtttcgccggccctgtaagccagcacaactaccgaccaggttattacacacaaaccgcgggcccctggcatctcgggaagctggaaatggattttgacttctgtgagggaactaccgtcgtggttacagaagattgcggcaacagagggccgtctctaaggactaccacagcctccggaaaactgatcacggagtggtgctgtcgctcatgcaccctccctccactgcggtacagaggcgaggacggttgttggtatgggatggaaattaggccccttaaggagaaggaagagaatttggtgaacagtctggtcactgctggacacggccagatagataattttagcttaggtgtgctcggcatggcactgttccttgaagagatgctgcgcacacgagttgggaccaaacatgccatcttgctcgtggctgtatcgtttgtcactctgattacaggaaacatgtccttccgggacctaggccgtgtgatggtgatggtcggggccgcaatgaccgatgacatcggaattggcgttacgtacctggcgctcctggccgcttttaaggtgagacctactttcgccgcaggtcttttgctgaggaaattaacctctaaggagctcatgatggctacaatcgggatagccctgcttagccagtcaaccatccccgaaactattctggagctaacagatgcactcgccctgggaatgatggtattgaaaatcgtgcgcaatatggaaaagtatcaactggctgtcaccattatggcgatcagttgcgtgccaaacgccgttatattacagaatgcatggaaggtgtcctgtacaattctcgctactgtctctgtgagccctctgcttctgacctcctcacagcagaaagccgactggatccccttggccctcacgatcaagggcctgaacccaacagctatttttctaaccactctgagccggaccagtaaaaagagatcttggccgcttaatgaggcaataatggccgttggcatggtgtccatcctcgcgagctcgctgttgaaaaacgacattcctatgacagggcccctggtcgctggaggtttactcactgtatgctacgtgctgaccggcaggtcagccgatcttgaactggagcgagcaacggacgttaagtgggaggatcaagccgaaatctctgggagttccccaattttgagcatcacaatagctgaggacggatctatgagcatcaaaaatgaagaggaggaacagaccctcactattctgatccgcacaggcctactggtgatttccggtcttttccccgtctcaatccctataaccgcagccgcgtggtatctctgggaggtgaagaagcagcgggctggggtactgtgggatgtgccaagtccccctccggtcggaaaagccgaattggaggacggcgcatacagaattaagcagaaaggcatcttagggtatagccaaatcggagccggtgtttacaaggaaggcacttttcacacaatgtggcacgtgaccagaggggctgtgctgatgcatcgtggaaaacgcattgagccatcttgggccgatgtcaagaaggacctcatctcctacggcggtgggtggaaactggagggagaatggaaggagggcgaagaggtgcaggttcttgcactggaacccggcaaaaaccctcgggctgtacagacgaagccagggttgttcaaaactaataccggaacaataggtgccgtgtcactagattttagtcccggcaccagcgggtcccctattgtcgacagaaagggaaaggtggttggcctgtatggtaacggggtggtcacaaggtctggagcgtacgtgtcggccatcgcacagactgagaaaagcattgaggataatccggaaatcgaggacgatatattccgaaagaaacggctcaccattatggacctgcaccccggcgctggcaagacgaaacgctatcttccagccatcgtaagagaagctatcaagagggggttacggacactgattctcgcacctactcgagtcgtggccgccgagatggaagaggctttgagaggactgcccatccgctaccaaaccccagcgattagggcagagcatacaggtcgtgaaatagttgacctcatgtgtcacgccaccttcactatgcggctgctttcacctgtgagagtccccaactataacctgatcattatggatgaggctcattttaccgacccagcctccatcgcagccaggggctacatcagtacacgcgtggaaatgggggaggctgcgggaattttcatgacggccactccgcctggctctaaggatccctttccacagagcaatgcacccataatggacgaggaacgagagatccctgaaagatcctggaactcaggtcacgagtgggttaccgatttcaaagggaagacagtgtggtttgtcccatctattaaagctggaaatgacatcgccgcatgcttgcggaagaacggcaaaaaggtgattcagctaagcaggaagaccttcgatagtgaatatgtaaaaactcgcacaaatgactgggattttgtggttaccacggacatctccgagatgggcgccaacttcaaggctgagcgtgtcatagatcccagacggtgtatgaaacctgtgatcctgactgacggggaagagagggtgattctcgccggaccgatgccagtcacacacagctctgcggcacaacgccgaggtagaatcggccggaatcccaagaacgaaaatgaccagtacatttacatgggggagcctttagaaaacgatgaggactgcgcccattggaaagaggctaagatgctgcttgataatatcaacacccccgaaggaataattccatcaatgtttgagcctgaaagggagaaagtagacgccatcgatggcgaatatcgcctgagaggtgaggctaggaagaccttcgtggacctcatgcggcgtggggatttgcccgtttggctggcataccgcgtggccgctgagggcattaattatgccgaccgaagatggtgttttgatggagtcaagaacaatcagatcctcgaagagaacgtggaagttgagatatggactaaagagggcgaaaggaagaaactgaagccacggtggcttgacgcacgcatctactccgatcctctagcgctgaaagagttcaaggagttcgccgctgggagaaagagtttgacattaaacctgattaccgagatgggaaggctcccgacatttatgactcagaaagcccgggacgcactggataatcttgctgtgctgcacacggccgaagcagggggaaaggcctataaccatgctctcagcgagttgcccgagaccctggaaacactactgctccttactctgttagcgaccgtcacagggggaatcttcttgtttctgatgtcgggcaaaggtgtggggaagatgaccctcggcatgtgctgcattatcactgcctctatactgctttggcacgcacaaattcagccacactggatcgctgcctccatcattctggagttctttctcatcgtattgctgatacctgaacccgagaaacagcgaacgccacaggacaatcaattaacctacgtggttattgccatcctaacagtcgtggcagctactatggccaacgaaatgggattcctggagaagaccaagaaagacctcggccttgggagcattgcgacacaggagcctgaatcaaatatcctggatatagacttgagacccgctagtgcctggaccctgtatgcagtggccactacatttgtcacgccgatgctccgccattctatcgagaactccagcgttaatgtgtcactgaccgctattgcaaaccaggccactgtacttatgggactcggtaagggctggccactgagtaaaatggatatcggggtgcctttgctggcgattggatgttacagccaggtcaatcccatcacattaaccgctgccctactgctccttgtggcacactacgccattatcggcccaggtctgcaagctaaggccaccagggaagcacagaaacgggctgccgcggggataatgaagaaccccacagttgacggcattactgtgatcgatttggaccctatcccgtatgatcccaagttcgagaaacagctgggacaggtcatgctcctgattctttgcgtaacgcaagtgttaatgatgcgtaccacatgggccctgtgtgaagcactcactttggctaccggcccaatatccacactgtgggaggggaatcctggaagattttggaacaccactatcgccgtttctatggcaaatattttcaggggcagctacctagctggtgccgggctgctcttttccatcatgaagaacacgacaaatacccgccggggaactggcaacattggtgagacccttggcgaaaaatggaagtcacgactgaatgccttggggaaatctgagttccagatctataagaaaagtggaatacaggaagtggacagaacactggcgaaggagggcatcaagaggggtgaaactgatcatcacgctgtctcgcgcggaagcgcaaaactccggtggtttgtggaaagaaacatggtcacccccgagggcaaggtggttgacctgggttgcgggcgtggaggctggtcctactattgtggtggcctaaagaatgtgagggaagtaaaggggcttacaaaaggaggccctgggcatgaggaaccaattcccatgtctacgtacggatggaatctggtgcggctccaatcaggcgtcgatgttttcttcacccctccagagaagtgcgacactctactgtgtgatatcggtgagagctcccccaacccgacaattgaagccgggcgcaccttgcgagtgctgagtctcgtcgagaattggcttaacaatgacactcagttttgcatcaaggtgctgaacccttatatgccatctgtaatagagaaaatggagacattgcagagaaagtacggaggcgctctggtgaggaatcccctcagccggaactcaacccacgaaatgtactgggtttccaatgccacgggcaacattgtgagtagcgtcaatatgatctctcgcatgttaatcaacagattcaccatgaaacacaagaaagcaacatatgagcctgacgtggatctggggtccggaactaggaatattggtatagagtcagaaatgccaaaccttgacatcattggcaagcgaatcgagaagattaaacaggaacatgagaccagctggcactacgatcaagaccatccctataagacatgggcctaccacgggtcgtatgaaactaaacagaccggatctgctagttccatggtcaatggcgtggttcggctgctaacaaagccgtgggatgtagtgcctatggtcacccagatggcgatgactgacacgacaccctttggtcagcaacgtgtgttcaaagagaaggttgataccagaactcaggagccaaaggaagggaccaaaaagctcatgaaaatcacagccgagtggctgtggaaggaattgggcaaaaagaaaacgcctcgcatgtgtaccagggaggagtttactcggaaggtgagaagcaacgcagctctgggcgccatattcacagacgaaaacaagtggaaatcagcacgcgaggccgtcgaagattccaggttttgggagctcgtggacaaggaacgaaatcttcacctggagggcaaatgcgagacctgtgtatacaacatgatggggaagcgggagaaaaagttaggagagttcggtaaggctaaaggctctagagccatctggtatatgtggctgggggcgaggtttttggagttcgaggcactcggatttctgaatgaagatcattggttcagccgcgagaacagtctatccggcgtggagggtgaagggcttcacaagctgggatacattctccgtgacgttagcaaaaaggagggcggcgccatgtacgctgacgatactgccgggtgggacacacggatcaccctggaagatttgaaaaatgaggaaatggtcacaaaccatatggagggagagcacaagaagctggcagaagctatttttaaactcacttatcagaataaggtggtgagagtccagaggcccaccccacgcggtacggttatggacatcatttctcgacgggatcaaagaggctcaggacaggtgggaacctacggccttaacacattcactaatatggaggcccagctgataaggcaaatggaaggtgaggggatcttcaaaagtattcagcatttaaccgtaacagaggaaatcgctgtgcagaactggctggcccgcgtcggaagagagcggttgtccaggatggcaatcagcggcgacgattgcgtggttaagcccctcgacgatcgttttgcgtctgccctgactgctctaaatgacatgggcaaagtgcgaaaggatattcagcaatgggaaccttcgcgcgggtggaacgactggacccaggtcccattctgctcacaccactttcatgagcttataatgaaggatggaagagtgctggtagttccgtgtcggaatcaggacgaactcatcggtagggcccgcattagccagggcgcagggtggtccctgaaagagacggcttgcttgggaaagagttatgcccaaatgtggtctttaatgtacttccacagacgggacctgaggctcgcagccaacgcgatctgtagcgctgtgccctcccattgggtccctacatcacgaaccacttggagtattcacgccaaacacgagtggatgacaaccgaagatatgcttactgtgtggaatcgtgtgtggatccaggagaacccatggatggaagacaagacccccgtcgagtcttgggaagaggttccttatctgggcaaaagagaggatcagtggtgcggtagcctaatagggctgacatcccgcgcaacgtgggccaagaacatccagaccgctattaatcaagtgcggtcactcatcggaaacgaagagtacactgactatatgccaagcatgaagaggtttagacgcgaagaggaagaggccggcgtattgtggtga

SEQ ID NO: 14924 - RNA, 9876 nt, synthetic construct
  misc_feature 1..9876: note = derived and/or modified CDS sequence (opt3) from DENV-2__FM210234__SS-prME
  source 1..9876: mol_type = other RNA
accgccggcgtgatcattatgctgatacccacagctatggcattccacctcactacgaggaacggggaacctcatatgatcgtcggaaggcaggaaaagggtaaaagccttctgtttaagaccgaagacggcgttaatatgtgcacattgatggccattgatttaggggaactgtgtgaagacactatcacctacaaatgcccattactccggcaaaacgaaccggaagatattgactgttggtgcaattccacatctacctgggtgacttatggaacatgtaccacgactggcgaacaccgccgagaaaagcgttcagtagcgctggtgccccatgtcggtatggggcttgagacccgtacagaaacttggatgagtagcgagggagcttggaaacacgcccagaggatcgagacctggatactgcggcatcctggcttcacaatcatggcagccattttggcttacaccgtgggcacgactcactttcagcgcgcactcatcttcattctgctggccgctgttgccccatccatgacaatgagatgcatcgggatatctaacagggattttgtggaaggagtctcgggtggctcatgggtggacattgtactcgagcacgggagctgtgttaccactatggcgaagaataagcccacattagatttcgaactgatcaaaaccgaggcaaagcagcctgccacgcttcggaaatattgcattgaagctaagttgaccaacacaactaccgagagtcgctgtccaacacaaggagagccctccctgaatgaagaacaggacaaacgatttgtgtgcaagcattctatggtcgatagaggctggggtaacgggtgtggactattcggcaagggcgggatcgtgacttgcgccatgtttacctgcaaaaagaatatggaaggaaaaatcgtgcagcctgagaacctcgaatacacaattgtcataaccccacacagcggtgaggagcatgcagttggcaatgacactgggaagcacggaaaagaaatcaagattacgccgcagtcccccatcacagaggctgaactgaccggctatggtactgtgaccatggagtgttcacctaggacagggcttgatttcaacgaaatggtactgttgcaaatggaggacaaagcctggctcgtgcaccggcagtggtttctggatttaccactgccctggctccctggcgcggacacccagggaagtaattggatacagaaggagactcttgtcacattcaagaacccacatgccaaaaagcaagacgtggttgtgctgggcagccaggaaggggcaatgcacacggctttgaccggagccactgagattcagatgtcttccggtaatctactgtttacaggccatctcaaatgccgtctgcgcatggataaacttcaactgaaagggatgtcatacagcatgtgtaccggaaagttcaagatcgtcaaagaaatcgctgagacacagcacggcactattgtgatcagagtacagtatgagggtgacgggagtccctgcaagattccgttcgaaataatggatttggagaaaaggcatgttctcggccggctgatcaccgtgaaccctattgtcacgggaaaggactctcccgtgaacatcgaagccgagccaccttttggcgattcctacatcattataggggtcgaacccggacagttaaaactgaattggttcaagaagggtagctcgatcggccaaatgtttgagaccacaatgcgaggggcaaaacgcatggccattctaggagacactgcttgggatttcggctctctcggtggggtgtttacctccatcggcaaggcgctgcaccaggttttcggagcaatttacggcgccgctttttcaggggtgagttggacaatgaaaatccttataggagtaatcattacttggatcggcatgaacagcagatccacctctttgagcgtctcactggtgctcgttggtgtgattacgctgtatcttggggccatggtccaggcagacagtggatgtgtggtatcctggaagaataaagagctgaagtgcggcagcggtatcttcataacagataacgtgcacacctggactgaacagtacaagtttcaaccagagtctccctcaaaattggccagtgctattcagaaggcccatgaagagggcatctgtgggattaggagcgttacacggctcgaaaatctgatgtggaaacagatcacccctgagttaaaccacatactgtccgagaatgaagtcaagctaactatcatgaccggagacattaaaggcatcatgcaggcagggaagcgctctctcagaccacaaccgacagagctgaaatattcgtggaagacgtggggaaaggcgaaaatgcttagcaccgaatcccataaccagactttcttgattgatggccccgagacagctgaatgccctaataccaacagggcctggaactcactggaggtggaggactacggttttggggtgttcacaactaacatctggctcaagctgcgtgaaaaacaggacgtcttttgtgatagtaagttaatgtctgcagccataaaagacaatcgggctgttcacgccgatatgggatattggattgagagcgcactgaacgacacctggaagatggaaaaggcttccttcatcgaggtgaaatcatgccactggccaaagagccatacgctttggtctaatggcgtgttggagtccgaaatgatcattcccaaaagtttcgccggtcctgtaagccagcacaactaccgaccaggctattacacacaaaccgcggggccctggcatctcggaaagctggagatggattttgacttctgtgaaggcactaccgtcgtggttacagaggattgcgggaacagaggaccgtctctaaggactaccacagcctccggcaaactgatcacggaatggtgctgtcgctcatgcaccctccctccactgcggtacagaggtgaggacgggtgttggtatggaatggagattaggccccttaaggaaaaggaggaaaatttggtgaacagtctggtcactgctggccacggtcagatagataattttagcttaggcgtgctcgggatcgcactgttccttgaggaaatgctgcgcacacgagttggaaccaaacatgccattttgctcgtggctgtatcgtttgtcactctgatcacaggcaacatgtccttccgggacctagggcgtgtgatggtgatggtcggagccgcaatgaccgatgacattggcatgggtgttacgtacctggcgctcctggccgcttttaaggtgagacctactttcgccgcagggcttttgctgaggaaattaacctctaaggagctcatgatggctacaatcggaatagccctgcttagccagtcaaccatccccgagactattctggaactaacagatgcactcgccctgggcatgatggtattgaaaatcgtgcgcaatatggagaagtatcaactggctgtcaccattatggcgatcagttgcgtgccaaacgccgttatattacagaatgcatggaaggtgtcctgtacaattctcgctactgtctctgtgagccctctgcttctgacctcctcacagcagaaagccgactggatccccttggccctcacgatcaagggcctgaacccaacagctatttttctaaccactctgagccggaccagtaaaaagagatcttggccgcttaatgaagcaataatggccgttgggatggtgtccatcctcgcgagctcgctgttgaaaaacgacattcctatgacaggacccctggtcgctggtggcttactcactgtatgctacgtgctgaccgggaggtcagccgatcttgagctggaacgagcaacggacgttaagtgggaggatcaagccgagatctctggaagttccccaattttgagcatcacaatagctgaagacggctctatgagcatcaaaaatgaggaagaggagcagaccctcactattctgatccgcacaggtctactggtgatttccgggcttttccccgtctcaatccctataaccgcagccgcgtggtatctctgggaagtgaagaagcagcgggctggagtactgtgggatgtgccaagtccccctccggtcggcaaagccgagttggaagacggcgcatacagaattaagcagaaagggatcttaggatatagccaaatcggtgccggcgtttacaaggaggggacttttcacacaatgtggcacgtgaccaggggagctgtgctgatgcatcgtggcaaacgcattgaaccatcttgggccgatgtcaagaaggacctcatctcctacggtgggggatggaaactggagggcgagtggaaggaaggcgaggaagtgcaggttcttgcactggagcccgggaaaaaccctcgggctgtacagacgaagccaggattgttcaaaactaataccggtacaataggcgccgtgtcactagattttagtcccgggaccagcggatcccctattgtcgacagaaagggcaaggtggttggtctgtatgggaacggagtggtcacaaggtctggcgcgtacgtgtcggccatcgcacagactgagaaaagcattgaggataatccggagatcgaagacgatatattccgaaagaaacggctcaccattatggacctgcaccccggcgctgggaagacgaaacgctatcttccagccatcgtaagagaggctatcaagaggggattacggacactgattctcgcacctactcgagtcgtggccgccgaaatggaggaggctttgagaggtctgcccatccgctaccaaaccccagcgattagggcagagcatacaggccgtgagatagttgacctcatgtgtcacgccaccttcactatgcggctgctttcacctgtgagagtccccaactataacctgatcattatggatgaagctcattttaccgacccagcctccatcgcagccagggggtacatcagtacacgcgtggagatgggagaagctgcgggcattttcatgacggccactccgcctggttctcgagatccctttccacagagcaatgcacccataatggacgaggagagagaaatccctgagcggtcctggaactcagggcacgaatgggttaccgatttcaagggaaaaacagtgtggtttgtcccatctattaaggctggcaatgacatcgccgcatgcttgaggaaaaacggcaagaaagtgattcagctaagccgcaagaccttcgatagtgagtatgtaaagactcgtacaaatgactgggattttgtggttaccacggacatctccgaaatgggggccaacttcaaagctgagagagtcatagatccccggaggtgtatgaagcctgtgatcctgactgacggagaggaacgcgtgattctcgccggtccgatgccagtcacacacagctctgcggcacaacgaagaggccggatcgggaggaatcccaaaaacgagaatgaccagtacatttacatgggagaacctttagagaacgatgaagactgcgcccattggaaggaggctaaaatgctgcttgataatatcaacacccccgagggcataattccatcaatgtttgaacctgagcgcgaaaaggtagacgccatcgatggtgagtatagactgagaggggaagctcggaaaaccttcgtggacctcatgcgtcgcggcgatttgcccgtttggctggcataccgagtggccgctgagggaattaattatgccgacagaaggtggtgttttgatggcgtcaagaacaatcagatcctcgaggaaaacgtggaggttgaaatatggactaaggagggggagcggaaaaagctgaaaccacgctggcttgacgcaagaatctactccgatcctctagcgctgaaggagttcaaagagttcgccgctggaaggaagagtttgacattaaacctgattaccgaaatgggtcggctcccgacatttatgactcagaaggcccgagacgcactggataatcttgctgtgctgcacacggccgaggcaggcgggagagcctataaccatgctctcagcgaattgcccgagaccctggagacactactgctccttactctgttagcgaccgtcacaggaggcatcttcttgtttctgatgtcgggtaaaggggtgggcaagatgaccctcggaatgtgctgcattatcactgcctctatactgctttggcacgcacaaattcagccacactggatcgctgcctccatcattctggagttctttctcatcgtattgctgatacctgagcccgaaaaacagcgcacgccacaggacaatcaattaacctacgtggttattgccatcctaacagtcgtggcagctactatggccaacgagatgggcttcctggaaaagaccaaaaaggacctcgggcttggaagcattgcgacacaggagcctgagtcaaatatcctggatatagacttgaggcccgctagtgcctggaccctgtatgcagtggccactacatttgtcacgccgatgctccggcattctatcgaaaactccagcgttaatgtgtcactgaccgctattgcaaaccaggccactgtacttatgggtctcggcaaggggtggccactgagtaaaatggatatcggagtgcctttgctggcgattggctgttacagccaggtcaatcccatcacattaaccgctgccctactgctccttgtggcacactacgccattatcggtccagggctgcaagctaaggccacccgtgaggcacagaaaagagctgccgcgggcataatgaagaaccccacagttgacggaattactgtgatcgatttggaccctatcccgtatgatcccaaattcgaaaagcagctgggccaggtcatgctcctgattctttgcgtaacgcaagtgttaatgatgaggaccacatgggccctgtgtgaggcactcactttggctaccgggccaatatccacactgtgggaaggaaatcctggccgcttttggaacaccactatcgccgtttctatggcaaatattttccggggtagctacctagctggggccggactgctcttttccatcatgaagaacacgacaaatacccgaagaggcactggtaacattggcgagacccttggggagaaatggaagtcaaggctgaatgccttgggaaaatctgagttccagatctataagaaaagtggcatacaggaggtggaccgcacactggcgaaggaagggatcaaacggggagagactgatcatcacgctgtctcgagaggcagcgcaaagctccgttggtttgtggagaggaacatggtcacccccgaaggtaaggtggttgacctggggtgcggacggggcggttggtcctactattgtggcgggctaaagaatgtgcgcgaggtaaagggacttacaaaaggcgggcctggacatgaagaaccaattcccatgtctacgtacggctggaatctggtgcgactccaatcaggtgtcgatgttttcttcacccctccagaaaagtgcgacactctactgtgtgatatcggggagagctcccccaacccgacaattgaggccggaagaaccttgagggtgctgagtctcgtcgaaaattggcttaacaatgacactcagttttgcatcaaagtgctgaacccttatatgccatctgtaatagagaagatggaaacattgcagcggaagtacggcggcgctctggtgcgcaatcccctcagcagaaactcaacccacgagatgtactgggtttccaatgccacggggaacattgtgagtagcgtcaatatgatctctaggatgttaatcaaccgattcaccatgaaacacaagaaagcaacatatgaacctgacgtggatctgggatccggtactcggaatattggcatagagtcagagatcccaaaccttgacattatcgggaagcgtattgagaaaatcaagcaggagcatgaaaccagctggcactacgatcaagaccatccctataagacatgggcctaccacggatcgtatgagactaaacagaccggctctgctagttccatggtcaatggtgtggttagactgctaacaaagccgtgggatgtagtgcctatggtcacccagatggcgatgactgacacgacaccctttgggcagcaacgcgtgttcaaagaaaaggttgataccaggactcaggagccaaaagagggaaccaagaagctcatgaaaataacagccgaatggctgtggaaggagttgggcaaaaagaaaacgcctcggatgtgtaccagagaagagtttactcgcaaggtgaggagcaacgcagctctgggcgccatcttcacagacgagaacaaatggaagtcagcacgagaagccgtcgaggattcccggttttgggaactcgtggacaaggagagaaatcttcacctggaagggaaatgcgagacctgtgtatacaacatgatgggaaagagggagaaaaagttaggtgagttcggcaaagctaaggggtctcgcgccatttggtatatgtggctgggagcgagatttttggagttcgaagcactcggctttctgaatgaggatcattggttcagccgggaaaacagtctatccggtgtggagggggagggacttcacaagctgggctacatcctcagagacgttagcaaaaaggaaggcggggccatgtacgctgacgatactgccggatgggacacaaggattaccctggaggatttgaaaaatgaagagatggtcacaaaccatatggaaggtgagcacaagaaactggcagaggctatctttaagctcacttatcagaataaggtggtgcgcgtccagcgacccaccccacggggcacggttatggacattatatctagaagggatcaacgcgggtcaggacaggtgggcacctacggtcttaacacattcactaatatggaagcccagctgatcagacaaatggagggggaaggaattttcaaaagtatccagcatttaaccgtaacagaggagatcgctgtgcagaactggctggcccgggtcggcagggaacgtttgtcccgaatggcaattagcggcgacgattgcgtggttaagcccctcgacgatcgctttgcgtctgccctgactgctctaaatgacatggggaaagtgagaaaggatatacagcaatgggagccttcgcggggatggaacgactggacccaggtcccattctgctcacaccactttcatgaacttatcatgaaagatggtagggtgctggtagttccgtgtcgcaatcaggacgagctcattggcagagcccggatcagccagggggcaggatggtccctgaaggaaacggcttgcttgggcaagagttatgcccaaatgtggtctttaatgtacttccacaggcgagacctgcgtctcgcagccaacgcgatttgtagcgctgtgccctcccattgggtccctacatcaagaaccacttggagtatccacgccaaacacgagtggatgacaaccgaggatatgcttactgtgtggaatcgcgtgtggatacaggaaaacccatggatggaggacaagacccccgtcgaatcttgggaggaagttccttatctgggtaaacgggaggatcagtggtgcgggagcctaatcggactgacatccagggcaacgtgggccaagaacattcagaccgctatcaatcaagtgagatcactcattggcaacgaggaatacactgactatatgccaagcatgaaacgctttcggagggaggaagaggaagccggcgtattgtggtga

SEQ ID NO: 14925 - RNA, 9876 nt, synthetic construct
  misc_feature 1..9876: note = derived and/or modified CDS sequence (opt3) from DENV-2__FM210213__SS-prME
  source 1..9876: mol_type = other RNA
accgccggcgtgataattatgctgatacccacagctatggcattccacctcactacgaggaatggggagcctcatatgatcgtcgggaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagacccggacagaaacttggatgagtagcgagggagcttggaaacacgcccagaggatcgagacctggatactgcggcatcctggcttcacaatcatggcagccattttggcttacaccgtgggcacgactcactttcagcgcgcactcatcttcattctgctggccgctgttgccccatccatgacaatgcgttgcatcgggatatctaacagggattttgtggaaggagtctcgggtggctcatgggtggacattgtactcgagcacgggagctgtgttaccactatggcgaagaataagcccacattagatttcgaactgatcaaaaccgaggcaaagcagcctgccacgcttcggaaatattgcattgaagctaagttgaccaacacaactaccgagagtcgctgtccaacacaaggagagccctccctgaatgaggaacaggacaaacgatttgtgtgcaagcattctatggtcgatagaggctggggtaacgggtgtggactattcggcaagggcgggatcgtgacttgcgccatgtttacctgcaaaaagaatatggaaggaaaaatcgtgcagcctgagaacctcgaatacacaattgtcataaccccacacagcggtgaggagcatgcagttggcaatgacactgggaagcacggaaaagaaatcaagattacgccgcagtcccccatcacagaggctgaactgaccggctatggtactgtgaccatggagtgttcacctaggacagggcttgatttcaacgaaatggtactgttgcaaatggaggacaaagcctggctcgtgcaccggcagtggtttctggatttaccactgccctggctccctggcgcggacacccagggaagtaattggatacagaaggagactcttgtcacattcaagaacccacatgccaaaaagcaagacgtggttgtgctgggcagccaggaaggggcaatgcacacggctttgaccggagccactgagattcagatgtcttccggtaatctactgtttacaggccatctcaaatgccgtctgcgcatggataaacttcaactgaaagggatgtcatacagcatgtgtaccggaaagttcaagatcgtcaaagaaatcgctgagacacagcacggcactattgtgatcagagtacagtatgagggtgacgggagtccctgcaagattccgttcgaaataatggatttggagaaaaggcatgttctcggccggctgatcaccgtgaaccctattgtcacggaaaaggactctcccgtgaacatcgaggccgaaccaccttttggagattcctacatcattataggcgtcgagcccgggcagttaaaactgaattggttcaagaagggaagctcgatcggtcaaatgtttgagaccacaatgcgaggcgcaaaacgcatggccattctaggggacactgcttgggatttcggatctctcggcggtgtgtttacctccatcgggaaggcgctgcaccaggttttcggcgcaatttacggagccgctttttcaggcgtgagttggacaatgaaaatccttataggggtaatcattacttggatcggaatgaacagcagatccacctctttgagcgtctcactggtgctcgttggcgtgattacgctgtatcttggtgccatggtccaggcagacagtgggtgtgtggtatcctggaagaataaagaactgaagtgcggaagcggcatcttcataacagataacgtgcacacctggactgagcagtacaagtttcaaccagaatctccctcaaaattggccagtgctattcagaaggcccatgaggaaggtatctgtggcattaggagcgttacacggctcgagaatctgatgtggaaacagatcacccctgagttaaaccacatactgtccgaaaatgaggtcaagctaactatcatgaccggggacattaaaggaatcatgcaggcaggcaagcgctctctcagaccacaaccgacagaactgaaatattcgtggaagacgtgggggaaggcgaaaatgcttagcaccgagtcccataaccagactttcttgattgatggacccgaaacagctgagtgccctaataccaacagggcctggaactcactggaggtggaagactacggctttggtgtgttcacaactaacatctggctcaagctgcgtgagaaacaggacgtcttttgtgatagtaagttaatgtctgcagccataaaagacaatcgggctgttcacgccgatatggggtattggattgaaagcgcactgaacgacacctggaagatggagaaggcttccttcatcgaggtgaaatcatgccactggccaaagagccatacgctttggtctaatggagtgttggaatccgagatgatcattcccaaaagtttcgccggccctgtaagccagcacaactaccgaccaggttattacacacaaaccgcgggcccctggcatctcgggaagctggaaatggattttgacttctgtgagggaactaccgtcgtggttacagaagattgcggcaacagagggccgtctctaaggactaccacagcctccggaaaactgatcacggagtggtgctgtcgctcatgcaccctccctccactgcggtacagaggcgaggacggttgttggtatgggatggaaattaggccccttaaggagaaggaagagaatttggtgaacagtctggtcactgctggacacggccagatagataattttagcttaggtgtgctcggcatggcactgttccttgaagagatgctgcgcacacgagttgggaccaaacatgccatcttgctcgtggctgtatcgtttgtcactctgattacaggaaacatgtccttccgggacctaggccgtgtgatggtgatggtcggggccgcaatgaccgatgacatcggaatgggcgttacgtacctggcgctcctggccgcttttaaggtgagacctactttcgccgcaggtcttttgctgaggaaattaacctctaaggagctcatgatggctacaattgggatcgccctgcttagccagtcaaccatacccgaaactatcctggagctaacagatgcactcgccctgggaatgatggtattgaaaattgtgcgcaatatggaaaagtatcaactggctgtcaccatcatggcgattagttgcgtgccaaacgccgttatcttacagaatgcatggaaggtgtcctgtacaatactcgctactgtctctgtgagccctctgcttctgacctcctcacagcagaaagccgactggattcccttggccctcacgatcaagggcctgaacccaacagctatctttctaaccactctgagccggaccagtaaaaagagatcttggccgcttaatgaggcaattatggccgttggcatggtgtccatactcgcgagctcgctgttgaaaaacgacatccctatgacagggcccctggtcgctggaggtttactcactgtatgctacgtgctgaccggcaggtcagccgatcttgaactggagcgagcaacggacgttaagtgggaggatcaagccgaaatttctgggagttccccaatcttgagcattacaatcgctgaggacggatctatgagcatcaagaatgaagaggaggaacagaccctcactatcctgattcgcacaggcctactggtgatctccggtcttttccccgtctcaattcctatcaccgcagccgcgtggtatctctgggaggtgaagaagcagcgggctggggtactgtgggatgtgccaagtccccctccggtcggaaaagccgaattggaggacggcgcatacagaataaagcagaaaggcattttagggtatagccaaatcggagccggtgtttacaaggaaggcacttttcacacaatgtggcacgtgaccagaggggctgtgctgatgcatcgtggaaaacgcatcgagccatcttgggccgatgtcaagaaggacctcatttcctacggcggtgggtggaaactggagggagaatggaaggagggcgaagaggtgcaggttcttgcactggaacccggcaaaaaccctcgggctgtacagacgaagccagggttgttcaaaactaataccggaacaatcggtgccgtgtcactagattttagtcccggcaccagcgggtcccctatagtcgacagaaagggaaaggtggttggcctgtatggtaacggggtggtcacaaggtctggagcgtacgtgtcggccattgcacagactgagaaaagcatcgaggataatccggaaattgaggacgatatcttccgaaagaaacggctcaccataatggacctgcaccccggcgctggcaagacgaaacgctatcttccagccattgtaagagaagctatcaagagggggttacggacactgatcctcgcacctactcgagtcgtggccgccgagatggaagaggctttgagaggactgcccattcgctaccaaaccccagcgatcagggcagagcatacaggtcgtgaaattgttgacctcatgtgtcacgccaccttcactatgcggctgctttcacctgtgagagtccccaactataacctgataatcatggatgaggctcattttaccgacccagcctccattgcagccaggggctacatcagtacacgcgtggaaatgggggaggctgcgggaatcttcatgacggccactccgcctggctctcgagatccctttccacagagcaatgcacccattatggacgaggaaagagagatacctgaacggtcctggaactcaggtcacgagtgggttaccgatttcaaggggaaaacagtgtggtttgtcccatctatcaaggctggaaatgacattgccgcatgcttgaggaaaaacggcaagaaagtgatccagctaagccgcaagaccttcgatagtgaatatgtaaagactcgtacaaatgactgggattttgtggttaccacggacatttccgagatgggcgccaacttcaaagctgagagagtcatcgatccccggaggtgtatgaagcctgtgatactgactgacggggaagaacgcgtgatcctcgccggaccgatgccagtcacacacagctctgcggcacaacgaagaggtcggattggcaggaatcccaaaaacgaaaatgaccagtacatctacatgggggagcctttagaaaacgatgaggactgcgcccattggaaggaggctaaaatgctgcttgataatattaacacccccgaaggaatcataccatcaatgtttgagcctgaacgcgagaaggtagacgccattgatggcgaatatagactgaggggtgaggctcggaaaaccttcgtggacctcatgcgtcgcggggatttgcccgtttggctggcataccgagtggccgctgagggcatcaattatgccgacagaaggtggtgttttgatggagtcaagaacaatcagattctcgaagagaacgtggaagttgagatctggactaaggagggcgaacggaaaaagctgaaaccacgctggcttgacgcaagaatatactccgatcctctagcgctgaaggagttcaaagagttcgccgctgggaggaagagtttgacattaaacctgatcaccgagatgggacggctcccgacatttatgactcagaaggcccgaaatgcactggacaaccttgctgtgctgcacacggccgaagcaggaggtagagcctataatcatgctctcagcgagttgcccgagaccctggaaacactactgctccttactctgttagcgaccgtcacagggggaattttcttgtttctgatgtcgggcaaaggtgtggggaagatgaccctcggcatgtgctgcatcattactgcctctatcctgctttggcacgcacaaatacagccacactggattgctgcctccatcatcctggagttctttctcattgtattgctgatccctgaacccgagaaacagcgcacgccacaggataaccaattaacctacgtggttatagccattctaacagtcgtggcagctactatggccaatgaaatgggattcctggagaagaccaaaaaggacctcggccttgggagcatcgcgacacaggagcctgaatcaaacattctggacatcgatttgaggcccgctagtgcctggaccctgtatgcagtggccactacatttgtcacgccgatgctccggcattctatagaaaattccagcgttaacgtgtcactgaccgctatcgcaaatcaggccactgtacttatgggactcggtaagggctggccactgagtaaaatggacattggggtgcctttgctggcgatcggatgttacagccaggtcaaccccattacattaaccgctgccctactgctccttgtggcacactacgccatcattggcccaggtctgcaagctaaggccacccgtgaagcacagaaaagagctgccgcggggatcatgaagaatcccacagttgatggcataactgtgattgacttggatcctatcccgtatgaccccaaattcgagaagcagctgggacaggtcatgctcctgatcctttgcgtaacgcaagtgttaatgatgaggaccacatgggccctgtgtgaagcactcactttggctaccggcccaatttccacactgtgggaggggaaccctggacgcttttggaataccactatagccgtttctatggcaaacatcttccggggcagctacctagctggtgccgggctgctcttttccattatgaagaatacgacaaacacccgaagaggaactggcaatatcggtgagacccttggcgaaaaatggaagtcaaggctgaacgccttggggaaatctgagttccagatttataagaaaagtggaatccaggaagtggatcgcacactggcgaaggagggcataaaaagaggggaaactgaccatcacgctgtctcgagaggaagcgcaaagctccgttggtttgtggaaaggaacatggtcacccccgagggcaaggtggttgatctgggttgcgggcggggaggctggtcctactattgtggtggccttaaaaatgtgcgcgaagtaaaggggctaacaaaaggaggccctgggcatgaggaaccaatccccatgtctacgtacggatggaacctggtgcgactccaatcaggcgtcgacgttttcttcacccctccagagaagtgcgatactctactgtgtgacattggtgagagctcccccaatccgacaatcgaagccgggagaaccttgagggtgctgagtctcgtcgagaactggcttaataacgatactcagttttgcattaaagtgctgaatccttatatgccatctgtaatcgaaaagatggagacattgcagcggaagtacggaggcgctctggtgcgcaaccccctcagcagaaattcaacccacgaaatgtactgggtttccaacgccacgggcaatatagtgagtagcgtcaacatgatttctaggatgttaatcaatcgattcaccatgaaacacaagaaagcaacatatgagcctgacgtggacctggggtccggaactcggaacatcggtattgagtcagaaataccaaatcttgatatcattggcaagcgtatcgagaaaattaagcaggaacatgagaccagctggcactacgaccaagatcatccctataagacatgggcctaccacgggtcgtatgaaactaaacagaccggatctgctagttccatggtcaacggcgtggttagactgctaacaaagccgtgggacgtagtgcctatggtcacccagatggcgatgactgatacgacaccctttggtcagcaacgcgtgttcaaagagaaggttgacaccaggactcaggagccaaaagaagggaccaagaagctcatgaaaatcacagccgagtggctgtggaaggaattgggcaaaaagaaaacgcctcggatgtgtaccagagaggagtttactcgcaaggtgaggagcaacgcagctctgggcgccatattcacagatgaaaataaatggaagtcagcacgagaggccgtcgaagactcccggttttgggagctcgtggataaggaaagaaaccttcacctggagggcaaatgcgagacctgtgtatacaatatgatggggaagagggagaaaaagttaggagagttcggtaaagctaagggctctcgcgccatctggtatatgtggctgggggcgagatttttggagttcgaggcactcggatttctgaacgaagaccattggttcagccgggagaatagtctatccggcgtggagggtgaagggcttcacaagctgggatacattctcagagatgttagcaaaaaggagggcggcgccatgtacgctgacgacactgccgggtgggatacaaggatcaccctggaagacttgaaaaacgaggaaatggtcacaaatcatatggagggagagcacaagaaactggcagaagctatttttaagctcacttatcagaacaaggtggtgcgcgtccagcgacccaccccacggggtacggttatggatatcatttctagaagggaccaacgcggctcaggacaggtgggaacctacggccttaatacattcactaacatggaggcccagctgataagacaaatggaaggtgaggggatcttcaaaagtattcagcatttaaccgtaacagaggaaatcgctgtgcagaattggctggcccgggtcggaagggagcgtttgtcccgaatggcaatcagcggcgatgactgcgtggttaagcccctcgatgaccgctttgcgtctgccctgactgctctaaacgatatgggcaaagtgagaaaggacattcagcaatgggaaccttcgcgggggtggaatgattggacccaggtcccattctgctcacaccactttcatgagcttataatgaaagacggaagggtgctggtagttccgtgtcgcaaccaggatgaactcatcggtagagcccggattagccagggcgcagggtggtccctgaaggagacggcttgcttgggaaagagttatgcccaaatgtggtctttaatgtacttccacaggcgagacctgcgtctcgcagccaatgcgatctgtagcgctgtgccctcccattgggtccctacatcaagaaccacttggagtattcacgccaaacacgagtggatgacaaccgaagacatgcttactgtgtggaaccgcgtgtggatccaggagaacccatggatggaagataagacccccgtcgagtcttgggaagaggttccttatctgggcaaacgggaggaccagtggtgcggtagcctaatagggctgacatccagggcaacgtgggccaagaatatccagaccgctattaaccaagtgagatcactcatcggaaatgaagagtacactgattatatgccaagcatgaaacgctttcggagggaagaggaagaggccggcgtattgtggtga

SEQ ID NO: 14926 - RNA, 9876 nt, synthetic construct
  misc_feature 1..9876: note = derived and/or modified CDS sequence (opt3) from DENV-2__FM210235__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgcccagaggatcgagacctggatactgcggcatcctggcttcacaatcatggcagccattttggcttacaccgtgggcacgactcactttcagcgcgcactcatcttcattctgctggccgctgttgccccatccatgacaatgagatgcatcgggatatctaacagggattttgtggaaggagtctcgggtggctcatgggtggacattgtactcgagcacgggagctgtgttaccactatggcgaagaataagcccacattagatttcgaactgatcaaaaccgaggcaaagcagcctgccacgcttcggaaatattgcattgaagctaagttgaccaacacaactaccgagagtcgctgtccaacacaaggagagccctccctgaatgaagagcaggacaaacgatttgtgtgcagacattctatggtcgataggggctggggtaacgggtgtggactattcggcaagggcgggatcgtgacttgcgccatgtttacctgcaagaaaaatatggaaggaaagatcgtgcagcctgagaacctcgaatacacaattgtcataaccccacacagcggtgaggagcatgcagttggcaatgacactgggaaacacggaaaggaaatcaaaattacgccgcagtcccccatcacagaggctgaactgaccggctatggtactgtgaccatggagtgttcacctcggacagggcttgatttcaacgaaatggtactgttgcaaatggaggacaaggcctggctcgtgcaccgtcagtggtttctggatttaccactgccctggctccctggcgcggacacccagggaagtaattggatacagaaagagactcttgtcacattcaagaacccacatgccaagaaacaagacgtggttgtgctgggcagccaggaaggggcaatgcacacggctttgaccggagccactgagattcagatgtcttccggtaatctactgtttacaggccatctcaagtgccgcctgagaatggataaacttcaactgaaggggatgtcatacagcatgtgtaccggaaaattcaagatcgtcaaggaaatcgctgagacacagcacggcactattgtgatcagggtacagtatgagggtgacgggagtccctgcaaaattccgttcgaaataatggatttggagaagcggcatgttctcggccgactgatcaccgtgaaccctattgtcacggaaaaagactctcccgtgaacatcgaggccgaaccaccttttggagattcctacatcattataggcgtcgagcccgggcagttaaagctgaattggttcaaaaagggaagctcgatcggtcaaatgtttgagaccacaatgcgcggcgcaaagagaatggccattctaggggacactgcttgggatttcggatctctcggcggtgtgtttacctccatcgggaaagcgctgcaccaggttttcggcgcaatttacggagccgctttttcaggcgtgagttggacaatgaagatccttataggggtaatcattacttggatcggaatgaacagcaggtccacctctttgagcgtctcactggtgctcgttggcgtgattacgctgtatcttggtgccatggtccaggcagacagtgggtgtgtggtatcctggaaaaataaggaactgaaatgcggaagcggcatcttcataacagataacgtgcacacctggactgagcagtacaagtttcaaccagaatctccctcaaagttggccagtgctattcagaaagcccatgaggaaggtatctgtggcattcggagcgttacacgcctcgagaatctgatgtggaagcagatcacccctgagttaaaccacatactgtccgaaaatgaggtcaaactaactatcatgaccggggacattaagggaatcatgcaggcaggcaaaagatctctcaggccacaaccgacagaactgaagtattcgtggaaaacgtgggggaaggcgaagatgcttagcaccgagtcccataaccagactttcttgattgatggacccgaaacagctgagtgccctaataccaaccgtgcctggaattcactggaggtggaagactacggctttggtgtgttcacaactaacatctggctcaaactgcgggagaagcaggacgtcttttgtgatagtaaattaatgtctgcagccataaaggacaatcgagctgttcacgccgatatggggtattggattgaaagcgcactgaacgacacctggaaaatggagaaggcttccttcatcgaggtgaagtcatgccactggccaaaaagccatacgctttggtctaatggagtgttggaatccgagatgatcattcccaagagtttcgccggccctgtaagccagcacaactacagaccaggttattacacacaaaccgcgggcccctggcatctcgggaaactggaaatggattttgacttctgtgagggaactaccgtcgtggttacagaagattgcggcaacagggggccgtctctacgcactaccacagcctccggaaagctgatcacggagtggtgctgtcggtcatgcaccctccctccactgagatacaggggcgaggacggttgttggtatgggatggaaattcgcccccttaaagagaaggaagagaatttggtgaacagtctggtcactgctggacacggccagatagataattttagcttaggtgtgctcggcatggcactgttccttgaagagatgctgcgaacacgggttgggaccaagcatgccatcttgctcgtgactgtatcgtttgtcacactgattaccggaaacatgtccttccgtgacctaggcagagtgatggtgatggtcggggctgccatgacggatgacatcggaatgggcgttacttacctggcactcctggcggcctttaaagtgaggcctaccttcgctgccggtcttttgctgcgcaagttaacatctaaagagctcatgatggcaaccattgggatcgctctgcttagccagtcaactatacccgaaacaatcctggagctaaccgatgccctcgcactgggaatgatggtattgaagattgtgcggaatatggaaaaatatcaactggccgtcacaatcatggctattagttgcgtgccaaacgcggttatcttacagaatgcctggaaggtgtcctgtactatactcgcagctgtctctgtgagccctctgcttctgacctcctcacagcagaaggccgactggattcccttggagtggagcatcaaaggcctcaacccaacggccatctttctgacaaccctaagtagaacttctaagaaaaggtcctggccgctgaatgaagctattatggcagttggcatggtgagcatacttgcctcgtcactcctgaagaacgacatccctatgaccgggcccttggtcgcgggaggtctgttaacagtatgctacgtgctcactggccgatctgctgatctggagcttgagcgcgccaccgacgttaaatgggaagatcaagcagagattagtgggtccagcccaatcctgtctattacgatcgccgaagacggaagcatgtccataaagaatgaggaggaagagcagacattgaccatcctcattcggactggcctgctagtgatctcaggtctgttccccgtcagtattcctatcacagctgcagcctggtatctttgggaagtgaaaaagcagagagcgggggtactctgggatgtgccaagcccccctccggtcggaaaggctgagctggaagacggcgcctacaggataaaacagaagggcattttggggtattctcaaatcggagcaggtgtttacaaagagggcacctttcacactatgtggcacgtgacacgtggggccgtgttaatgcatcgcggaaagcggatcgagccatcctgggctgatgtcaaaaaggacctgatttcatacggcggtgggtggaagctcgaaggagagtggaaagaaggcgaggaagtgcaggttctggcccttgagcccggcaagaaccctagagcagtacagaccaaaccagggctgttcaagacgaatactggaaccatcggtgctgtgagtttggattttagccccggcacatccgggtctcctatagtcgacaggaaaggaaaggtggttggcctatatggtaacggggtggtcacccgatcgggagcctacgtgagcgcgattgcccagacagagaagtcaatcgaagataatccggagattgaagacgatatcttccggaaaaagcgcctgactataatggacctccaccccggcgcaggcaaaaccaagagatatctgccagctattgtaagggaggccatcaaacgggggcttcgaacgttaatcctggctcctacaagagtcgtggcagccgaaatggaggaggccctccgcggattgcccattaggtaccaaactccagctatccgtgcggaacataccggtcgggagattgttgacctgatgtgtcacgcaacattcaccatgagactcctgtcccctgtgagggtccccaactataaccttataatcatggatgaagcccattttactgacccagctagtattgccgcacgcggctacatctctacccgagtggagatgggggaggccgctggaatcttcatgacagcgacgccgcctggcagcagagatccctttccacagtccaatgcccccattatggacgaagagcgggaaatacctgagaggtcatggaactctggtcacgaatgggttactgatttcaaggggaagaccgtgtggtttgtcccaagcatcaaagcaggaaatgacattgctgcctgcctgcgcaagaacggcaaaaaggtgatccagttgagtcgtaaaacattcgattccgagtatgtaaagaccagaactaatgactgggattttgtggttacaaccgacattagcgagatgggcgcaaacttcaaggccgaacgggtcatcgatcccaggcgctgtatgaaacctgtgatactaacggacggggaggaacgagtgatcctggctggaccgatgccagtcactcactcttcagccgcgcaaagacggggtaggattggccgcaatcccaagaacgagaatgaccagtacatctacatgggggaacctctcgagaacgatgaggactgcgcacattggaaagaagccaagatgttactggataatattaacacacccgagggaatcataccatccatgtttgaacctgagagagaaaaagtagacgctattgatggcgagtataggcttcggggtgaggcccgtaagaccttcgtggacctgatgcgccgaggggatctccccgtttggttggcttacagagtggcagccgaaggcatcaattatgctgacaggcggtggtgttttgatggagtcaaaaacaatcagattctggaggaaaacgtggaggttgagatctggaccaaggaaggcgagcgcaagaaactcaagccaagatggctggacgccaggatatacagtgatcctcttgcactaaaagaattcaaggagttcgcggccgggcggaaaagcctgactttgaacttaatcacagaaatgggacgactgccgacctttatgacacagaaggctagagacgccctcgataatctggcagtgcttcacactgctgaggccggtggccgcgcatataaccatgccctgtcggagctccccgaaacgttggagaccctgctactgctcacacttctggctactgtcaccgggggaattttcttatttttgatgtctggcaagggtgtggggaaaatgacactgggcatgtgctgcatcattaccgcgtccatcctcctgtggtacgcccaaatacagccacactggattgcagctagcatcatccttgaattctttctgattgtactcttgatccctgagcccgaaaagcagaggactccacaggacaatcaactgacgtatgtggttatagccattttaaccgtcgtggccgcaacaatggctaacgagatgggattcctagagaaaactaagaaagacctgggcctcgggtcaatcgccacccgggaacctgagagtaatattcttgatatcgacctgcgtcccgcgtctgcttggacattgtacgccgtggcaaccacttttgtcacaccgatgctgagacactccatagaaaacagctcagttaatgtgagtctcacggccatcgctaaccaggcaaccgtactgatgggacttggtaagggctggccactcagcaagatggatattggggtgcctctgttggccatcggatgttactcccaggtcaatcccattactctgacagcggctttactactgctcgtggcccattatgcaatcattggcccaggtcttcaggccaaagctaccagggaggcccaaaagcgcgcagctgccgggatcatgaaaaaccccaccgttgacggcgtgacagtcatagatctggaccctattccgtacgatcccaagttcgaaaaacagttgggacaggtaatgctgctcatcctgtgcgtgactcaggttcttatgatgcggacgacctgggcgttatgtgaggccctgacactcgcaactggcccaatctctaccttgtgggaggggaatcctggacgattttggaacacaaccattgctgtgagcatggccaatatattcagaggctcctatctggcaggtgctgggctactgttttcaatcatgaagaacactacgaatacaaggcgcggaaccggcaacattggtgaaactctcggcgagaagtggaaatctcggcttaatgccctggggaagagtgaattccaaatctacaaaaagtcgggaattcaggaggtcgacagaaccttggccaaagagggcatcaagcgtggggaaacagatcaccatgcggtgagcaggggatccgctaaactgcggtggtttgtcgagcgcaacatggtgactcccgaaggcaaggttgtggacctcggttgcgggcgaggaggctggtcttattactgtggtggcctgaagaacgtaagagaggtgaaagggttaaccaagggaggccctgggcacgaagagccaatacccatgtcaacatatggatggaatcttgtcaggctgcagagcggcgttgatgtgttcttcacgcctccagagaaatgcgacaccctcctatgtgatatcggtgaatccagtcccaacccgactattgaggcagggcggacactgcgcgtcttgtctctggtggaaaattggctcaacaatgacacccaattttgcatcaaggtacttaacccttacatgccaagcgtgattgagaaaatggaaactctgcagagaaagtacggaggcgccttggttaggaatcccctgtcacgaaactccacacatgagatgtattgggtgagtaatgctaccggcaacatcgtcagctctgtgaatatgatatcccggatgctcattaaccgtttcacgatgaagcacaaaaaggccacctacgagcctgacgtcgatttagggtcaggaacaagaaatatcggtatcgaaagcgagattccaaacctggacataatcggcaaacgcattgaaaagatcaaacaggagcacgaaacttcgtggcattatgatcaggaccacccctacaagacctgggcatatcatgggtcttacgagacaaagcaaactggaagtgcctccagcatggtgaatggcgttgtaaggcttctgaccaaaccgtgggatgtggtccctatggtgacacagatggctatgaccgacactacgccctttggtcagcagcgggttttcaaggagaaagtggatacaagaacccaagaaccaaaggaggggactaaaaagctaatgaagattaccgcggaatggctctggaaagagctgggaaagaaaaagacacctcgcatgtgtacgagggaggaatttacccgaaaagtccggtcaaacgccgcattgggcgctatcttcactgacgagaacaagtggaaatccgccagagaagcagtggaggattctaggttttgggaactggtagacaaggagcgcaatctccaccttgagggcaagtgcgaaacatgtgtgtataacatgatggggaaacgtgagaagaaactgggagaattcggtaaggccaaaggcagccgggctatatggtacatgtggttaggggccagatttctggagttcgaagcgttgggatttctcaatgaggatcactggttcagtagggagaactccctgagcggcgttgaaggtgaggggctacataagcttggatacatcctgcgcgacgtctctaagaaagaaggcggcgcaatgtatgccgacgataccgctgggtgggacactcgaattacactcgaggatctgaagaatgaagagatggtgaccaaccacatggagggagaacataaaaagttggccgaggcaatctttaaactgacataccagaataaggtggtccgggttcagagacccactccaaggggtaccgtgatggacattatctcacgcagagatcagcggggcagtgggcaagtaggaacgtatggcctcaacaccttcacaaatatggaagctcagcttattaggcagatggagggtgagggggtgttcaagtccatacaacgtctgactgtcaccgaagagatcgccgtgcagaactggttagctcgagttggacgcgaaagactgagccggatggccatttctggcgacgattgcgtggtcaaacccttggacgataggtttgcatcggcgctcacagccctgaatgacatgggcaaggtgcgcaaagatatccagcagtgggagccttcaagagggtggaacgactggactcaagtaccattctgcagccaccattttcacgaactaatcatgaaggatggacgggttcttgtggtcccgtgtaggaatcaggacgagctgattggtcgagctcgtatatcccagggcgccgggtggagtctcaaagagaccgcatgcctgggaaagtcttacgctcagatgtggagcttgatgtatttccacagacgcgacttacggctggccgcaaacgccatctgttccgcggtgccctcacattgggtgcctacgagtaggacaacctggtctattcacgctaagcatgaatggatgactacagaggatatgctcaccgtctggaatagagtttggatccaagaaaacccatggatggaggacaaaactcccgtggaaagctgggaggaggtaccttaccttggcaagcgcgaagatcagtggtgcggttccctgattgggctaacctcacgggccacatgggcaaaaaacatccagacggccataaatcaggtgaggagcctgatcggaaacgaggaatataccgactacatgccatctatgaagcgatttagacgggaggaagaggaggctggcgtcctctggtga

SEQ ID NO: 14927 - RNA, 9876 nt, synthetic construct
  misc_feature 1..9876: note = derived and/or modified CDS sequence (opt3) from DENV-2__FM210205__SS-prME
  source 1..9876: mol_type = other RNA
agcgccggcatgatcattatgctgatacccaccgtgatggctttccacctcacaactagaaacggggagcctcatatgatcgtcggaattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagagcaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaagcttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggaaaaaagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttactagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactgccgagtgccccaatacaaacagagcatggaatagtctggaagtggaggattacggatttggcgtgttcaccacaaacatctggctcaagctgaaagaaaagcaggacgcgttttgtgactctaagttaatgagcgctgccattaaagataatagggcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaaactcattaccgagtggtgctgtagatcctgcacactgccgcctcttaggtatcgcggagaggacggctgttggtacggtatggaaatacggccattgaaggagaaagaagagaatctggtgaactcattagttacggcggggcacggacaggtggataatttcagtctcggcgtactgggtatggccctttttctggaagagatgttgagaaccagggtcggcactaagcatgctatcctcctggtggcagtgagcttcgtcacactaattaccgggaacatgtcgtttaaagacctgggacgcgttgtggtaatggtgggcgccactatggctgatgacatcgggatgggagtcacatatctcgccctgcttgcagcgttcaaggtgcgacccacctttgccgctggcttgctgttaaagaaactcacgtccaaggagctgatgatgactaccattggtatcgttcttctgtctcaaagcacaatacctgaaaccgtgctagagctcactgatgccctggcattggggatgatggtcctgaaaatcgtgcggaatatggaaaagtaccagttagctgttacaattatggccatcctctgcgtgcccaacgcagtcattctgcagaatgcctggaaagtatcatgtaccatccttgctgtggttagtgtgtccccactgttgctcacatctagccagcaaaagactgactggatacctctggcgctaaccattaaaggactgaaccccacggccatcttccttacaaccctctcccgtactaataagaagagatcatggccactgaacgaggcaatcatggctgtcggcatggtgagcattttggccagttctctgttaaaaaatgacataccgatgaccggccctctcgtagccgggggactgcttacagtgtgctatgtcctgactggtaggtccgctgatttggaactcgagcgcgcaaccgacgttaagtgggaggatcaggccgaaatcagcggctcgtcacccattctgtctatcacgattagtgaggacgggtccatgagcatcaaaaacgaagaggaggaacagacactaaccatactgatccggactggacttctcgtgatttctggcctgtttccaatcagcattcccatcacagcggctgcctggtacttgtgggaggtgaagaaacagagagcaggtgtcttatgggatgtgccttccccaccccctatggggaaggccgaactggaggacggagcttataggataaagcaaaaaggcattctcggctactcacagatcggggcaggagtttacaaggaaggtaccttccacactatgtggcatgtaacacgaggcgccgtgctgatgcacaaagggaagcgcatcgagccgagttgggcggatgtcaaaaaggaccttattagctatggaggcggttggaagctggagggggaatggaaagagggagaagaggtgcaggttttggctctagaaccaggcaagaatccccgggccgtgcagaccaaacctggcctgtttaagacgaacactgggaccatcggagcagtctctctcgatttctccccaggtacatcaggcagtcccataattgacaaaaaggggaaggtggtaggactgtacggcaacggtgtcgtgaccagaagcggggcctatgtttccgctatcgcccaaacagagaaatctattgaggataatcctgaaatcgaggacgatatatttaggaagcgtcgccttactattatggacttacacccgggagcaggcaaaaccaagcggtacctgcccgctatcgtgagagaagccatcaaaaggggcctccgaacgttgattctggcgccaacacgggtcgtggccgcagagatggaagaggctctccgcgggctgcctatcagatatcagactcccgccattagggctgagcataccggacgggaaatagttgaccttatgtgtcacgcaacattcaccatgcgactgttgtcgccagtgagagtccctaactacaatctaatcattatggatgaggcccatttcactgaccccgccagcatcgctgcgcgcggttatatctcaaccagggtggaaatgggcgaggcagccgggatttttatgacagctacgccaccgggatcccgtgatcctttcccccagagtaacgccccaataatcgacgaggaacgggagattcccgaaagatcttggaatagcggccacgagtgggtaactgattttaagggtaagaccgtgtggttcgttccttccatcaaagcagggaacgacattgccgcttgcctgaggaagaatggaaaaaaggtcatccaactctcacgcaaaacatttgattctgaatacgtgaagacccgaactaacgactgggatttcgtggtcacaaccgacataagcgagatgggcgcgaattttaaagccgagagagtaatcgatccacggaggtgtatgaagcccgtgattttaacggacggcgaagagcgcgttatcctggcagggcctatgccggtgactcatagttccgctgcccagcgtagaggacggattggtaggaacccaaagaatgaaaacgaccagtacatctatatgggcgagccccttgaaaatgatgaggactgcgcacactggaaagaggccaagatgctgctcgataacataaatacacctgaagggattatccccagcatgttcgagccagaacgcgagaaagtcgacgctattgatggagaataccgattgagaggcgaggcccggaagacctttgtggacctgatgaggcgcggtgatctccctgtttggctggcgtataaagtggcagccgaggggatcaactacgctgacagaaggtggtgtttcgatggcataaagaacaatcagatccttgaagagaacgtcgaagtggagatttggaccaaggagggagaacggaaaaagctaaaaccccgttggctggacgcccgcatctattctgatccattggctttaaaggagtttaaagaattcgcagccggccgaaagtcactgactctcaatctgattacagagatggggagacttcctaccttcatgacacaaaagactagggacgctctggataacctcgccgtattgcacacggcagaagcgggaggtcgggcctacaatcatgctctgtccgagctaccggagaccctggaaacactccttctgttaactttgctggccaccgtgacaggcgggatctttctcttcctgatgagtggacgcggcataggtaaaatgacccttgggatgtgctgcattatcactgcaagcatcctgctctggtatgctcagattcagccccactggatcgccgcatcgataattttggagtttttcctgatcgttttactaattccagaacctgagaagcagagaacgccccaagacaaccagctgacctacgtcgtgatcgccatactcacagtggtcgctgcgactatggccaatgaaatgggctttcttgagaaaaccaagaaagacttcggactgggctctatcgcaacacagcagccagagtccaacattttggatatcgacctgaggcctgctagcgcctggaccctctacgccgttgcaactacatttgtgacgcccatgctgcggcattcaattgaaaatagttctgtaaacgtgtcccttaccgctatcgccaatcaagcgactgtcctcatggggctgggaaagggttggccgttgagcaagatggatattggcgtgccactgttagctatcgggtgttattcacaggttaaccctataacactaaccgccgcactgctccttctggtggcccactacgctattatcggacccggcttgcaggcaaaagccacccgagaggcgcagaagagagctgccgcaggtatcatgaaaaatccaacagtcgacgggattactgtaatagatctggaccccatcccttatgatccgaagttcgaaaaacaactcggccaggtgatgctgcttattttatgcgttacgcaggtgctgatgatgcgcaccacatgggccctctgtgaggctttgactctggccaccggacccatcagtacactatgggaaggcaacccagggaggttttggaataccactattgcagtcagcatggctaacatcttccggggatcctacctggccggcgcgggtctccttttttctataatgaagaatacgacaaacacccgtagagggactggaaacatcggcgagaccctgggtgagaaatggaagagcaggttgaatgccctgggcaagtccgaattccaaatttataaaaagtcagggatccaggaggtggaccgcacactcgcaaaagaaggaattaagcggggcgagactgatcaccatgctgtctctcgagggagtgccaaactgagatggtttgtggagaggaacatggttacccctgaaggaaaggtggtagacttaggctgcggtcgcgggggatggtcgtactattgtggcggtcttaagaatgtgcgggaggtcaaaggcctgacaaaggggggacccggccacgaagagcctatcccaatgagcacgtacgggtggaacctcgttagactacagtccggagtggatgtcttcttcataccccctgaaaaatgcgacaccctgttgtgtgatattggcgagtcttcaccaaatcccactgtggaggcaggtcgtacactgagggtactcaaccttgtggaaaattggctgaacaataacacccagttttgcatcaaggttttgaatccgtacatgcctagcgtgatcgagaaaatggaagctctgcaacggaagtatgggggagccctcgtccgcaacccattatcccgaaatagtactcatgagatgtactgggtgtctaacgccagcggcaatattgtctcatccgtgaacatgataagtagaatgctgatcaacaggttcacaatgcggcacaagaaagcgacctatgaacccgacgttgaccttggcagcgggacgcgcaatattggaatcgagtctgagattcctaacctggatatcataggtaagagaatcgaaaaaattaagcaggagcatgaaacctcctggcactacgaccaggatcacccatataaaacatgggcttaccatggctcatatgagactaagcagaccgggagcgcatcgtctatggtaaatggagtggtcaggctactcacaaagccctgggacgtgctgccgactgttacccaaatggccatgacagataccactccttttggccagcagcgagtgttcaaagaaaaggtcgacacgcggacacaggagcccaaagagggtaccaagaaattgatgaagatcactgctgaatggctgtggaaagagctcgggaagaagaaaaccccacgtatgtgtacaagagaagagtttacgcgcaaggtgaggagtaacgccgcacttggagccattttcaccgatgagaataaatggaagtccgctcgggaagcggtagaggacagcagattttgggaactggtggataaagagcgcaacttacacctggaaggcaagtgcgagacttgtgtttacaatatgatgggcaagagggagaaaaagttgggggaattcggaaaagccaagggttcacgagcaatctggtacatgtggctcggcgctcggtttctggagttcgaagccctagggtttcttaacgaggaccattggttctccagagaaaattctctgagcggagtcgagggcgagggtctccacaaactggggtatattttgagggatgtgagtaagaaggaaggaggcgcaatgtacgccgacgacacagctggctgggatacccgcataactctggaggacctcaaaaacgaagagatggtgacaaatcacatggaaggggagcataagaaacttgccgaggcgatctttaagctgacctatcaaaacaaagtcgttcgtgtgcagcggcctacacccagaggaactgtaatggatattatctccaggcgcgaccagcgaggtagcggccaagtggggacctacggattaaatacgttcaccaacatggaagcacagctgatccggcagatggagggcgaaggtgtcttcaagaatattcagcacttgacagtgactgaggaggttgccgtgcaaaactggctcgctagagtcgggagggaacgcctgtctagaatggccatatcaggagatgactgcgtggtaaagccactagatgaccggtttgcaaacgctcttaccgccctgaatgatatgggcaaaatcaggaaggacattcagcagtgggagcccagtaaaggctggaacgattggacacaggttcctttctgctcccatcactttcatgaactcatcatgaaggacgggcgtgtgctggtcgtgccatgtcgaaatcaagatgagttgattggacgcgctagaatcagccagggtgccggctggtctttacgggaaactgcatgcctggggaaatcgtatgcgcagatgtggtcactcatgtacttccacaggcgcgaccttagactggccgctaacgccatatgtagcgcagtgccgtcccactgggtccccaccagtcggacgacatggtctatccatgctaagcacgagtggatgaccactgaggacatgctaacagtttggaatagggtgtggattcgagaaaacccttggatggaggataagaccccagtagaaagctgggaggaaatcccctatctgggaaaacgtgaggaccagtggtgcggctccctcattggtttgacttcaagagccacctgggcaaagaatatccaagccgcgataaaccaggtgcgcagtctgattgggaatgaggaatacacagattacatgccttctatgaaacggtttaggagagaggaagaggaagctggagtcctttggtga

SEQ ID NO: 14928 - RNA, 9876 nt, synthetic construct
  misc_feature 1..9876: note = derived and/or modified CDS sequence (opt3) from DENV-2__FM210206__SS-prME
  source 1..9876: mol_type = other RNA
agcgcaggaatgatcattatgctgatacccaccgtgatggctttccacctcacaactagaaacggggagcctcatatgatcgtcggcattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagcactggtgccccatgtcggtatggggcttgagactcgtaccgaaacatggatgagctccgagggagcgtggaaacacgctcagagaatcgagacttggatactgaggcatcctggcttcaccttgatggccgcaatcctcgcctacacaattggcaccacgcactttcagcgggtgctgatcttcattctgctcactgctgttgcaccatctatgacaatgcgctgcatcgggatatcgaacagagattttgtggaaggagtctcaggtggcagctgggtggacattgtattagagcacgggagttgtgttaccactatggccaagaataagcccacactggatttcgaacttatcaaaaccgaggctaagcagcctgccacgttgaggaaatattgcattgaagcgaagctgaccaacacaactaccgagtcccggtgtccaacacaaggagagccctctctaaaagaagaacaggacaagcgctttgtgtgcaagcatagcatggtcgatcgaggctggggtaatgggtgtggactcttcggcaaaggcgggatcgtgacttgcgcaatgtttacctgcaagaaaaacatggaaggaaagatcgtgcagcctgagaatctggaatacacaattgtcgttaccccacactccggtgaggagcatgccgtgggcaacgacactgggaaacacggaaaggaaataaaagtaacgccgcagtcaagtatcacagaggctgaacttaccggctatggtactgtgaccatggagtgtagccccagaacagggctggatttcaatgaaatggtcttgctccaaatggagaacaaggcctggctggtgcacaggcagtggtttttagacctgcctctcccatggcttcccggcgcagataagcaggagtctaattggattcagaaagaaaccctggttactttcaagaaccctcatgctaaaaagcaagacgtggtcgtgttgggatcccaggagggcgccatgcacacagcgctaacgggggccaccgaaatccagatgtcaagcggaaatctgctctttactggtcatctgaaatgccggcttcgtatggacaagctgcaattgaagggcatgagttactctatgtgtacagggaaattcaaggtagttaaagagatagcagagacccagcacggaacaattgtgatccgcgtccagtatgaaggcgatggttccccatgcaagatccccttcgagattatggacctcgagaagagatacgtgctggggaggttaatcactgtcaacccgattgtgaccgagaaggatagccctgttaacatagaagctgagcccccatttggcgactcgtacatcattatcggagtggagcctggccagctgaagctaaattggttcaaaaaggggtcttccatcggacaaatgtttgaaacgaccatgcggggtgccaaacgaatggctattctcggcgatacagcctgggacttcgggtcactgggaggcgtatttacaagtataggtaaggcacttcatcaggtcttcggggccatctatggcgctgcgtttagcggagtgtcctggaccatgaaaattttgatcggcgttattatcacatggatagggatgaactctcgcagcacttcactgagtgtgtccctcgtcctggtgggaatcgtaaccctttacctgggcgtgatggttcaggcagatagcggttgtgtcgtgtcttggaagaataaggagttgaaatgcgggtcaggaattttcatcacggacaacgtgcacacatggaccgaacagtataagtttcaacccgagagtccaagcaaactcgcctccgctattcagaaggcccaggaagagggcatctgtggtataagatctgtcactaggctggagaatttaatgtggaaacagattacacccgaactgaaccacatcctagcagagaatgaagttaagctcaccattatgactggcgatatcaaagggataatgcaagccggaaagcggtcgctgcgccctcagccaaccgagcttaagtacagctggaaaacatggggcaaggctaaaatgttgtccatcgaatcatataaccagacgttcctgattgacgggccggagaccgccgagtgccccaatactaacagagcatggaatagtctcgaagtggaggattacggatttggcgtgttcacaaccaacatctggctgaagttaaaagaaaagcaggacgcgttttgtgactctaagctgatgagcgctgccattaaagataatagggcagtacatgccgacatgggttattggatcgagtccgctcttaacgatacatggaagatagagaaagcctcattcattgaagtcaagaattgccactggcctaaaagccatactttgtggtctaacggggtgctcgagtccgaaatgatcatcccaaagaacctggcaggacccgttagtcaacacaattaccgtcctggctaccacacccagattgctggtccatggcatctaggcaagctggagatggacttcgatttttgtgacgggacgacagtgatcgtcaccgaagattgcggaaaccggggccccagcctccgaactaccacagcctctgggaaactgattactgagtggtgctgtagatcctgcacccttccgcctttgaggtatcgcggagaggacggctgttggtacggtatggaaatacggccactgaaggagaaagaagagaatttagtgaactcactcgttacagcggggcacggacaggtggataatttcagtctgggcgtacttggtatggccctgtttttggaagagatgctcagaacgagggtcggcaccaagcatgctatcctgctagtggcagtgagcttcgtcactctgattacagggaacatgtcgtttaaagacctcggacgcgttgtggtaatggtgggcgccaccatggctgatgacatcgggatgggagtcacttatctggcccttttggcagcgttcaaggtgcgacccacatttgccgctggcctgttactccggaagctgacctccaaagagcttatgatgacgactattggtatcgttctgctatctcaaagcaccatacctgaaacagtgctcgagctgaccgatgccttggcactggggatgatggtcttaaagatcgtgcgtaatatggaaaaataccagctcgctgttactattatggccatcctgtgcgtgcccaacgcagtcattcttcagaatgcctggaaggtatcatgtacaatcctggctgtggttagtgtgtccccattgctcctgacctctagccagcagaaaactgactggatacctctagcgctgactattaagggacttaaccccaccgccatcttcctcacgacactgtccagaaccaataaaaagaggtcatggccattgaacgaggcaatcatggctgtcggcatggtgagcattctggccagttctttactcaagaatgacataccgatgactggccctctggtagccgggggacttctgaccgtgtgctatgtcttgacaggtcgctccgctgatctcgaactggagcgggcaactgacgttaaatgggaggatcaagccgaaatcagcggctcgtcacccattctatctatcaccattagtgaggacgggtccatgagcatcaagaacgaagaggaggaacagacgctgacaatacttatcagaaccggactcctggtgatttctggcttgtttccaatcagcattcccatcactgcggctgcctggtacttatgggaggtgaaaaagcagagggccggtgtcctgtgggatgtgccttccccaccccctatggggaaagccgaactcgaggacggagcttatcgaataaagcaaaagggcattctgggctactcacagatcggggcaggagtttacaaagaaggtacattccacaccatgtggcatgtaactcgcggcgccgtgcttatgcacaaggggaaacggatcgagccgagttgggcggatgtcaagaaagacctgattagctatggaggcggttggaagttggagggggaatggaaggagggagaagaggtgcaggttctagctctggaaccaggcaaaaatcccagagccgtgcagacaaagcctggcctctttaaaaccaacacggggactatcggagcagtctctctggatttctccccaggtacctcaggcagtcccataattgacaagaaagggaaggtggtaggactttacggcaacggtgtcgtgacaaggagcggggcctatgtttccgctatcgcccaaaccgagaagtctattgaggataatcctgaaatcgaggacgatatatttcgtaaacgccggttaacaattatggacctgcacccgggagcaggcaagactaaaagatacctccccgctatcgtgagggaagccatcaagcgaggcttgcggaccctgattctcgcgccaacgcgcgtcgtggccgcagagatggaagaggctctgagagggcttcctatcaggtatcagacacccgccattcgggctgagcatactggacgagaaatagttgacctgatgtgtcacgcaaccttcacaatgagattgctatcgccagtgcgcgtccctaactacaatctgatcattatggatgaggcccatttcaccgaccccgccagcatcgctgcgaggggttatatctcaactcgtgtggaaatgggcgaggcagccgggatttttatgaccgctacaccaccgggatcccgggatcctttcccccagagtaacgccccaataatcgacgaggaaagagagattcccgaaaggtcttggaatagcggccacgagtgggtaacggattttaaaggtaagactgtgtggttcgttccttccatcaaggcagggaacgacattgccgcttgcctccgcaaaaatggaaagaaagtcatccaattatcacgaaagacctttgattctgaatacgtgaaaacaagaaccaacgactgggatttcgtggtcactacagacataagcgagatgggcgcgaattttaaggccgagcgggtaatcgatccaaggcgctgtatgaaacccgtgattctgaccgacggcgaagaacgtgttatccttgcagggcctatgccggtgacgcatagttccgctgcccagagacggggaaggattggtcgcaacccaaagaatgaaaacgaccagtacatctatatgggcgagcccctggaaaatgatgaggactgcgcacactggaaggaggccaaaatgctcttggataacataaatactcctgaagggattatccccagcatgttcgagccagaacgagagaaggtcgacgctattgatggagaatacagactgcggggcgaggccaggaaaacatttgtggacctcatgcgcagaggtgatctgcctgtttggcttgcgtataaggtggcagccgaggggatcaactacgctgacaggcggtggtgtttcgatggcatcaaaaacaatcagatcctagaagagaacgtcgaagtggagatttggaccaaggagggagaacgtaagaaactgaagccccgctggttggacgcccgaatctattctgatccattagctctgaaagagtttaaggagttcgcagccggcagaaaatcactcaccctgaatcttattactgagatggggaggctgcctacattcatgacccaaaagacacgggacgctctcgataacttggccgtactgcacactgcagaagcgggaggtcgcgcctacaatcatgctctatccgagctgccggagacgctcgaaacccttctgttattgacactgctcgccactgtgaccggcgggatctttctgttccttatgagtggaagaggcataggtaagatgacactggggatgtgctgcattatcaccgcaagcatcctcttgtggtatgctcagattcagccccactggatcgccgcatcgataattctggagtttttcttaatcgttctactgattccagaacctgagaaacagaggactccccaagacaaccagctcacgtacgtcgtgatcgccatacttaccgtggtcgctgcgacaatggccaatgaaatgggctttctggagaagactaaaaaggacttgggactgggctctatcgcaacccagcagccagagtccaacattctcgatatcgacctgcggcctgctagcgcctggacactttacgccgttgcaaccactttcgtgacacccatgctccgacattcaattgaaaatagttctgtaaacgtgtccctgacggctatcgccaatcaagcgaccgtcttgatggggctgggaaaaggttggccgttaagcaagatggatattggcgtgccactactggctatcgggtgttattcacaggttaaccctataactctcacagccgcacttctgttgctggtggcccactacgctattatcggacccggcctccaggcaaaggccaccagagaggcgcagaaacgcgctgccgcaggtatcatgaagaatccaaccgtcgacgggattacagtaatagatctggaccccatcccttatgatccgaaatttgaaaagcaacttggccaggtgatgttactgattctctgcgttactcaggtgttgatgatgaggacgacctgggccctgtgtgaggctctaacactggccactggacccatcagtaccctctgggaaggcaacccagggcggttctggaatacaaccattgcagtcagcatggctaacatctttcgtggatcctaccttgccggcgcgggtctgttgttctctataatgaaaaatactacgaacacaagaagggggaccggaaacatgggcgagactctgggtgagaagtggaaaagccgcctcaatgccctgggcaagtccgaatttcaaatctataagaaatcagggattcaggaggtggaccggaccttagcaaaggaaggaatcaaacgaggcgagacagatcaccatgctgtctctagagggagtgccaaacttaggtggttcgtggagcgcaacatggttactcctgaaggaaaagtggtagacctgggctgcggtagagggggatggtcgtactattgtggcggtctcaagaatgtgagagaggtcaagggcctaaccaaagggggacccggccacgaagaacctattccaatgagcacatacgggtggaacctggttcgtttgcagtccggagtggatgtctttttcataccccctgaaaagtgcgacacgctgctctgtgatataggcgagtcttcaccaaatcccaccgtggaggcaggtaggactcttcgggtactgaacttggtggaaaattggctgaacaataacacacagttctgcattaaagttctcaatccgtacatgcctagcgtgatcgagaagatggaggctttacaacgcaaatatgggggagccctggtccgaaacccactttccagaaatagtacccatgagatgtactgggtgtctaacgccagcggcaatatcgtctcatccgtgaacatgattagtaggatgctgataaaccggtttactatgcgccacaagaaggcgacatatgaacccgacgttgacctaggcagcgggaccagaaatatcggaattgagtctgagatccctaacctcgatattatcggtaaaaggatagaaaagatcaaacaggagcatgaaacgtcctggcactacgaccaggatcacccatataagacctgggcttaccatggctcatatgagacaaaacagactgggagcgcatcgtctatggtaaatggagtggtccgactgttgaccaagccctgggacgtgctgccgacagttactcaaatggccatgaccgatacaacccctttcggccagcagcgggtgtttaaggaaaaagtcgacactcgtacgcaggagcccaaggagggtactaaaaagctcatgaaaattaccgctgaatggctttggaaggagctggggaaaaagaagactccaagaatgtgtacccgcgaagagttcacaaggaaagtgcggagtaacgccgcattaggagccatctttacggatgagaataagtggaaatccgctagagaagcggtagaggacagccgcttctgggaactggtggataaggagaggaacttgcacctcgaaggcaaatgcgagacctgtgtttacaatatgatgggcaagcgagagaagaaactgggggaatttggaaaggccaaaggttcacgggcaatttggtacatgtggctaggcgctagattccttgagtttgaagccctggggttcctcaacgaggaccattggttttccagggaaaattctctgagcggagtcgagggcgagggtttgcacaagctggggtatatcctccgcgatgtgagtaaaaaggaaggaggcgcaatgtacgccgacgacactgctggctgggatacacgtattacccttgaggacctgaagaacgaagagatggtgactaatcacatggaaggggagcataaaaagttagccgaggcgatattcaaactgacatatcaaaacaaggtcgttcgggtgcagagacctacccccaggggaacagtaatggatatcatttcccgccgagaccagcggggtagcggccaagtggggacttacggattgaatacctttacgaacatggaagcacagctcatcagacagatggagggcgaaggtgtcttcaaaaatatccagcacctgaccgtgacagaggaggttgccgtgcaaaactggctagctagggtcgggcgcgaaagactttctcggatggccatttcaggagatgactgcgtggtaaagccactggatgacaggttcgcaaacgctctcactgccctgaatgatatgggcaagatacgtaaagacatccagcagtgggagcccagtaagggctggaacgattggacccaggttcctttttgctcccatcacttccatgaattgattatgaaagacgggcgagtgttagtcgtgccatgtcgcaatcaagatgagctgatcggacgggctcggattagccagggtgccggctggtctctcagggaaacagcatgccttgggaagtcgtatgcgcagatgtggtcactgatgtactttcaccgcagagacctacggctggccgctaacgccatctgtagcgcagtgccgtcccactgggtccccacaagtaggaccacgtggtctatacatgctaaacacgagtggatgacaaccgaggacatgctcactgtttggaatcgagtgtggatccgtgaaaacccttggatggaggataagacaccagtagaaagctgggaggaaattccctatttgggaaagagagaggaccagtggtgcggctccctgatcggtcttacctcacgcgccacttgggccaaaaatattcaagccgcgatcaaccaggtgcggagtctgatagggaatgaggaatacaccgattacatgccttctatgaagaggttcagacgcgaggaagaggaagctggagtcctctggtga

SEQ ID NO: 14929 - RNA, 9876 nt, synthetic construct
  misc_feature 1..9876: note = derived and/or modified CDS sequence (opt3) from DENV-2__FM210246__SS-prME
  source 1..9876: mol_type = other RNA
agcgcaggcatgatcattatgctgatacccaccgtgatggctttccacctcactactagaaacggggaacctcatatgatcgtcggtattcaagaaaagggaaaatcccttctgtttaagacggaggacggcgttaatatgtgcaccttgatggcaatggatttaggggaactgtgtgaggacacgatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcattcaaccagacctttttgattgacgggccggagactgccgagtgccccaatacaaacagagcatggaatagtctggaagtggaggattatggattcggcgtgtttaccacaaacatctggctcaagctgaaagaaaagcaggacgcgttctgtgactctaagttaatgagcgctgccattaaagataatagggcagtacatgccgacatgggttactggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcaacacaattatcgtcctggctaccacacgcagattgctggtccatggcatctgggcaagctagagatggactttgatttctgtgacgggacaaccgtgatcgtcactgaagattgcggaaaccggggccccagcctgcgaaccacaactgcctctgggaaactcattaccgagtggtgctgtagatcctgcacactgccgcctcttaggtaccgcggagaggacggctgttggtatggtatggaaatacggccattgaaggagaaagaagagaatctggtgaactcattagttacggcggggcacggacaggtggataattttagtctcggcgtactgggtatggcccttttcctggaagagatgttgagaaccagggtcggcactaagcatgctatcctcctggtggcagtgagctttgtcacactaattaccgggaacatgtcgttcaaagacctgggacgcgttgtggtaatggtgggcgccactatggctgatgacatcgggatgggagtcacatacctcgccctgcttgcagcgtttaaggtgcgacccaccttcgccgctggcttgctgttacggaagctcacgtccaaagagctgatgatgactaccattggtatcgttcttctgtctcaaagcacaatacctgaaaccgtgctagagctcactgatgccctggcattggggatgatggtcctgaagatcgtgcgtaatatggaaaaatatcagttagctgttacaattatggccatcctctgcgtgcccaacgcagtcattctgcagaatgcctggaaggtatcatgtaccatccttgctgtggttagtgtgtccccactgttgctcacatctagccagcagaaaactgactggatacctctggcgctaaccattaagggactgaaccccacggccatctttcttacaaccctctccagaactaataaaaagaggtcatggccactgaacgaggcaatcatggctgtcggcatggtgagcattttggccagttctctgttaaagaatgacataccgatgaccggccctctcgtagccgggggactgcttacagtgtgctacgtcctgactggtcgctccgctgatttggaactcgagcgggcaaccgacgttaaatgggaggatcaggccgaaatcagcggctcgtcacccattctgtctatcacgattagtgaggacgggtccatgagcatcaagaacgaagaggaggaacagacactaaccatactgatcagaactggacttctcgtgatttctggcctgttcccaatcagcattcccatcacagcggctgcctggtatttgtgggaggtgaaaaagcagagggccggtgtcttatgggatgtgccttccccaccccctatggggaaagccgaactggaggacggagcttaccgaataaagcaaaagggcattctcggctattcacagatcggggcaggagtttacaaagaaggtacctttcacactatgtggcatgtaacacgcggcgccgtgctgatgcacaaggggaaacggatcgagccgagttgggcggatgtcaagaaagaccttattagctacggaggcggttggaagctggagggggaatggaaggagggagaagaggtgcaggttttggctctagaaccaggcaaaaatcccagagccgtgcagaccaagcctggcctgttcaaaacgaacactgggaccatcggagcagtctctctcgatttttccccaggtacatcaggcagtcccataattgacaagaaagggaaggtggtaggactgtatggcaacggtgtcgtgaccaggagcggggcctacgtttccgctatcgcccaaacagagaagtctattgaggataatcctgaaatcgaggacgatatattccgtaaacgccggcttactattatggacttacacccgggagcaggcaagaccaaaagatatctgcccgctatcgtgagggaagccatcaagcgaggcctccggacgttgattctggcgccaacacgcgtcgtggccgcagagatggaagaggctctcagagggctgcctatcaggtaccagactcccgccattcgggctgagcataccggacgagaaatagttgaccttatgtgtcacgcaacattcaccatgagactgttgtcgccagtgcgcgtccctaactataatctaatcattatggatgaggcccattttactgaccccgccagcatcgctgcgaggggttacatctcaacccgtgtggaaatgggcgaggcagccgggattttcatgacagctacgccaccgggatcccgggatccttttccccagagtaacgccccaataatcgacgaggaaagagagattcccgaaaggtcttggaatagcggccacgagtgggtaactgatttcaaaggtaagaccgtgtggtttgttccttccatcaaggcagggaacgacattgccgcttgcctgcgcaaaaatggaaagaaagtcatccaactctcacgaaagacattcgattctgaatatgtgaaaaccagaactaacgactgggattttgtggtcacaaccgacataagcgagatgggcgcgaatttcaaggccgagcgggtaatcgatccaaggcgctgtatgaaacccgtgattttaacggacggcgaagaacgtgttatcctggcagggcctatgccggtgactcatagttccgctgcccagagacggggaaggattggtcgcaacccaaagaatgaaaacgaccagtacatctacatgggcgagccccttgaaaatgatgaggactgcgcacactggaaggaggccaaaatgctgctcgataacataaatacacctgaagggattatccccagcatgtttgagccagaacgagagaaggtcgacgctattgatggagaatatagattgcggggcgaggccaggaaaaccttcgtggacctgatgcgcagaggtgatctccctgtttggctggcgtacaaggtggcagccgaggggatcaactatgctgacaggcggtggtgttttgatggcatcaaaaacaatcagatccttgaagagaacgtcgaagtggagatttggaccaaggagggagaacgtaagaaactaaagccccgctggctggacgcccgaatctactctgatccattggctttaaaagagttcaaggagttcgcagccggcagaaaatcactgactctcaatctgattacagagatggggaggcttcctacctttatgacacaaaagactcgggacgctctggataacctcgccgtattgcacacggcagaagcgggaggtcgcgcctataatcatgctctgtccgagctaccggagaccctggaaacactccttctgttaactttgctggccaccgtgacaggcgggatcttcctctttctgatgagtggaagaggcataggtaagatgacccttgggatgtgctgcattatcactgcaagcatcctgctctggtacgctcagattcagccccactggatcgccgcatcgataattttggagttctttctgatcgttttactaattccagaacctgagaaacagaggacgccccaagacaaccagctgacctatgtcgtgatcgccatactcacagtggtcgctgcgactatggccaatgaaatgggcttccttgagaagaccaaaaaggacctgggattgggctctatcgcaacacagcagccagagtccaacattctggatatcgacctccggcctgctagcgcctggaccctgtacgccgttgcaactacatttgtgacgcccatgcttcgacattcaattgaaaatagttctgtaaacgtgtccctcaccgctatcgccaatcaagcgactgtcctgatggggttgggaaaaggttggccgctgagcaagatggatattggcgtgccattactagctatcgggtgttactcacaggttaaccctataacactgaccgccgcactccttctgttggtggcccactatgctattatcggacccggcctgcaggcaaaggccaccagagaggcgcagaaacgcgctgccgcaggtatcatgaagaatccaacagtcgacgggattactgtaatagatctcgaccccatcccttacgatccgaaattcgaaaagcaactgggccaggtgatgcttttaattctgtgcgttacacaggtgctcatgatgaggaccacatgggccttgtgtgaggctctgactctagccaccggacccatcagtacactgtgggaaggcaacccagggcggttttggaataccactattgcagtcagcatggctaacatcttccgtggatcctatctcgccggcgcgggtcttctgttttctataatgaaaaatacgacaaacaccagaagggggactggaaacatgggcgagaccttgggtgagaagtggaaaagccgcctgaatgccctcggcaagtccgagttccaaatctacaagaaatcagggattcaggaggtggaccggacactggcaaaggaaggaatcaaacgaggcgagactgatcaccatgctgtctctagagggagtgccaagttaaggtggtttgtggagcgcaacatggttacccctgaaggaaaagtggtagaccttggctgcggtagagggggatggtcgtattactgtggcggtctgaagaatgtgagagaggtcaagggcctcacaaaagggggacccggccacgaagaacctattccaatgagcacgtatgggtggaacctagttcgtctgcagtccggagtggatgtcttcttcataccccctgaaaagtgcgacaccttgctgtgtgatataggcgagtcttcaccaaatcccactgtggaggcaggtaggacactccgggtacttaacctggtggaaaattggttgaacaataacacccagttttgcattaaagttctgaatccgtacatgcctagcgtgatcgagaagatggaagctctccaacgcaaatacgggggagccttagtccgaaacccactgtccagaaatagtactcatgagatgtattgggtgtctaacgccagcggcaatatcgtctcatccgtgaacatgattagtaggatgcttataaaccggttcacaatgcgccacaagaaggcgacctacgaacccgacgttgacctgggcagcgggacgagaaatatcggaattgagtctgagatccctaacctagatattatcggtaaaaggatagaaaagatcaaacaggagcatgaaacctcctggcactatgaccaggatcacccatacaagacatgggcttatcatggctcatacgagactaaacagaccgggagcgcatcgtctatggtaaatggagtggtccgactcctgacaaagccctgggacgtgttgccgactgttacccaaatggccatgacagataccactccttttggccagcagcgggtgttcaaggaaaaagtcgacacgcgtacacaggagcccaaggagggtaccaaaaagctgatgaaaattactgctgaatggctctggaaggagcttgggaaaaagaagaccccaagaatgtgtacacgcgaagagtttacgaggaaagtgcggagtaacgccgcactgggagccatcttcaccgatgagaataagtggaaatccgctagagaagcggtagaggacagccgcttttgggaattagtggataaggagaggaacctgcacttggaaggcaaatgcgagacttgtgtttataatatgatgggcaagcgagagaagaaactcggggagttcggaaaggccaaaggttcacgggcaatttggtacatgtggctgggcgctagatttctagagttcgaagcccttgggtttctgaacgaggaccattggttctccagggaaaattctctcagcggagtcgagggcgagggtctgcacaagttggggtacatcctgcgcgatgtgagtaaaaaggaaggaggcgcaatgtatgccgacgacacagctggctgggatacccgtattactctcgaggaccttaagaacgaagagatggtgacaaatcacatggaaggggagcataaaaagctggccgaggcgatatttaaattaacctaccaaaacaaggtcgttcgggtgcagagacctacacccaggggaactgtaatggatatcatttcccgccgagaccagcggggtagcggccaagtggggacctatggactgaatacgttcaccaacatggaagcacagttgatcagacagatggagggcgaaggtgtcttcaaaaatatccagcacctcacagtgactgaggaggttgccgtgaagaactggctggctagggtcgggcgcgaaagactatctcggatggccatttcaggagatgactgcgtggtaaagccacttgatgacaggtttgcaaacgctctgaccgccctcaatgatatgggcaaaatacgtaaggacatccaacagtgggagcccagtaaaggctggaacgattggacacaggttcctttctgctcccatcactttcatgaactgattatgaaggacgggcgagtgttggtcgtgccatgtcgcaatcaggatgagttaatcggacgggctcggattagccaaggtgccggctggtctctgagggaaactgcatgcctcgggaaatcgtacgcgcagatgtggtcacttatgtatttccaccgcagagacctgcggctagccgctaacgccatctgtagcgcagtgccgtcccactgggtccccaccagtaggacgacatggtctatacatgctaagcacgagtggatgaccactgaggacatgctgacagtttggaatcgagtgtggatccgtgaaaacccttggatggaggataagaccccagtagaaagctgggaggaaattccctacctcggaaaaagagaggaccagtggtgcggctccttgatcggtctgacttcacgcgccacctgggcaaagaatattcaggccgcgatcaaccaagtgcggagtcttatagggaatgaggaatatacagattacatgccttctatgaaaaggtttagacgcgaggaagaggaagctggagtcctgtggtga

SEQ ID NO: 14930 - RNA, 9876 nt, synthetic construct
  misc_feature 1..9876: note = derived and/or modified CDS sequence (opt3) from DENV-2__FM210207__SS-prME
  source 1..9876: mol_type = other RNA
agcgcaggcatgatcattatgctgatacccaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacacgatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagcactggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactgccgagtgccccaatacaaacagagcatggaatagtctggaagtggaggattacggatttggcgtgttcaccacaaacatctggctcaagctgaaagaaaagcaggacgcgttttgtgactctaagttaatgagcgctgccattaaagataatagggcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaaactcattaccgagtggtgctgtagatcctgcacactgccgcctcttaggtatcgcggagaggacggctgttggtacggtatggaaatacggccattgaaggagaaagaagagaatctggtgaactcattagttacggcggggcacggacaggtggataatttcagtctcggcgtactgggtatggccctttttctggaagagatgttgagaaccagggtcggcactaagcatgctatcctcctggtggcagtgagcttcgtcacactaattaccgggaacatgtcgtttaaagacctgggacgcgttgtggtaatggtgggcgccactatggctgatgacatcgggatgggagtcacatatctcgccctgcttgcagcgttcaaggtgcgacccacctttgccgctggcttgctgttacggaagctcacgtccaaagagctgatgatgactaccattggtatcgttcttctgtctcaaagcacaatacctgaaaccgtgctagagctcactgatgccctggcattggggatgatggtcctgaagatcgtgcgtaatatggaaaaataccagttagctgttacaattatggccatcctctgcgtgcccaacgcagtcattctgcagaatgcctggaaggtatcatgtaccatccttgctgtggttagtgtgtccccactgttgctcacatctagccagcagaaaactgactggatacctctggcgctaaccattaagggactgaaccccacggccatcttccttacaaccctctccagaactaataaaaagaggtcatggccactgaacgaggcaatcatggctgtcggcatggtgagcattttggccagttctctgttaaagaatgacataccgatgaccggccctctcgtagccgggggactgcttacagtgtgctatgtcctgactggtcgctccgctgatttggaactcgagcgggcaaccgacgttaaatgggaggatcaggccgaaatcagcggctcgtcacccattctgtctatcacgattagtgaggacgggtccatgagcatcaagaacgaagaggaggaacagacactaaccatactgatcagaactggacttctcgtgatttctggcctgtttccaatcagcattcccatcacagcggctgcctggtacttgtgggaggtgaaaaagcagagggccggtgtcttatgggatgtgccttccccaccccctatggggaaagccgaactggaggacggagcttatcgaataaagcaaaagggcattctcggctactcacagatcggggcaggagtttacaaagaaggtaccttccacactatgtggcatgtaacacgcggcgccgtgctgatgcacaaggggaaacggatcgagccgagttgggcggatgtcaagaaagaccttattagctatggaggcggttggaagctggagggggaatggaaggagggagaagaggtgcaggttttggctctagaaccaggcaaaaatcccagagccgtgcagaccaagcctggcctgtttaaaacgaacactgggaccatcggagcagtctctctcgatttctccccaggtacatcaggcagtcccataattgacaagaaagggaaggtggtaggactgtacggcaacggtgtcgtgaccaggagcggggcctatgtttccgctatcgcccaaacagagaagtctattgaggataatcctgaaatcgaggacgatatatttcgtaaacgccggcttactattatggacttacacccgggagcaggcaagaccaaaagatacctgcccgctatcgtgagggaagccatcaagcgaggcctccggacgttgattctggcgccaacacgcgtcgtggccgcagagatggaagaggctctcagagggctgcctatcaggtatcagactcccgccattcgggctgagcataccggacgagaaatagttgaccttatgtgtcacgcaacattcaccatgagactgttgtcgccagtgcgcgtccctaactacaatctaatcattatggatgaggcccatttcactgaccccgccagcatcgctgcgaggggttatatctcaacccgtgtggaaatgggcgaggcagccgggatttttatgacagctacgccaccgggatcccgggatcctttcccccagagtaacgccccaataatcgacgaggaaagagagattcccgaaaggtcttggaatagcggccacgagtgggtaactgattttaaaggtaagaccgtgtggttcgttccttccatcaaggcagggaacgacattgccgcttgcctgcgcaaaaatggaaagaaagtcatccaactctcacgaaagacatttgattctgaatacgtgaaaaccagaactaacgactgggatttcgtggtcacaaccgacataagcgagatgggcgcgaattttaaggccgagcgggtaatcgatccaaggcgctgtatgaaacccgtgattttaacggacggcgaagaacgtgttatcctggcagggcctatgccggtgactcatagttccgctgcccagagacggggaaggattggtcgcaacccaaagaatgaaaacgaccagtacatctatatgggcgagccccttgaaaatgatgaggactgcgcacactggaaggaggccaaaatgctgctcgataacataaatacacctgaagggattatccccagcatgttcgagccagaacgagagaaggtcgacgctattgatggagaatacagattgcggggcgaggccaggaaaacctttgtggacctgatgcgcagaggtgatctccctgtttggctggcgtataaggtggcagccgaggggatcaactacgctgacaggcggtggtgtttcgatggcatcaaaaacaatcagatccttgaagagaacgtcgaagtggagatttggaccaaggagggagaacgtaagaaactaaagccccgctggctggacgcccgaatctattctgatccattggctttaaaagagtttaaggagttcgcagccggcagaaaatcactgactctcaatctgattacagagatggggaggcttcctaccttcatgacacaaaagactcgggacgctctggataacctcgccgtattgcacacggcagaagcgggaggtcgcgcctacaatcatgctctgtccgagctaccggagaccctggaaacactccttctgttaactttgctggccaccgtgacaggcgggatctttctcttcctgatgagtggaagaggcataggtaagatgacccttgggatgtgctgcattatcactgcaagcatcctgctctggtatgctcagattcagccccactggatcgccgcatcgataattttggagtttttcctgatcgttttactaattccagaacctgagaaacagaggacgccccaagacaaccagctgacctacgtcgtgatcgccatactcacagtggtcgctgcgactatggccaatgaaatgggctttcttgagaagaccaaaaaggacctgggattgggctctatcgcaacacagcagccagagtccaacattctggatatcgacctccggcctgctagcgcctggaccctgtacgccgttgcaactacattcgtgacgcccatgcttcgacattcaattgaaaatagttctgtaaacgtgtccctcaccgctatcgccaatcaagcgactgtcctgatggggttgggaaaaggttggccgctgagcaagatggatattggcgtgccattactagctatcgggtgttattcacaggttaaccctataacactgaccgccgcactccttctgttggtggcccactacgctattatcggacccggcctgcaggcaaaggccaccagagaggcgcagaaacgcgctgccgcaggtatcatgaagaatccaacagtcgacgggattactgtaatagatctcgaccccatcccttatgatccgaaatttgaaaagcaactgggccaggtgatgcttttaattctgtgcgttacacaggtgctcatgatgaggaccacatgggccttgtgtgaggctctgactctagccaccggacccatcagtacactgtgggaaggcaacccagggcggttctggaataccactattgcagtcagcatggctaacatctttcgtggatcctacctcgccggcgcgggtcttctgttctctataatgaaaaatacgacaaacaccagaagggggactggaaacatgggcgagaccttgggtgagaagtggaaaagccgcctgaatgccctcggcaagaacgaatttcaaatctataagaaatccgggattcaggaggtggaccggacactggcaaaggaaggaatcaaacgaggcgagactgatcaccatgctgtctcaagagggtctgccaagttaaggtggttcgtggagcgcaatatggttacccctgaaggaaaagtggtagaccttggctgcggtagagggggatggagttactattgtggcggtctgaagaacgtgagagaggtcaagggcctcacaaaagggggacccggccacgaggaacctattccaatgtcgacgtacgggtggaatctagttcgtctgcagagcggagtggatgtctttttcataccccctgaaaagtgcgacaccttgctgtgtgatataggcgagtcctctccaaaccccactgtggaggcaggtaggacactccgggtacttaatctggtggaaaactggttgaataacaatacccagttctgcattaaagttctgaacccgtacatgccttcagtgatcgagaagatggaagctctccaacgcaaatatgggggagccttagtccgaaatccactgagcagaaactccactcatgagatgtactgggtgagtaatgcctctggcaacatcgtcagctcagtgaacatgatttccaggatgcttataaatcggtttacaatgcgccacaagaaggcgacctatgaacccgacgttgacctgggcagtgggacgagaaacatcggaattgagagcgagatccctaatctagatattatcggtaaaaggatagaaaagatcaaacaggagcatgaaacctcttggcactacgaccaggatcacccatataagacatgggcttaccatggctcctatgagactaaacagaccgggtcagcaagctcgatggtaaacggagtggtccgactcctgacaaagccctgggacgtgttgccgactgttacccaaatggccatgacagataccactcctttcggccagcagcgggtgtttaaggaaaaagtcgacacgcgtacacaggagcccaaggagggtaccaaaaagctgatgaaaattactgctgaatggctctggaaggagcttgggaaaaagaagaccccaagaatgtgtacacgcgaagagttcacgaggaaagtgcggtctaatgccgcactgggagccatctttaccgatgagaacaagtggaaaagtgctagagaagcggtagaggactcccgcttctgggaattagtggataaggagaggaatctgcacttggaaggcaaatgcgagacttgtgtttacaacatgatgggcaagcgagagaagaaactcggggaatttggaaaggccaaaggtagccgggcaatttggtacatgtggctgggcgctagattcctagagtttgaagcccttgggttcctgaatgaggaccattggttttcaagggaaaactccctctctggagtcgagggcgagggtctgcacaagttggggtatatcctgcgcgatgtgagcaaaaaggaaggaggcgcaatgtacgccgacgacacagctggctgggatacccgtattactctcgaggaccttaagaatgaagagatggtgacaaaccacatggaaggggagcataaaaagctggccgaggcgatattcaaattaacctatcaaaataaggtcgttcgggtgcagagacctacacccaggggaactgtaatggatatcattagtcgccgagaccagcggggttccggccaagtggggacctacggactgaacacgtttaccaatatggaagcacagttgatcagacagatggagggcgaaggtgtcttcaaaaacatccagcacctcacagtgactgaggaggttgccgtgcaaaactggctggctagggtcgggcgcgaaagactaagccggatggccatttctggagatgactgcgtggtaaagccacttgatgacaggttcgcaaatgctctgaccgccctcaacgatatgggcaagatacgtaaagacatccagcagtgggagccctcaaagggctggaatgattggacacaggttcctttttgcagtcatcacttccatgaactgattatgaaagacgggcgagtgttggtcgtgccatgtcgcaaccaagatgagttaatcggacgggctcggatttcccagggtgccggctggagcctgagggaaactgcatgcctcgggaagtcttatgcgcagatgtggtcgcttatgtactttcaccgcagagacctgcggctagccgctaatgccatctgttcagcagtgccgagccactgggtccccacctccaggacgacatggagtatgcatgctaaacacgagtggatgaccactgaggacatgctgacagtttggaaccgagtgtggatacgtgaaaatccttggatggaggataagaccccagtagaatcttgggaggaaatcccctatctcggaaagagagaggaccagtggtgcggcagcttgattggtctgacttcccgcgccacctgggccaaaaacatccaagccgcgattaatcaggtgcggtcacttatcgggaacgaggaatacacagattacatgcctagtatgaagaggttcagacgcgaggaagaggaagctggagtcctgtggtga

SEQ ID NO: 14931 - RNA, 9876 nt, synthetic construct
  misc_feature 1..9876: note = derived and/or modified CDS sequence (opt3) from DENV-2__FM210238__SS-prME
  source 1..9876: mol_type = other RNA
accgccggcatgataattatgctgatacccacagctatggcattccacctcactacgaggaacggggagcctcatatgatcgtgggaaggcaggaaaagggtaaaagccttctgtttaagaccgaggacggcgtcaatatgtgcacattgatggccattgatttaggggaactgtgtgaggacactatcacctacaaatgcccattactccggcaaaacgaaccggaggatattgactgttggtgcaattccacatctacctgggttacttatggaacatgtaccacgactggcgagcaccgccgagaaaagcgttcagtggcgctggtaccccatgtgggtatggggcttgagacccggacagaaacttggatgagtagcgagggagcttggaaacacgcccagaggatcgagacctggatactgcggcatcctggcttcacaatcatggcagccattttggcttacaccgtcggcacgactcactttcagcgcgcactcatcttcattctgctggccgctgtggccccatccatgacaatgcgttgcatcgggatatctaacagggattttgttgaaggagtgtcgggtggctcatgggtcgacattgtgctcgagcacgggagctgtgtaaccactatggcgaagaataagcccacattagatttcgaactgatcaaaaccgaggcaaagcagcctgccacgcttcggaaatattgcattgaagctaagttgaccaacacaactaccgagagtcgctgtccaacacaaggagagccctccctgaatgaggaacaggacaaacgatttgtttgcaagcattctatggtggatagaggctggggtaacgggtgtggactattcggcaagggcgggatcgtcacttgcgccatgtttacctgcaaaaagaatatggaaggaaaaatcgtgcagcctgagaacctcgaatacacaattgtgataaccccacacagcggtgaggagcatgcagtcggcaatgacactgggaagcacggaaaagaaatcaagattacgccgcagtcccccatcacagaggctgaactgaccggctatggtactgttaccatggagtgttcacctaggacagggcttgatttcaacgaaatggtgctgttgcaaatggaggacaaagcctggctcgtacaccggcagtggtttctggatttaccactgccctggctccctggcgcggacacccagggaagtaattggatacagaaggagactcttgtgacattcaagaacccacatgccaaaaagcaagacgtcgtggttctgggcagccaggaaggggcaatgcacacggctttgaccggagccactgagattcagatgtcttccggtaatctactgtttacaggccatctcaaatgccgtctgcgcatggataaacttcaactgaaagggatgtcatacagcatgtgtaccggaaagttcaagatcgtgaaagaaatcgctgagacacagcacggcactattgtcatcagagtgcagtatgagggtgacgggagtccctgcaagattccgttcgaaataatggatttggagaaaaggcatgtactcggccggctgatcaccgttaaccctattgtgacggaaaaggactctcccgtcaacatcgaggccgaaccaccttttggagattcctacatcattataggcgtggagcccgggcagttaaaactgaattggttcaagaagggaagctcgatcggtcaaatgtttgagaccacaatgcgaggcgcaaaacgcatggccattctaggggacactgcttgggatttcggatctctcggcggtgtctttacctccatcgggaaggcgctgcaccaggtgttcggcgcaatttacggagccgctttttcaggcgttagttggacaatgaaaatccttataggggtgatcattacttggatcggaatgaacagcagatccacctctttgagcgtatcactggtcctcgtgggcgttattacgctgtatcttggtgccatggtgcaggcagacagtgggtgtgtcgtgtcctggaagaataaagaactgaagtgcggaagcggcatcttcataacagataacgtacacacctggactgagcagtacaagtttcaaccagaatctccctcaaaattggccagtgctattcagaaggcccatgaggaaggtatctgtggcattaggagcgtgacacggctcgagaatctgatgtggaaacagatcacccctgagttaaaccacatactgtccgaaaatgaggttaagctaactatcatgaccggggacattaaaggaatcatgcaggcaggcaagcgctctctcagaccacaaccgacagaactgaaatattcgtggaagacgtgggggaaggcgaaaatgcttagcaccgagtcccataaccagactttcttgattgatggacccgaaacagctgagtgccctaataccaacagggcctggaactcactggaggtcgaagactacggctttggtgtgttcacaactaacatctggctcaagctgcgtgagaaacaggacgtgttttgtgatagtaagttaatgtctgcagccataaaagacaatcgggctgtccacgccgatatggggtattggattgaaagcgcactgaacgacacctggaagatggagaaggcttccttcatcgaggttaaatcatgccactggccaaagagccatacgctttggtctaatggagtgttggaatccgagatgatcattcccaaaagtttcgccggccctgtgagccagcacaactaccgaccaggttattacacacaaaccgcgggcccctggcatctcgggaagctggaaatggattttgacttctgtgagggaactaccgtagtcgtgacagaagattgcggcaacagagggccgtctctaaggactaccacagcctccggaaaactgatcacggagtggtgctgtcgctcatgcaccctccctccactgcggtacagaggcgaggacggttgttggtatgggatggaaattaggccccttaaggagaaggaagagaatttggttaacagtctggtgactgctggacacggccagatagataattttagcttaggtgtcctcggcatggcactgttccttgaagagatgctgcgcacacgagtggggaccaaacatgccatcttgctcgttactgtgtcgtttgtaacactgattaccggaaacatgtccttccgggacctaggccgtgtcatggtgatggtgggggctgccatgacggatgacatcggaatgggcgtcacttacctggcactcctggcggcctttaaggttagacctaccttcgctgccggtcttttgctgaggaaattaacatctaaggagctcatgatggcaaccattgggatcgctctgcttagccagtcaactatacccgaaacaatcctggagctaaccgatgccctcgcactgggaatgatggtgttgaaaattgtacgcaatatggaaaagtatcaactggccgtgacaatcatggctattagttgcgtcccaaacgcggtgatcttacagaatgcctggaaggtttcctgtactatactcgcagctgtgtctgtcagccctctgcttctgacctcctcacagcagaaagccgactggattcccttggccctcacgatcaagggcctgaacccaacagctatctttctaaccactctgagccggaccagtaaaaagagatcttggccgcttaatgaggcaattatggccgtgggcatggtttccatactcgcgagctcgctgttgaaaaacgacatccctatgacagggcccctggtggctggaggtttactcactgtctgctacgtactgaccggcaggtcagccgatcttgaactggagcgagcaacggacgtgaagtgggaggatcaagccgaaatttctgggagttccccaatcttgagcattacaatcgctgaggacggatctatgagcatcaagaatgaagaggaggaacagaccctcactatcctgattcgcacaggcctactggttatctccggtcttttccccgtgtcaattcctatcaccgcagccgcgtggtatctctgggaggtcaagaagcagcgggctggggtgctgtgggatgtaccaagtccccctccggtgggaaaagccgaattggaggacggcgcatacagaataaagcagaaaggcattttagggtatagccaaatcggagccggtgtctacaaggaaggcacttttcacacaatgtggcacgttaccagaggggctgtgctgatgcatcgtggaaaacgcatcgagccatcttgggccgatgtgaagaaggacctcatttcctacggcggtgggtggaaactggagggagaatggaaggagggcgaagaggtccaggtgcttgcactggaacccggcaaaaaccctcgggctgttcagacgaagccagggttgttcaaaactaataccggaacaatcggtgccgtatcactagattttagtcccggcaccagcgggtcccctatagtggacagaaagggaaaggtcgtgggcctgtatggtaacggggttgtgacaaggtctggagcgtacgtctcggccattgcacagactgagaaaagcatcgaggataatccggaaattgaggacgatatcttccgaaagaaacggctcaccataatggacctgcaccccggcgctggcaagacgaaacgctatcttccagccattgtgagagaagctatcaagagggggttacggacactgatcctcgcacctactcgagtagtcgccgccgagatggaagaggctttgagaggactgcccattcgctaccaaaccccagcgatcagggcagagcatacaggtcgtgaaattgtggacctcatgtgtcacgccaccttcactatgcggctgctttcacctgttagagtgcccaactataacctgataatcatggatgaggctcattttaccgacccagcctccattgcagccaggggctacatcagtacacgcgtcgaaatgggggaggctgcgggaatcttcatgacggccactccgcctggctctcgagatccctttccacagagcaatgcacccattatggacgaggaaagagagatacctgaacggtcctggaactcaggtcacgagtgggtgaccgatttcaaggggaaaacagtttggtttgtgccatctatcaaggctggaaatgacattgccgcatgcttgaggaaaaacggcaagaaagtcatccagctaagccgcaagaccttcgatagtgaatatgtgaagactcgtacaaatgactgggattttgtagtgaccacggacatttccgagatgggcgccaacttcaaagctgagagagttatcgatccccggaggtgtatgaagcctgtcatactgactgacggggaagaacgcgtgatcctcgccggaccgatgccagtgacacacagctctgcggcacaacgaagaggtcggattggcaggaatcccaaaaacgaaaatgaccagtacatctacatgggggagcctttagaaaacgatgaggactgcgcccattggaaggaggctaaaatgctgcttgataatattaacacccccgaaggaatcataccatcaatgtttgagcctgaacgcgagaaggtcgacgccattgatggcgaatatagactgaggggtgaggctcggaaaaccttcgtagacctcatgcgtcgcggggatttgcccgtgtggctggcataccgagttgccgctgagggcatcaattatgccgacagaaggtggtgttttgatggagtgaagaacgaccagattctcgaagagaatgtcgaagtggagatctggactaaggagggcgaacggaaaaagctgaaaccacgctggcttgatgcaagaatatactccgaccctctagcgctgaaggagttcaaagagttcgccgctgggaggaagagtttgacattaaacctgatcaccgagatgggacggctcccgacatttatgactcagaaggcccgagatgcactggacaaccttgctgttctgcacacggccgaagcaggaggtagagcctataatcatgctctcagcgagttgcccgagaccctggaaacactactgctccttactctgttagcgaccgtgacagggggaattttcttgtttctgatgtcgggcaaaggtgtcgggaagatgaccctcggcatgtgctgcatcattactgcctctatcctgctttggtacgcacaaatacagccacactggattgctgcctccatcatcctggagttctttctcattgtgttgctgatccctgaacccgagaaacagcgcacgccacaggacaaccaattaacctatgtagtgatagccattctaacagttgtcgcagctactatggccaatgaaatgggattcctggagaagaccaaaaaggatctcggccttgggagcatcgcgacacaggagcctgaatcaaacattctggacatcgatttgaggcccgctagtgcctggaccctgtacgcagtggccactacatttgtgacgccgatgctccggcactctatagaaaattccagcgtcaacgtttcactgaccgctatcgcaaatcaggccactgtgcttatgggactcggtaagggctggccactgagtaaaatggacattggggtacctttgctggcgatcggatgttacagccaggtgaaccccattacattaaccgctgccctactgctccttgtcgcacattatgccatcattggcccaggtctgcaagctaaggccacccgtgaagcacagaaaagagctgccgcggggatcatgaagaatcccacagtggatggcataactgttattgacttggatcctatcccgtacgaccccaaattcgagaagcagctgggacaggtgatgctcctgatcctttgcgtcacgcaagtattaatgatgaggaccacatgggccctgtgtgaagcactcactttggctaccggcccaatttccacactgtgggaggggaaccctggacgcttttggaataccactatagccgtgtctatggcaaacatcttccggggcagctatctagctggtgccgggctgctcttttccattatgaagaatacgacaaacacccgaagaggaactggcaatatcggtgagacccttggcgaaaaatggaagtcaaggctgaacgccttggggaaatctgagttccagatttacaagaaaagtggaatccaggaagttgatcgcacactggcgaaggagggcataaaaagaggggaaactgaccaccatgctgtgtcgagaggaagcgcaaagctccgttggtttgtcgaaaggaatatggtgacccccgagggcaaggtcgtggatctgggttgcgggcggggaggctggtcctattactgtggtggccttaaaaatgttcgcgaagtgaaggggctaacaaaaggaggccctgggcacgaggaaccaatccccatgtctacgtatggatggaacctggtacgactccaatcaggcgtggacgtcttcttcacccctccagagaagtgcgatactctactgtgtgacattggtgagagctcccccaatccgacaatcgaagccgggagaaccttgagggttctgagtctcgtggagaactggcttaataacgacactcagttttgcattaaagtcctgaatccttacatgccatctgtgatcgaaaagatggagacattgcagcggaagtacggaggcgctctggtacgcaaccccctcagcagaaattcaacccatgaaatgtattgggtgtccaacgccacgggcaatatagttagtagcgtgaacatgatttctaggatgttaatcaatcgattcaccatgaaacacaagaaagcaacatacgagcctgatgtcgacctggggtccggaactcggaacatcggtattgagtcagaaataccaaatcttgatatcattggcaagcgtatcgagaaaattaagcaggaacacgagaccagctggcattatgaccaagatcacccctacaagacatgggcctatcatgggtcgtacgaaactaaacagaccggatctgctagttccatggtgaacggcgtcgtgagactgctaacaaagccgtgggacgttgtacctatggtgacccagatggcgatgactgatacgacaccctttggtcagcaacgcgtcttcaaagagaaggtggacaccaggactcaggagccaaaagaagggaccaagaagctcatgaaaatcacagccgagtggctgtggaaggaattgggcaaaaagaaaacgcctcggatgtgtaccagagaggagtttactcgcaaggttaggagcaatgcagctctgggcgccatattcacagatgaaaacaaatggaagtcagcacgagaggccgtggaagactcccggttttgggagctcgtcgataaggaaagaaaccttcacctggagggcaaatgcgagacctgtgtgtataatatgatggggaagagggagaaaaagttaggagagttcggtaaagctaagggctctcgcgccatctggtacatgtggctgggggcgagatttttggagttcgaggcactcggatttctgaacgaagaccactggttcagccgggagaatagtctatccggcgtagagggtgaagggcttcataagctgggatacattctcagagacgtgagcaaaaaggagggcggcgccatgtatgctgatgacactgccgggtgggatacaaggatcaccctggaagacttgaaaaacgaggaaatggttacaaatcacatggagggagagcataagaaactggcagaagctatttttaagctcacttaccagaacaaggtcgtgcgcgtgcagcgacccaccccacggggtacggtcatggatatcatttctagaagggaccaacgcggctcagggcaggttggaacctatggccttaatacattcactaacatggaggcccagctgataagacaaatggaaggtgagggggtgttcaaaagtatccagcggttaaccgtaacagaggaaattgctgtgcagaattggctggccagggtcggacgtgagcgattgtcccgcatggcaatcagcggcgatgactgcgtggttaagcccctcgatgacagatttgcgtctgccctgactgctctaaacgatatgggcaaagtgcggaaggacatccagcaatgggaaccttcgagggggtggaatgattggacccaggtcccattctgctcacaccattttcacgagcttattatgaaagacggacgcgtgctggtagttccgtgtagaaaccaggacgaactcataggtcgggccaggatcagccagggcgcagggtggtccctgaaggagacggcttgcttgggaaagagttacgcccaaatgtggtctttaatgtatttccaccgacgtgatctgagactcgcagccaatgcgatttgtagcgctgtgccctcccattgggtccctacatcacgcaccacttggagtatccacgccaaacatgagtggatgacaaccgaagacatgcttactgtgtggaaccgggtgtggattcaggagaatccatggatggaagataagacccccgtcgagtcttgggaagaggttccttacctgggcaaaagggaggaccagtggtgcggtagcctaatcgggctgacatccagagcaacgtgggccaagaacatacagaccgctatcaaccaagtgcgctcactcattggaaatgaagagtatactgattacatgccaagcatgaaacggtttaggcgagaagaggaagaggccggcgtattgtggtga

SEQ ID NO: 14932 - RNA, 9876 nt, synthetic construct
  misc_feature 1..9876: note = derived and/or modified CDS sequence (opt3) from DENV-2__FM210224__SS-prME
  source 1..9876: mol_type = other RNA
accgccggagtgatcattatgctgatacccacagctatggcattccacctcactacgaggaacggggagcctcatatgatcgtcgggaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagacccggacagaaacttggatgagtagcgagggagcttggaaacacgcccagaggatcgagacctggatactgcggcatcctggcttcacaatcatggcagccattttggcttacaccatcggcacgactcactttcagcgcgcactcattttcatcctgctgacagccgtggctccatccatgaccatgcgttgcatagggatttctaacagggattttgttgaaggagtgtcgggtggctcatgggtcgacatcgtgctcgagcacgggagctgtgtaactacaatggccaagaataagcccaccttagatttcgaactgattaaaacggaggcgaagcagcctgcaacccttcggaaatattgcatcgaagccaagttgacaaacactaccacagagagtcgctgtccaactcaaggagagccctccctgaatgaagaacaggacaaacgatttgtttgcaagcattctatggtggatagaggctggggtaacgggtgtggactattcggcaagggcgggatcgtcacatgcgctatgtttacatgcaaaaagaatatggaaggaaaaattgtgcagcctgagaacctcgaatacaccatagtgatcactccacacagcggtgaggagcatgccgtcggcaatgacacggggaagcacggaaaagaaattaagatcacaccgcagtcctcaataaccgaggcagaactgactggctatggtaccgttacaatggagtgtagtcccaggaccgggcttgatttcaacgaaatggtgctgttgcaaatggaggacaaggcttggctcgtacaccggcagtggtttctggatttacctctgccatggctccccggcgccgacactcagggaagcaattggattcagaaggagacacttgtgacgttcaagaaccctcatgcgaaaaagcaagacgtcgtggttctgggctctcaggaaggggccatgcacaccgcattgactggagctacagagatccagatgtcctcaggtaatctactgtttaccggccatctcaaatgccgtctgcgcatggataaacttcaactgaaagggatgagctacagtatgtgtacaggaaagttcaagatcgtgaaagaaattgccgagactcagcacggcaccatcgtcattagagtgcagtatgagggtgacgggtctccatgcaagatacccttcgaaatcatggatttggagaaaaggcatgtactcggccggctgattacggttaacccgatcgtgaccgaaaaggactcccctgtcaacatcgaggctgaacccccatttggagatagctacattataatcggcgtggagcctgggcagttaaaactgaattggttcaagaagggatcgtctattggtcaaatgtttgagacaactatgcgaggcgccaaacgcatggcaatcctaggggacaccgcctgggatttcggatccctcggcggtgtctttacatcaattgggaaggctctgcaccaggtgttcggcgcgatctacggagcagcctttagtggcgttagctggactatgaaaatacttatcggggctattatcacctggattggaatgaactccagatctacgagcttgtcagtgagtctggtactcgtcggcgtgatcacactgtatcttggtgccatggttcaggcagactccgggtgtgtggtcagctggaagaataaagaactgaagtgcggatctggcatattcattaccgataacgtgcacacttggacagagcagtacaagtttcaacccgaatcaccaagtaaattggccagcgctatccagaaggcccatgaggaaggtatttgtggcatcaggtccgtaacccggctcgagaatctgatgtggaaacagataactcccgagttaaaccacatcctgtctgaaaatgaggtgaagctaaccattatgacaggggacatcaaaggaattatgcaggcaggcaagcgctcgctcagacctcaaccaacggaactgaaatatagctggaagacctgggggaaggcgaaaatgctttccactgagtcacataaccagacattcttgatcgatggaccggaaaccgctgagtgccccaatacaaacagggcctggaatagtctggaggttgaagactacggctttggtgtcttcactaccaacatatggctcaagctgcgtgagaaacaggacgtgttttgtgattctaagttaatgagcgcagccattaaagacaatcgggctgtgcacgccgatatggggtattggatcgaatccgcactgaacgacacgtggaagatggagaaggcttcattcatcgaggtcaaaagctgccactggcctaagtctcatacactttggtccaatggagttttggaaagtgagatgattatcccaaaatcattcgccggccccgtgtctcagcacaactaccgacctggttattacacccaaactgcgggcccatggcatctcgggaagctggaaatggattttgacttctgtgagggaaccacagtggtagtcactgaagattgcggcaacagagggccctccctaaggaccacaacggcctcaggaaaactgattaccgagtggtgctgtcgcagttgcactctcccgcctctgcggtacagaggcgaggacggttgttggtatgggatggaaataaggccacttaaggagaaggaagagaatttggtgaacagcctggttacagctggacacggccagatcgataatttttcgttaggtgtgctcggcatggcactgttccttgaagagatgctgcgcacccgagtcgggactaaacatgccattttgctcgtggctgtttcctttgtgacactgatcaccggaaacatgtctttccgggacctaggccgtgtaatggtcatggtgggggccacgatgactgatgacattggaatgggcgtgacctacctggcactcctggcggcctttaaggtcagacccacattcgctgccggtcttttgctgaggaaattaaccagcaaggagctcatgatggcaactatcgggatagctctgctttcacagagtacaatccctgaaaccattctggagctaacagatgccctcgcactgggaatgatggttttgaaaatcgtgcgcaatatggaaaagtatcaactggccgtaactattatggctatctcctgcgtgcccaacgcggtcatattacagaatgcctggaaggtgtcttgtaccattctcgcagctgttagcgtgtccccactgcttctgacgtcaagccagcagaaagccgactggatccctttggccctcacaatcaagggcctgaaccccaccgctatttttctaactaccctgagtcggacatctaaaaagagatcctggccacttaatgaggcaataatggccgtcggcatggtgagcatcctcgcgtcgtcactgttgaaaaacgacattccgatgactgggcctctggttgctggaggtttactcaccgtgtgctacgtcctgacgggcaggtctgccgatcttgaactggagcgagcaacagacgtaaagtgggaggatcaagccgaaatcagtgggtccagccccattttgtctatcaccataagcgaggacggatccatgtcaatcaaaaatgaagaggaggaacagactctcacaattctgatccgcaccggcctactggtgattagtggtcttttcccagttagcatccccataactgctgcagcctggtatctctgggaggtgaagaagcagcgggcgggggtcctgtgggatgtgccttctccaccccctgtaggaaaagctgaattggaggacggcgcctacagaattaagcagaaaggcatcttagggtattcccaaatcggagcaggagtgtacaaggaaggcacatttcacaccatgtggcacgtcacgagaggggccgttctgatgcatcgtggaaaacgcattgagccgtcatgggctgatgtgaagaaggacctcatcagttacggcggtgggtggaaactggagggagaatggaaggagggcgaagaggtgcaggtccttgccctggaaccaggcaaaaacccccgggcagtgcagactaagcctgggttgttcaaaaccaatacaggaaccataggtgctgttagcctagatttttccccaggcacatctgggtcgcccattgtagacagaaagggaaaggtggtcggcctgtatggtaacggggtggttactaggagcggagcctacgtgtcagcgatcgcccagaccgagaaatccattgaggataatcctgaaatcgaggacgatatattccgaaagaaacggctcacgattatggacctgcacccgggcgcaggcaagacaaaacgctatcttcccgctatcgtcagagaagccatcaagagggggttacggactctgattctcgctccaacccgagtggtagcagccgagatggaagaggccttgagaggactgcctatccgctaccaaacacccgctattagggcggagcataccggtcgtgaaatagtcgacctcatgtgtcacgcaactttcaccatgcggctgcttagtccagtgagagttcctaactataacctgatcattatggatgaggcccattttacagaccccgcttctatcgccgcaaggggctacatcagcacgcgcgtggaaatgggggaggccgctggaattttcatgactgcgaccccaccgggctcccgagatccttttccccagtcaaatgccccaataatcgacgaggaaagagagattcccgaacggtcttggaacagcggtcacgagtgggtcacagatttcaaggggaaaaccgtgtggtttgttcctagtatcaaggcaggaaatgacattgctgcctgcttgaggaaaaacggcaagaaagtgatccagctatcccgcaagactttcgatagcgaatatgtcaagacacgtaccaatgactgggattttgtggtaacgactgacatatctgagatgggcgcaaacttcaaagccgagagagtgatcgatccacggaggtgtatgaagcccgttattctgacagacggggaagaacgcgtcatcctcgctggacctatgccggtgacccactcatccgccgcgcaacgaagaggtcggattggcaggaatcccaaaaacgaaaatgaccagtacatctacatgggggagcccttagaaaacgatgaggactgcgcacattggaaggaggccaaaatgctgcttgataatataaacacccctgaaggaattatccccagtatgtttgagccagaacgcgagaaggtggacgctattgatggcgaatatagactgaggggtgaggcccggaaaactttcgtcgacctcatgcgtcgcggggatttgcctgtatggctggcttaccgagtggcagccgagggcatcaattatgctgacagaaggtggtgttttgatggagccaagaacaatcagatactcgaagagaacgttgaagtggagatctggacaaaggagggcgaacggaaaaagctgaaaccccgctggcttgacgcaagaatttacagcgatccactagcgctgaaggagttcaaagagttcgccgctgggaggaagtcgttgaccttaaacctgatcacagagatgggacggctccctacttttatgacgcagaaggcccgagacgcactggataatcttgctgtcctgcacaccgccgaagccggtggtagagcatataaccatgctctctctgagttgccggagacactggaaactctactgctccttaccctgttagcgacagtgaccgggggaattttcttgtttctgatgtccggcaaaggtgttgggaagatgactctcggcatgtgctgcatcataacggccagcattctgctttggtacgcacaaatccagccccactggatcgctgcctcaattatcctggagttctttctcatagtgttgctgattccagaacctgagaaacagcgcaccccacaggacaatcaattaacatatgtcgtgatcgccattctaactgtagtggcagctaccatggccaacgaaatgggattcctggagaagaccaaaaaggacctcggccttgggagtatcgcgacccaggagccagaatctaatatactggatatcgacttgaggcctgcttccgcctggactctgtacgcagttgccacaacgtttgtcacccccatgctccggcacagcattgagaactcaagtgtgaatgtgagcctgactgctatcgcaaaccaggccacagtccttatgggactcggtaagggctggccgctgtccaaaatggatattggggttccattgctggcgatcggatgttactctcaggtgaatcctattaccttaaccgctgccctactgctccttatcgcacattatgccataattggccccggtctgcaagctaaggccacacgtgaagcacagaaaagagctgccgcggggatcatgaagaacccaactgtagacggcatcacggtgattgatttggaccccataccttacgatccgaaattcgagaagcagctgggacaggtcatgctcctgatcctttgcgtgacccaagttttaatgatgaggacaacttgggccctgtgtgaagcactcaccttggctacaggccccattagcaccctgtgggaggggaatccaggacgcttttggaacactacgatcgccgtgtccatggcaaatattttccggggctcatatctagctggtgccgggctgctcttttctatcatgaagaacacaaccaatactcgaagaggaaccggcaacataggtgagacacttggcgaaaaatggaagagtaggctgaatgccttggggaaatcggagttccagatctacaagaaaagcggcattcaggaagtcgaccgcactctggcgaaggagggcatcaaaagaggggaaaccgatcaccatgctgtatccagaggatctgcaaagctccgttggtttgtggaaaggaacatggttacacctgagggcaaggtggtcgacctgggttgcgggcggggaggctggtcatattactgtggtggccttaaaaacgtgcgcgaagtcaaggggctaacgaaaggaggccccgggcacgaggaacctattccaatgagcacctatggatggaatctggtgcgactccaatccggcgttgatgtgttcttcactccccctgagaagtgcgacacactactgtgtgatatcggtgagagttctccaaaccccaccatagaagccgggagaactttgagggtactgagcctcgtggagaattggcttaacaatgacacacagttttgcattaaagtcctgaacccgtacatgccttcagttatcgaaaagatggagaccttgcagcggaagtacggaggcgctctggtgcgcaatccactctccagaaacagtacgcatgaaatgtattgggtcagcaatgccaccggcaacatcgtgtcttccgtaaatatgatttcaaggatgttaataaaccgattcacaatgaaacacaagaaagcaacttacgagcccgacgtggatctggggagcggaacccggaatatcggtattgagtcggaaatccctaaccttgacattatcggcaagcgtatagagaaaatcaagcaggaacacgagacatcttggcattatgatcaagaccacccatacaagacttgggcctatcatgggagttacgaaaccaaacagacaggatccgctagctcaatggttaatggcgtggtcagactgctaaccaagccctgggatgtggtcccgatggtgactcagatggcgatgacggacacaaccccttttggtcagcaacgcgttttcaaagagaaggtagatactaggacccaggagcccaaagaagggacaaagaagctcatgaaaattacggccgagtggctgtggaaggaattgggcaaaaagaaaaccccacggatgtgtactagagaggagtttacacgcaaggtgaggtccaacgcagctctgggcgccatcttcaccgacgaaaacaaatggaagtctgcacgagaggccgtcgaagatagccggttttgggagctcgtggacaaggaaagaaatcttcacctggagggcaaatgcgagacttgtgtttataacatgatggggaagagggagaaaaagttaggagagttcggtaaagctaagggcagtcgcgccatttggtacatgtggctgggggcgagatttttggagttcgaggcactcggatttctgaatgaagatcactggttctcccgggagaacagcctatctggcgtggagggtgaagggcttcataagctgggatacatcctcagagacgtcagcaaaaaggagggcggcgccatgtatgctgacgatacagccgggtgggacaccaggattacactggaagatttgaaaaatgaggaaatggtgactaaccacatggagggagagcataagcgcctggcagaagctatatttaaactcacctaccagaataaggtagtgcgagttcagcggcctacgcccagaggtaccgtcatggacatcattagtaggcgcgatcaaagaggctccggacaggtgggaacatatggccttaacactttcaccaatatggaggcccagctgatccggcaaatggaaggtgaggggatcttcaagagcattcagcacttaacagtgactgaggaaatagctgtccagaactggctggccagggttggacgtgagcgattgtctcgcatggcaatctcgggcgacgattgcgtggtaaaaccactcgacgatagatttgcgtcagccctgaccgctctaaatgacatgggcaaggtgcggaaagatattcagcaatgggaacccagcaaggggtggaacgactggacgcaggtccctttctgctcccatcactttcacgagcttatcatgaaagatggaagggtgctggttgtgccatgtcgcaatcaggacgaactcattggtagagcccggatcagtcagggcgcagggtggtctctgaaggagacagcttgcttgggaaagagctacgcccaaatgtggtccttaatgtatttccataggcgagacctgcgtctcgcagccaacgcgatatgttcagctgtcccgagtcactgggtgcccacctctagaactacatggagcatccatgccaaacacgagtggatgaccactgaagatatgcttaccgtatggaatcgcgtttggattcaggagaacccttggatggaagacaagacaccagtggagtcctgggaagaggtcccctacctgggcaaacgggaggatcagtggtgcggttcactaatcgggctgacgagcagggcaacctgggccaagaacattcagactgctatcaatcaagtgagatctctcataggaaacgaagagtatacagactacatgccttccatgaaacgctttcggagggaagaggaagaggccggcgtgttgtggtga

SEQ ID NO: 14933 - RNA, 9876 nt, synthetic construct
  misc_feature 1..9876: note = derived and/or modified CDS sequence (opt3) from DENV-2__FM210225__SS-prME
  source 1..9876: mol_type = other RNA
accgccggagtgatcattatgctgatacccacggctatggcattccacctcactacgaggaacggggagcctcatatgatcgtcgggaggcaggaaaagggtaaaagccttctgtttaagaccgaggacggagttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagacccggacagaaacttggatgagtagcgagggagcttggaaacacgcccagaggatcgagacctggatactgcggcatcctggcttcacaatcatggcagccattttggcttacaccatcggcacgactcactttcagcgcgcactcattttcatcctgctgacagccgtggctccatccatgaccatgcgttgcatagggatttctaacagggattttgttgaaggagtgtcgggtggctcatgggtcgacatcgtgctcgagcacgggagctgtgtaactacaatggccaagaataagcccaccttagatttcgaactgattaaaacggaggcgaagcagcctgcaacccttcggaaatattgcatcgaagccaagttgacaaacactaccacagagagtcgctgtccaactcaaggagagccctccctgaatgaagaacaggacaaacgatttgtttgcaagcattctatggtggatagaggctggggtaacgggtgtggactattcggcaagggcgggatcgtcacatgcgctatgtttacatgcaaaaagaatatggaaggaaaaattgtgcagcctgagaacctcgaatacaccatagtgatcactccacacagcggtgaggagcatgccgtcggcaatgacacggggaagcacggaaaagaaattaagatcacaccgcagtcctcaataaccgaggcagaactgactggctatggtaccgttacaatggagtgtagtcccaggaccgggcttgatttcaacgaaatggtgctgttgcaaatggaggacaaggcttggctcgtacaccggcagtggtttctggatttacctctgccatggctccccggcgccgacactcagggaagcaattggattcagaaggagacacttgtgacgttcaagaaccctcatgcgaaaaagcaagacgtcgtggttctgggctctcaggaaggggccatgcacaccgcattgactggagctacagagatccagatgtcctcaggtaatctactgtttaccggccatctcaaatgccgtctgcgcatggataaacttcaactgaaagggatgagctacagtatgtgtacaggaaagttcaagatcgtgaaagaaattgccgagactcagcacggcaccatcgtcattagagtgcagtatgagggtgacgggtctccatgcaagatacccttcgaaatcatggatttggagaaaaggcatgtactcggccggctgattacggttaacccgatcgtgaccgaaaaggactcccctgtcaacatcgaggctgaacccccatttggagatagctacattataatcggcgtggagcctgggcagttaaaactgaattggttcaagaagggatcgtctattggtcaaatgtttgagacaactatgcgaggcgccaaacgcatggcaatcctaggggacaccgcctgggatttcggatccctcggcggtgtctttacatcaattgggaaggctctgcaccaggtgttcggcgcgatctacggagcagcctttagtggcgttagctggactatgaaaatacttatcggggctattatcacctggattggaatgaactccagatctacgagcttgtcagtgagtctggtactcgtcggcgtgatcacactgtatcttggtgccatggttcaggcagactccgggtgtgtggtcagctggaagaataaagaactgaagtgcggatctggcatattcattaccgataacgtgcacacttggacagagcagtacaagtttcaacccgaatcaccaagtaaattggccagcgctatccagaaggcccatgaggaaggtatttgtggcatcaggtccgtaacccggctcgagaatctgatgtggaaacagataactcccgagttaaaccacatcctgtctgaaaatgaggtgaagctaaccattatgacaggggacatcaaaggaattatgcaggcaggcaagcgctcgctcagacctcaaccaacggaactgaaatatagctggaagacctgggggaaggcgaaaatgctttccactgagtcacataaccagacattcttgatcgatggaccggaaaccgctgagtgccccaatacaaacagggcctggaatagtctggaggttgaagactacggctttggtgtcttcactaccaacatatggctcaagctgcgtgagaaacaggacgtgttttgtgattctaagttaatgagcgcagccattaaagacaatcgggctgtgcacgccgatatggggtattggatcgaatccgcactgaacgacacgtggaagatggagaaggcttcattcatcgaggtcaaaagctgccactggcctaagtctcatacactttggtccaatggagttttggaaagtgagatgattatcccaaaatcattcgccggccccgtgtctcagcacaactaccgacctggttattacacccaaactgcgggcccatggcatctcgggaagctggaaatggattttgacttctgtgagggaaccacagtggtagtcactgaagattgcggcaacagagggccctccctaaggaccacaacggcctcaggaaaactgattaccgagtggtgctgtcgcagttgcactctcccgcctctgcggtacagaggcgaggacggttgttggtatgggatggaaataaggccacttaaggagaaggaagagaatttggtgaacagcctggttacagctggacacggccagatcgataatttttcgttaggtgtgctcggcatggcactgttccttgaagagatgctgcgcacccgagtcgggactaaacatgccattttgctcgtggctgtttcctttgtgacactgatcaccggaaacatgtctttccgggacctaggccgtgtaatggtcatggtgggggccacgatgactgatgacattggaatgggcgtgacctacctggcactcctggcggcctttaaggtcagacccacattcgctgccggtcttttgctgaggaaattaaccagcaaggagctcatgatggcaactatcgggatagctctgctttcacagagtacaatccctgaaaccattctggagctaacagatgccctcgcactgggaatgatggttttgaaaatcgtgcgcaatatggaaaagtatcaactggccgtaactattatggctatctcctgcgtgcccaacgcggtcatattacagaatgcctggaaggtgtcttgtaccattctcgcagctgttagcgtgtccccactgcttctgacgtcaagccagcagaaagccgactggatccctttggccctcacaatcaagggcctgaaccccaccgctatttttctaactaccctgagtcggacatctaaaaagagatcctggccacttaatgaggcaataatggccgtcggcatggtgagcatcctcgcgtcgtcactgttgaaaaacgacattccgatgactgggcctctggttgctggaggtttactcaccgtgtgctacgtcctgacgggcaggtctgccgatcttgaactggagcgagcaacagacgtaaagtgggaggatcaagccgaaatcagtgggtccagccccattttgtctatcaccataagcgaggacggatccatgtcaatcaaaaatgaagaggaggaacagactctcacaattctgatccgcaccggcctactggtgattagtggtcttttcccagttagcatccccataactgctgcagcctggtatctctgggaggtgaagaagcagcgggcgggggtcctgtgggatgtgccttctccaccccctgtaggaaaagctgaattggaggacggcgcctacagaattaagcagaaaggcatcttagggtattcccaaatcggagctggtgtgtacaaggaaggcacatttcacaccatgtggcacgtcacgagaggggcagttctgatgcatcgtggaaaacgcattgagccgtcatgggcagatgtgaagaaggacctcatcagttacggcggtgggtggaaactggagggagaatggaaggagggcgaagaggtgcaggtccttgccctggaaccaggcaaaaacccccgggcagtgcagactaagcctgggttgttcaaaaccaatacaggaaccataggtgctgttagcctagatttttccccaggcacatctgggtcgcccattgtagacagaaagggaaaggtggtcggcctgtatggtaacggggtggttactaggagcggagcctacgtgtcagcgatcgcccagaccgagaaatccattgaggataatcctgaaatcgaggacgatatattccgaaagaaacggctcacgattatggacctgcacccgggcgcaggcaagacaaaacgctatcttcccgctatcgtcagagaagccatcaagagggggttacggactctgattctcgctccaacccgagtggtagcagccgagatggaagaggccttgagaggactgcctatccgctaccaaacacccgctattagggcggagcataccggtcgtgaaatagtcgacctcatgtgtcacgcaactttcaccatgcggctgcttagtccagtgagagttcctaactataacctgatcattatggatgaggcccattttacagaccccgcttctatcgccgcaaggggctacatcagcacgcgcgtggaaatgggggaggccgctggaattttcatgactgcgaccccaccgggctcccgagatccttttccccagtcaaatgccccaataatcgacgaggaaagagagattcccgaacggtcttggaacagcggtcacgagtgggtcacagatttcaaggggaaaaccgtgtggtttgttcctagtatcaaggcaggaaatgacattgctgcctgcttgaggaaaaacggcaagaaagtgatccagctatcccgcaagactttcgatagcgaatatgtcaagacacgtaccaatgactgggattttgtggtaacgactgacatatctgagatgggcgcaaacttcaaagccgagagagtgatcgatccacggaggtgtatgaagcccgttattctgacagacggggaagaacgcgtcatcctcgctggacctatgccggtgacccactcatccgccgcgcaacgaagaggtcggattggcaggaatcccaaaaacgaaaatgaccagtacatctacatgggggagcccttagaaaacgatgaggactgcgcacattggaaggaggccaaaatgctgcttgataatataaacacccctgaaggaattatccccagtatgtttgagccagaacgcgagaaggtggacgctattgatggcgaatatagactgaggggtgaggcccggaaaactttcgtcgacctcatgcgtcgcggggatttgcctgtatggctggcttaccgagtggcagccgagggcatcaattatgctgacagaaggtggtgttttgatggagttaagaacaatcagatactcgaagagaacgtggaagtcgagatctggacaaaggagggcgaacggaaaaagctgaaaccccgctggcttgacgccagaatttacagcgatccactagcactgaaggagttcaaagagttcgcggccgggaggaagtcgttgaccttaaacctgatcacagagatgggacggctccctacttttatgacgcagaaggctcgagacgccctggataatcttgcagtgctgcacaccgctgaagccggtggcagagcatataaccatgccctctctgagttgccggagacactggaaactctactgctccttaccctgttagctacagttaccgggggaattttcttgtttctgatgtccggcaaaggtgtggggaagatgactctcggcatgtgctgcatcataacggcgagcattctgctttggtacgcccaaatccagccccactggatcgcagcttcaattatcctggagttctttctcatagtcttgctgattccagaacctgagaaacagcgcaccccacaggacaatcaattaacatatgtggtaatcgccattctaactgtggttgccgcaaccatggctaacgaaatgggattcctggagaagaccaaaaaggacctcggccttgggagtatcgccacccaggagccagaatctaatatactggatatcgacttgaggcctgcgtccgcttggactctgtacgccgtcgcaacaacgtttgtgacccccatgctccggcacagcattgagaactcaagtgtgaatgtcagcctgactgccatcgctaaccaggcaacagttcttatgggactcggtaagggctggccgctgtccaaaatggatattggggtgccattgctggccatcggatgttactctcaggtaaatcctattaccttaaccgcggctctactgctccttatcgcccattatgcaataattggccccggtctgcaagccaaggctacacgtgaagcccagaaaagagcagctgccgggatcatgaagaacccaactgtggacggcatcacggtcattgatttggaccccataccttacgatccgaaattcgagaagcagctgggacaggtgatgctcctgatcctttgcgttacccaagtgttaatgatgaggacaacttgggcgctgtgtgaagccctcaccttggcaacaggccccattagcaccctgtgggaggggaatccaggacgcttttggaacactacgatcgctgtctccatggccaatattttccggggctcatatctagccggtgctgggctgctcttttctatcatgaagaacacaaccaatactcgaagaggaaccggcaacataggtgagacacttggcgaaaaatggaagagtaggctgaatgccttggggaaatcggagttccagatctacaagaaaagcggcattcaggaagtagaccgcactctggccaaggagggcatcaaaagaggggaaaccgatcaccatgcggtgtccagaggatctgctaagctccgttggtttgttgaaaggaacatggtgacacctgagggcaaggtcgtggacctgggttgcgggcggggaggctggtcatattactgtggtggccttaaaaacgtccgcgaagtgaaggggctaacgaaaggaggccccgggcacgaggaacctattccaatgagcacctatggatggaatctggttcgactccaatccggcgtggatgtattcttcactccccctgagaagtgcgacacactactgtgtgatatcggtgagagttctccaaaccccaccatagaagcagggagaactttgagggtgctgagcctcgtcgagaattggcttaacaatgacacacagttttgcattaaagttctgaacccgtacatgccttcagtgatcgaaaagatggagaccttgcagcggaagtacggaggcgccctggtccgcaatccactctccagaaacagtacgcatgaaatgtattgggtgagcaatgctaccggcaacatcgtatcttccgtgaatatgatttcaaggatgttaataaaccgattcacaatgaaacacaagaaagccacttacgagcccgacgttgatctggggagcggaacccggaatatcggtattgagtcggaaatccctaaccttgacattatcggcaagcgtatagagaaaatcaagcaggaacacgagacatcttggcattatgatcaagaccacccatacaagacttgggcatatcatgggagttacgaaaccaaacagacaggatccgccagctcaatggtgaatggcgtcgtgagactgctaaccaagccctgggatgtcgtgccgatggttactcagatggctatgacggacacaaccccttttggtcagcaacgcgtattcaaagagaaggtggatactaggacccaggagcccaaagaagggacaaagaagctcatgaaaattacggcggagtggctgtggaaggaattgggcaaaaagaaaaccccacggatgtgtactagagaggagtttacacgcaaggtcaggtccaacgccgcactgggcgctatcttcaccgacgaaaacaaatggaagtctgcccgagaggcagtggaagatagccggttttgggagctcgttgacaaggaaagaaatcttcacctggagggcaaatgcgagacttgtgtgtataacatgatggggaagagggagaaaaagttaggagagttcggtaaagccaagggcagtcgcgctatttggtacatgtggctgggggccagatttttggagttcgaggcgctcggatttctgaatgaagatcactggttctcccgggagaacagcctatctggcgtcgagggtgaagggcttcataagctgggatacatcctcagagacgtgagcaaaaaggagggcggcgcaatgtatgccgacgatacagctgggtgggacaccaggattacactggaagatttgaaaaatgaggaaatggtaactaaccacatggagggagagcataagcgcctggccgaagcaatatttaaactcacctaccagaataaggtggttcgagtccagcggcctacgcccagaggtaccgtgatggacatcattagtaggcgcgatcaaagaggctccggacaggtgggaacatatggccttaacactttcaccaatatggaggctcagctgatccggcaaatggaaggtgaggggatcttcaagagcattcagcacttaacagtcactgaggaaatagccgttcagaactggctggctagggtgggacgtgagcgattgtctcgcatggccatctcgggcgacgattgcgtagtgaaaccactcgacgatagatttgcatcagcgctgaccgccctaaatgacatgggcaaggtccggaaagatattcagcaatgggaacccagcaaggggtggaacgactggacacaggtgcctttctgctcccatcactttcacgagcttatcatgaaagatggaagggttctggtggtcccatgtcgcaatcaggacgaactcattggtagagctcggatcagtcagggcgccgggtggtctctgaaggagacagcatgcttgggaaagagctacgctcaaatgtggtccttaatgtatttccataggcgagacctgcgtctcgccgcaaacgccatatgttcagcggtgccgagtcactgggtacccacctctagaactacatggagcatccatgctaaacacgagtggatgaccactgaagatatgcttaccgtttggaatcgcgtgtggattcaggagaacccttggatggaagacaagacaccagtcgagtcctgggaagaggtgccctacctgggcaaacgggaggatcagtggtgcggttcactaatcgggctgacgagcagggccacctgggcaaagaacattcagactgccatcaatcaagtgagatctctcataggaaacgaagagtatacagactacatgccttccatgaaacgctttcggagggaagaggaagaggctggcgtcttgtggtga

SEQ ID NO: 14934 - RNA, 9876 nt, synthetic construct
  misc_feature 1..9876: note = derived and/or modified CDS sequence (opt3) from DENV-2__FM210226__SS-prME
  source 1..9876: mol_type = other RNA
accgccggcgtgatcattatgctgatacccacagctatggcattccacctcactacgaggaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagacccggacagaaacttggatgagtagcgagggagcttggaaacacgcccagaggatcgagacctggatactgcggcatcctggcttcacaatcatggcagccattttggcttacaccgtgggcacgactcactttcagcgcgcactcatcttcattctgctggccgctgttgccccatccatgacaatgcgttgcatcgggatatctaacagggattttgtggaaggagtctcgggtggctcatgggtggacattgtactcgagcacgggagctgtgttaccactatggcgaagaataagcccacattagatttcgaactgatcaaaaccgaggcaaagcagcctgccacgcttcggaaatattgcattgaagctaagttgaccaacacaactaccgagagtcgctgtccaacacaaggagagccctccctgaatgaagaacaggacaaacgatttgtgtgcaagcattctatggtcgatagaggctggggtaacgggtgtggactattcggcaagggcgggatcgtgacttgcgccatgtttacctgcaaaaagaatatggaaggaaaaatcgtgcagcctgagaacctcgaatacacaattgtcataaccccacacagcggtgaggagcatgcagttggcaatgacactgggaagcacggaaaagaaatcaagattacgccgcagtcccccatcacagaggctgaactgaccggctatggtactgtgaccatggagtgttcacctaggacagggcttgatttcaacgaaatggtactgttgcaaatggaggacaaagcctggctcgtgcaccggcagtggtttctggatttaccactgccctggctccctggcgcggacacccagggaagtaattggatacagaaggagactcttgtcacattcaagaacccacatgccaaaaagcaagacgtggttgtgctgggcagccaggaaggggcaatgcacacggctttgaccggagccactgagattcagatgtcttccggtaatctactgtttacaggccatctcaaatgccgtctgcgcatggataaacttcaactgaaagggatgtcatacagcatgtgtaccggaaagttcaagatcgtcaaagaaatcgctgagacacagcacggcactattgtgatcagagtacagtatgagggtgacgggagtccctgcaagattccgttcgaaataatggatttggagaaaaggcatgttctcggccggctgatcaccgtgaaccctattgtcacggaaaaggactctcccgtgaacatcgaggccgaaccaccttttggagattcctacatcattataggcgtcgagcccgggcagttaaaactgaattggttcaagaagggaagctcgatcggtcaaatgtttgagaccacaatgcgaggcgcaaaacgcatggccattctaggggacactgcttgggatttcggatctctcggcggtgtgtttacctccatcgggaaggcgctgcaccaggttttcggcgcaatttacggagccgctttttcaggcgtgagttggacaatgaaaatccttataggggtaatcattacttggatcggaatgaacagcagatccacctctttgagcgtctcactggtgctcgttggcgtgattacgctgtatcttggtgccatggtccaggcagacagtgggtgtgtggtatcctggaagaataaagaactgaagtgcggaagcggcatcttcataacagataacgtgcacacctggactgagcagtacaagtttcaaccagaatctccctcaaaattggccagtgctattcagaaggcccatgaggaaggtatctgtggcattaggagcgttacacggctcgagaatctgatgtggaaacagatcacccctgagttaaaccacatactgtccgaaaatgaggtcaagctaactatcatgaccggggacattaaaggaatcatgcaggcaggcaagcgctctctcagaccacaaccgacagaactgaaatattcgtggaagacgtgggggaaggcgaaaatgcttagcaccgagtcccataaccagactttcttgattgatggacccgaaacagctgagtgccctaataccaacagggcctggaactcactggaggtggaagactacggctttggtgtgttcacaactaacatctggctcaagctgcgtgagaaacaggacgtcttttgtgatagtaagttaatgtctgcagccataaaagacaatcgggctgttcacgccgatatggggtattggattgaaagcgcactgaacgacacctggaagatggagaaggcttccttcatcgaggtgaaatcatgccactggccaaagagccatacgctttggtctaatggagtgttggaatccgagatgatcattcccaaaagtttcgccggccctgtaagccagcacaactaccgaccaggttattacacacaaaccgcgggcccctggcatctcgggaagctggaaatggattttgacttctgtgagggaactaccgtcgtggttacagaagattgcggcaacagagggccgtctctaaggactaccacagcctccggaaaactgatcacggagtggtgctgtcgctcatgcaccctccctccactgcggtacagaggcgaggacggttgttggtatgggatggaaattaggccccttaaggagaaggaagagaatttggtgaacagtctggtcactgctggacacggccagatagataattttagcttaggtgtgctcggcatggcactgttccttgaagagatgctgcgcacacgagttgggaccaaacatgccatcttgctcgtggctgtatcgtttgtcactctgattacaggaaacatgtccttccgggacctaggccgtgtgatggtgatggtcggggccgcaatgaccgatgacatcggaattggcgttacgtacctggcgctcctggccgcttttaaggtgagacctactttcgccgcaggtcttttgctgaggaaattaacctctaaggagctcatgatggctacaatcgggatagccctgcttagccagtcaaccatccccgaaactattctggagctaacagatgcactcgccctgggaatgatggtattgaaaatcgtgcgcaatatggaaaagtatcaactggctgtcaccattatggcgatcagttgcgtgccaaacgccgttatattacagaatgcatggaaggtgtcctgtacaattctcgctactgtctctgtgagccctctgcttctgacctcctcacagcagaaagccgactggatccccttggccctcacgatcaagggcctgaacccaacagctatttttctaaccactctgagccggaccagtaaaaagagatcttggccgcttaatgaggcaataatggccgttggcatggtgtccatcctcgcgagctcgctgttgaaaaacgacattcctatgacagggcccctggtcgctggaggtttactcactgtatgctacgtgctgaccggcaggtcagccgatcttgaactggagcgagcaacggacgttaagtgggaggatcaagccgaaatctctgggagttccccaattttgagcatcacaatagctgaggacggatctatgagcatcaaaaatgaagaggaggaacagaccctcactattctgatccgcacaggcctactggtgatttccggtcttttccccgtctcaatccctataaccgcagccgcgtggtatctctgggaggtgaagaagcagcgggctggggtactgtgggatgtgccaagtccccctccggtcggaaaagccgaattggaggacggcgcatacagaattaagcagaaaggcatcttagggtatagccaaatcggagccggtgtttacaaggaaggcacttttcacacaatgtggcacgtgaccagaggggctgtgctgatgcatcgtggaaaacgcattgagccatcttgggccgatgtcaagaaggacctcatctcctacggcggtgggtggaaactggagggagaatggaaggagggcgaagaggtgcaggttcttgcactggaacccggcaaaaaccctcgggctgtacagacgaagccagggttgttcaaaactaataccggaacaataggtgccgtgtcactagattttagtcccggcaccagcgggtcccctattgtcgacagaaagggaaaggtggttggcctgtatggtaacggggtggtcacaaggtctggagcgtacgtgtcggccatcgcacagactgagaaaagcattgaggataatccggaaatcgaggacgatatattccgaaagaaacggctcaccattatggacctgcaccccggcgctggcaagacgaaacgctatcttccagccatcgtaagagaagctatcaagagggggttacggacactgattctcgcacctactcgagtcgtggccgccgagatggaagaggctttgagaggactgcccatccgctaccaaaccccagcgattagggcagagcatacaggtcgtgaaatagttgacctcatgtgtcacgccaccttcactatgcggctgctttcacctgtgagagtccccaactataacctgatcattatggatgaggctcattttaccgacccagcctccatcgcagccaggggctacatcagtacacgcgtggaaatgggggaggctgcgggaattttcatgacggccactccgcctggctctcgagatccctttccacagagcaatgcacccataatggacgaggaaagagagatccctgaacggtcctggaactcaggtcacgagtgggttaccgatttcaaggggaaaacagtgtggtttgtcccatctattaaggctggaaatgacatcgccgcatgcttgaggaaaaacggcaagaaagtgattcagctaagccgcaagaccttcgatagtgaatatgtaaagactcgtacaaatgactgggattttgtggttaccacggacatctccgagatgggcgccaacttcaaagctgagagagtcatagatccccggaggtgtatgaagcctgtgatcctgactgacggggaagaacgcgtgattctcgccggaccgatgccagtcacacacagctctgcggcacaacgaagaggtcggatcggcaggaatcccaaaaacgaaaatgaccagtacatttacatgggggagcctttagaaaacgatgaggactgcgcccattggaaggaggctaaaatgctgcttgataatatcaacacccccgaaggaataattccatcaatgtttgagcctgaacgcgagaaggtagacgccatcgatggcgaatatagactgaggggtgaggctcggaaaaccttcgtggacctcatgcgtcgcggggatttgcccgtttggctggcataccgagtggccgctgagggcattaattatgccgacagaaggtggtgttttgatggagtcaagaacaatcagatcctcgaagagaacgtggaagttgagatatggactaaggagggcgaacggaaaaagctgaaaccacgctggcttgacgcaagaatctactccgatcctctagcgctgaaggagttcaaagagttcgccgctgggaggaagagtttgacattaaacctgattaccgagatgggacggctcccgacatttatgactcagaaggcccgagacgcactggataatcttgctgtgctgcacacggccgaagcaggaggtagagcctataaccatgctctcagcgagttgcccgagaccctggaaacactactgctccttactctgttagcgaccgtcacagggggaatcttcttgtttctgatgtcgggcaaaggtgtggggaagatgaccctcggcatgtgctgcattatcactgcctctatactgctttggcacgcacaaattcagccacactggatcgctgcctccatcattctggagttctttctcatcgtattgctgatacctgaacccgagaaacagcgcacgccacaggacaatcaattaacctacgtggttattgccatcctaacagtcgtggcagctactatggccaacgaaatgggattcctggagaagaccaaaaaggacctcggccttgggagcattgcgacacaggagcctgaatcaaatatcctggatatagacttgaggcccgctagtgcctggaccctgtatgcagtggccactacatttgtcacgccgatgctccggcattctatcgagaactccagcgttaatgtgtcactgaccgctattgcaaaccaggccactgtacttatgggactcggtaagggctggccactgagtaaaatggatatcggggtgcctttgctggcgattggatgttacagccaggtcaatcccatcacattaaccgctgccctactgctccttgtggcacactacgccattatcggcccaggtctgcaagctaaggccacccgtgaagcacagaaaagagctgccgcggggataatgaagaaccccacagttgacggcattactgtgatcgatttggaccctatcccgtatgatcccaaattcgagaagcagctgggacaggtcatgctcctgattctttgcgtaacgcaagtgttaatgatgaggaccacatgggccctgtgtgaagcactcactttggctaccggcccaatatccacactgtgggaggggaatcctggacgcttttggaacaccactatcgccgtttctatggcaaatattttccggggcagctacctagctggtgccgggctgctcttttccatcatgaagaacacgacaaatacccgaagaggaactggcaacattggtgagacccttggcgaaaaatggaagtcaaggctgaatgccttggggaaatctgagttccagatctataagaaaagtggaatacaggaagtggaccgcacactggcgaaggagggcatcaaaagaggggaaactgatcatcacgctgtctcgagaggaagcgcaaagctccgttggtttgtggaaaggaacatggtcacccccgagggcaaggtggttgacctgggttgcgggcggggaggctggtcctactattgtggtggcctaaagaatgtgcgcgaagtaaaggggcttacaaaaggaggccctgggcatgaggaaccagtgcccatgtctacgtacggatggaatctggtccgactccaatcaggcgttgatgtgttcttcacccctccagagaagtgcgacactctactgtgtgatattggtgagagctcccccaacccgacaatcgaagccgggagaaccttgagggtcctgagtctcgtggagaattggcttaacaatgacactcagttttgcattaaagtactgaacccttatatgccatctgtgatcgaaaagatggagacattgcagcggaagtacggaggcgctctggttcgcaatcccctcagcagaaactcaacccacgaaatgtactgggtgtccaatgccacgggcaacatagtcagtagcgtgaatatgatttctaggatgttaatcaaccgattcaccatgaaacacaagaaagcaacatatgagcctgacgtcgatctggggtccggaactcggaatatcggtattgagtcagaaataccaaaccttgacatcattggcaagcgtatcgagaaaattaagcaggaacatgagaccagctggcactacgatcaagaccatccctataagacatgggcctaccacgggtcgtatgaaactaaacagaccggatctgctagttccatggtgaatggcgttgtaagactgctaacaaagccgtgggatgtggtccctatggtgacccagatggcgatgactgacacgacaccctttggtcagcaacgcgttttcaaagagaaggtggataccaggactcaggagccaaaagaagggaccaagaagctcatgaaaatcacagccgagtggctgtggaaggaattgggcaaaaagaaaacgcctcggatgtgtaccagagaggagtttactcgcaaggtcaggagcaacgcagctctgggcgccatattcacagacgaaaacaaatggaagtcagcacgagaggccgtggaagattcccggttttgggagctcgtagacaaggaaagaaatcttcacctggagggcaaatgcgagacctgtgtgtacaacatgatggggaagagggagaaaaagttaggagagttcggtaaagctaagggctctcgcgccatctggtatatgtggctgggggcgagatttttggagttcgaggcactcggatttctgaatgaagatcattggttcagccgggagaacagtctatccggcgttgagggtgaagggcttcacaagctgggatacattctcagagacgtcagcaaaaaggagggcggcgccatgtacgctgacgatactgccgggtgggacacaaggatcaccctggaagatttgaaaaatgaggaaatggtgacaaaccatatggagggagagcacaagaaactggcagaagctatttttaagctcacttatcagaataaggtggtccgcgttcagcgacccaccccacggggtacggtgatggacatcatttctagaagggatcaacgcggctcagggcaggtaggaacctacggccttaacacattcactaatatggaggcccagctgataagacaaatggaaggtgaggggatcttcaaaagtattcagcatttaaccgtgacagaggaaatcgctgtccagaactggctggcccgggtgggaagggagcgtttgtcccgaatggcaatcagcggcgacgattgcgttgtgaagcccctcgacgatcgctttgcgtctgccctgactgctctaaatgacatgggcaaagtcagaaaggatattcagcaatgggaaccttcgcgggggtggaacgactggacccaggtgccattctgctcacaccactttcatgagcttataatgaaagatggaagggtactggttgtgccgtgtcgcaatcaggacgaactcatcggtagagcccggattagccagggcgcagggtggtccctgaaggagacggcttgcttgggaaagagttatgcccaaatgtggtctttaatgtacttccacaggcgagacctgcgtctcgcagccaacgcgatctgtagcgctgtcccctcccattgggtgcctacatcaagaaccacttggagtattcacgccaaacacgagtggatgacaaccgaagatatgcttactgtgtggaatcgcgtctggatccaggagaacccatggatggaagacaagacccccgttgagtcttgggaagaggtgccttatctgggcaaacgggaggatcagtggtgcggtagcctaatagggctgacatccagggcaacgtgggccaagaacatccagaccgctattaatcaagtaagatcactcatcggaaacgaagagtacactgactatatgccaagcatgaaacgctttcggagggaagaggaagaggccggcgtgttgtggtga

SEQ ID NO: 14935 - RNA, 9876 nt, synthetic construct
  misc_feature 1..9876: note = derived and/or modified CDS sequence (opt3) from DENV-2__FM210227__SS-prME
  source 1..9876: mol_type = other RNA
accgccggagtgatcattatgctgataccaactgctatggcattccacctcactacgaggaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtcgcgctggtgccccatgtcggtatggggcttgagacccggacagaaacttggatgagtagcgagggagcttggaaacacgcccagaggatcgagacctggatactgcggcatcctggcttcacaatcatggcagccattttggcttacaccatcggcacgactcactttcagcgcgcactcattttcatcctgctgacagccgtggctccatccatgaccatgagatgcatagggatttctaacagggattttgttgaaggagtgtcgggtggctcatgggtcgacatcgtgctcgagcacgggagctgtgtaactacaatggccaagaataagcccaccttagatttcgaactgattaaaacggaggcgaagcagcctgcaacccttcggaaatattgcatcgaagccaagttgacaaacactaccacagagagtcgctgtccaactcaaggagagccctccctgaatgaggaacaggacaaacgatttgtttgcaagcattctatggtggatagaggctggggtaacgggtgtggactgttcggcaagggcgggatcgtaacctgcgctatgtttacatgcaaaaagaatatggaaggaaaaattgtgcagcctgagaacctcgaatacaccatagtgatcactccacacagcggtgaggagcatgccgtcggcaatgacacggggaagcacggaaaagaaattaagatcacaccgcagtcctcagttaccgaggcagaactgactggctatggtaccgtgacaatggagtgtagtcccaggaccgggcttgatttcaacgaaatggtactgttgcaaatggaggacaaggcttggctcgtgcaccggcagtggtttctggatttacctctgccatggctccccggcgccgacactcagggaagcaattggatacagaaggagacacttgtcacgttcaagaaccctcatgcgaaaaagcaagacgtggttgtgctgggctctcaggaaggggccatgcacaccgcattgactggagctacagagattcagatgtcctcaggtaatctactgtttaccggccatctcaaatgccgtctgcgcatggataaacttcaactgaaagggatgagctacagtatgtgtacaggaaagttcaagatcgtcaaagaaatcgccgagactcagcacggcaccattgtgatcagagtacagtatgagggtgacgggtctccatgcaagattcccttcgaaataatggatttggagaaaaggcatgttctcggccggctgatcacggtgaacccgattgtcaccgaaaaggactcccctgtgaacatcgaggctgaacccccatttggagatagctacatcattataggcgtcgagcctgggcagttaaaactgaattggttcaagaagggatcgtctatcggtcaaatgtttgagacaactatgcgaggcgccaaacgcatggcaattctaggggacaccgcctgggatttcggatccctcggcggtgtgtttacatcaatcgggaaggctctgcaccaggttttcggcgcgatttacggagcagcctttagtggcgtgagctggactatgaaaatccttataggggctatcattacctggatcggaatgaactccagatctacgagcttgtcagtaagtctggtcctcgtgggcgttattacactgtatcttggtgccatggtgcaggcagactccgggtgtgtcgtgagctggaagaataaagaactgaagtgcggatctggcatcttcataaccgataacgtacacacttggacagagcagtacaagtttcaacccgaatcaccaagtaaattggccagcgctattcagaaggcccatgaggaaggtatctgtggcattaggtccgtgacccggctcgagaatctgatgtggaaacagatcactcccgagttaaaccacatactgtctgaaaatgaggttaagctaaccatcatgacaggggacattaaaggaatcatgcaggcaggcaagcgctcgctcagacctcaaccaacggaactgaaatatagctggaagacctgggggaaggcgaaaatgctttccactgagtcacataaccagacattcttgattgatggaccggaaaccgctgagtgccccaatacaaacagggcctggaatagtctggaggtcgaagactacggctttggtgtgttcactaccaacatctggctcaagctgcgtgagaaacaggacgtgttttgtgattctaagttaatgagcgcagccataaaagacaatcgggctgtccacgccgatatggggtattggattgaatccacgctgaacgacacatggaagatggagaaggcatcattcatcgaggttaaaagctgccactggcctaagtctcataccctttggtccaatggagtgttggaaagtgagatgatcattccaaagagcttcgctggccccgtgtctcagcacaactaccgacctggttatcatactcaaaccgccggcccatggcacctcgggaagctggaaatggattttgacttctgtgagggaacaactgtagtcgtgaccgaagattgcggcaacagagggccctccctaaggacaacgaccgcgtcaggaaaactgatcactgagtggtgctgtcgcagttgcacactcccgcctctgcggtacagaggcgaggacggttgttggtacgggatggaaattaggccacttaaggagaaggaagagaatttggttaacagcctggtgaccgccggacatggccagatagataatttttcgttaggtgtcctcggcatggctctgttccttgaagagatgctgcgcactcgagtggggacaaaacacgcaatcttgctcgttgccgtgtcctttgtaaccctgattacgggaaacatgtctttccgggacctaggccgtgtcatggtgatggtgggggctactatgaccgatgacatcggaatgggcgtcacatatctggccctcctggcagcgtttaaggttagacccaccttcgccgctggtcttttgctgaggaaattaactagcaaggagctcatgatggccacaattgggatcgcactgctttcacagagtaccatacctgaaacaatcctggagctaactgatgctctcgccctgggaatgatgattttgaaaatcgtgcgcaatatggaaaagtaccaactggcagtaaccattatggccatctcctgcgtgcccaacgctgtcatattacagaatgcgtggaaggtgtcttgtacgattctcgccgcagttagcgtgtccccactgcttctgacatcaagccagcagaaagctgactggatccctttggccctcaccatcaagggcctgaaccccactgccatttttctaaccacactgagtcggacttctaaaaagagatcctggccacttaatgaggctataatggcagtcggcatggtgagcatcctcgcctcgtcactgttgaaaaacgacattccgatgaccgggcctctggttgcgggaggtttactcacggtgtgctatgtcctgacaggcaggtctgctgatcttgaactggagcgagccaccgacgtaaagtgggaggatcaagcagaaatcagtgggtccagccccattttgtctatcactataagcgaggacggatccatgtcaatcaaaaatgaagaggaggaacagacactcaccattctgatccgcactggcctactggtgattagtggtcttttcccagttagcatccccataacagccgctgcatggtacctctgggaggtgaagaagcagcgggccggggtcctgtgggatgtgccttctccaccccctgtaggaaaagcggaattggaggacggcgcttatagaattaagcagaaaggcatcttagggtactcccaaatcggagccggtgtgtataaggaaggcacctttcacacgatgtggcatgtcactagaggggcagttctgatgcaccgtggaaaacgcattgagccgtcatgggccgatgtgaagaaggacctcatcagttacggcggtgggtggaaactggagggagaatggaaggagggcgaagaggtgcaggtccttgctctggaaccaggcaaaaacccccgggccgtgcagaccaagcctgggttgttcaaaacaaataccggaacaataggtgcagttagcctagatttttccccaggcacttctgggtcgcccattgtagacagaaagggaaaggtggtcggcctgtacggtaacggggtggttaccaggagcggagcttatgtgtcagccatcgcgcagacggagaaatccattgaggataatcctgaaatcgaggacgatatattccgaaagaaacggctcacaattatggacctgcatccgggcgccggcaagactaaacgctaccttcccgcaatcgtcagagaagctatcaagagggggttacggaccctgattctcgccccaacacgagtggtagctgcagagatggaagaggccttgagaggactgcctatccgctatcaaacccccgccattagggctgagcacactggtcgtgaaatagtcgacctcatgtgtcatgcgaccttcacaatgcggctgcttagtccagtgagagttcctaactacaacctgatcattatggatgaggcacactttacggaccccgcctctatcgctgccaggggctatatcagcactcgcgtggaaatgggggaggcagccggaattttcatgaccgctacaccaccgggctcccgagatccttttccccagtcaaatgcgccaataatggacgaggaaagagagatccccgaacggtcttggaacttcggtcacgagtgggtcaccgattttaaggggaaaactgtgtggttcgttcctagcattaaggccggaaatgacatcgcagcttgcttgaggaaaaacggcaagaaagtgattcagctaagtcgcaagacatttgattccgaatacgtcaagacccgtacgaatgactgggatttcgtggtaactacagacatcagcgagatgggcgccaactttaaagcagagagagtgatagatccacggaggtgtatgaagcccgttatcctgaccgacggggaagaacgcgtcattctcgccggacctatgccggtgacccattcttcagctgcccaacgaagaggtcggatcggcaggaatcccaaaaacgaaaatgaccagtatatttacatgggggagcccttagaaaacgatgaggactgcgcgcactggaaggaggcaaaaatgctgcttgataatatcaacactcctgaaggaataattccctccatgttcgagccagaacgcgagaaggtggacgccatcgatggcgaatacagactgaggggtgaggctcggaaaacatttgtcgacctcatgcgtcgcggggatttgcctgtatggctggcctatcgagtggctgcagagggcattaattacgccgacagaaggtggtgtttcgatggagttaagaacaatcagatcctcgaagagaacgtggaagtcgagatatggaccaaggagggcgaacggaaaaagctgaaaccccgctggcttgacgctagaatctatagtgatccactagccctgaaggagttcaaagaatttgcagcggggaggaaaagcctaacattaaacctgattactgagatgggacggctccctacgttcatgacccagaaggcccgagacgctctggataatcttgccgtgctgcatacagcagaagctggtggcagagcctacaaccacgcactctcggagttgccggagactctggaaaccctactgctccttacactgttagccaccgttactgggggaatctttttgttcctgatgtctggcaaaggtgtggggaagatgacgctcggcatgtgctgcattatcaccgcttccatactgctttggtatgcgcaaattcagccccactggatcgccgcaagcatcattctggagtttttcctcatcgtcttgctgataccagaacctgagaaacagcgcacaccccaggacaatcaattaacttacgtggtaattgctatcctaaccgtggttgccgccacaatggcaaacgaaatgggatttctggagaagaccaaaaaggacctcggccttgggtcagtcgctactcaggagccagaaagtaatattctggatatcgacttgaggcctgcctctgcgtggacactgtatgctgtggccacgaccttcgtgactcccatgctccggcattccatagagaacagctcagtcaatgttagtctgacagcaatcgccaaccaggctaccgtgcttatgggactcggtaagggctggccgctgagcaaaatggatattggggtaccattgctggcaatcggatgttactcccaggtgaatcctattaccttaacagccgcgctactgctccttgtcgctcactacgccatcattggccccggtctgcaagcaaaggccactcgtgaagctcagaaaagagccgcagctgggatcatgaagaacccaacggtggacggcataaccgttattgatttggaccccatcccttatgatccgaaatttgagaagcagctgggacaggtgatgctcctgatcctttgcgtcacacaagtattaatgatgaggactacctgggccctgtgtgaagcgctcacattggccaccggccccatttctactctgtgggaggggaatccaggacgcttctggaacacgacaatagcagtgagcatggctaatatctttcggggctcctacctagccggtgcagggctactcttctcaattatgaagaacaccactaatacccgaagaggaacaggcaacatcggtgagactcttggcgaaaaatggaagtctaggctgaatgctttggggaaaagtgagtttcagatttataagaaatcgggaatccaggaagttgaccgcaccctggccaaggagggcataaaaagaggggagacagatcatcacgccgtgagcagaggatccgcgaagctccgttggttcgtcgaaaggaacatggtgacgcctgagggcaaggtcgtggacctgggttgcgggcggggaggctggtcttactattgtggtggcttgaaaaacgttcgcgaagtgaaggggcttaccaaaggaggccccgggcatgaggaacctatcccaatgtcaacttacggatggaatctggtacgactccaaagcggcgtggatgtcttctttacaccccctgagaagtgcgacaccctactgtgtgatattggtgagtccagtccaaaccccactatcgaagctgggagaacattgagggttctgtctctcgtggagaattggcttaacaatgacacccagttctgcattaaagtcctgaacccgtatatgcctagcgtgatcgaaaagatggagacgttgcagcggaagtacggaggcgcactggtacgcaatccactctcaagaaactccacccacgaaatgtactgggtgagtaatgccacaggcaacatagttagctctgtgaatatgatttccaggatgttaatcaaccgatttactatgaaacacaagaaagctacctatgagcccgacgtcgatctggggtcaggaacacggaatatcggtattgagagcgaaatacctaaccttgacatcattggcaagcgtatcgagaaaattaagcaggaacatgagacttcgtggcactacgatcaagaccatccatataagacctgggcctaccacgggtcttatgaaacaaaacagaccggaagtgcatccagcatggtgaatggcgtcgtgagactgctaactaagccctgggatgttgtaccgatggtgacgcagatggccatgacagacaccactcctttcggtcagcaacgcgtctttaaagagaaggtggataccaggacacaggagcccaaagaagggacgaagaagctcatgaaaatcaccgctgagtggctgtggaaggaattgggcaaaaagaaaactccacggatgtgtacaagagaggagttcacccgcaaggttaggtcaaacgcggccctgggcgcaatatttactgacgaaaacaaatggaagtccgctcgagaggccgtggaagattctcggttctgggagctcgtcgacaaggaaagaaatcttcacctggagggcaaatgcgagacatgtgtgtacaacatgatggggaagagggagaaaaagttaggagagtttggtaaagcaaagggcagccgcgccatctggtatatgtggctgggggctcgtttcttggaatttgaggccctcggattcctgaatgaagatcattggtttagtcgggagaactccctaagcggcgtagagggtgaagggcttcacaagctgggatacattctcagagacgtgtctaaaaaggagggcggcgcgatgtacgcagacgataccgccgggtgggacacaaggatcactctggaagatttgaaaaatgaggaaatggttaccaaccatatgggaggtgagcacaagcgcctggctgaggccattttcaaactcacgtatcagaataaggtcgtgcgagtgcagcggcctacccccagaggcacagtcatggacatcatttcaaggcgcgatcaaagagggagtggacaggttggcacttacggtcttaacaccttcacaaatatggaagcacagctgatacggcaaatggagggggaaggaatctttaagtccattcagcatttaactgtgaccgaggagatcgctgtacagaactggctggccagggtgggccgtgaacgattgagccgcatggctatctctggcgacgattgcgtcgtgaaaccactcgacgatagattcgcctcggcactgacggcgctaaatgacatggggaaggttcggaaagatattcagcaatgggagccctcaaagggatggaacgactggacacaggtgcctttttgcagccaccacttccatgatcttataatgaaagacggtagggtcctggtggtaccatgtcgcaatcaggacgaactcatcggcagagcccggatttcccagggggctggatggagtctgaaggagaccgcctgcttgggcaagtcttatgcacaaatgtggagcttaatgtactttcacaggcgagatctgcgtctcgctgccaacgcaatctgttccgccgttccgtcacattgggtgcccacaagtagaacaacctggtctattcacgcgaaacacgaatggatgactaccgaggacatgcttacagtctggaatcgcgtgtggatccaggagaacccttggatggaagataagacgccagtggagagctgggaagaggtcccctatctgggtaaacgggaagaccagtggtgcgggtccctaataggactgacctcaagggctacttgggccaagaacatccagacagcaattaatcaagttagaagcctcatcggcaacgaggagtacaccgattatatgccttctatgaaacgcttccggagggaagaggaagaggccggcgtgttgtggtga

SEQ ID NO: 14936 - RNA, 9876 nt, synthetic construct
  misc_feature 1..9876: note = derived and/or modified CDS sequence (opt3) from DENV-2__FM210204__SS-prME
  source 1..9876: mol_type = other RNA
accgcaggagtgatcattatgctgatacccaccgctatggcattccacctcactacgagaaacggggaacctcatatgatcgtcgggaggcaggaaaagggtaaaagccttctgtttaagaccgaggacggcgttaatatgtgcacattgatggccattgatttaggggaactgtgtgaggacactatcacctacaaatgcccacttctccggcaaaacgaaccggaggatattgactgttggtgcaattccacatctacctgggtgacttatggaacatgtaccacgactggcgagcaccgccgagaaaagcgttcagtcgcgctggtgccccatgtcggtatggggcttgagaccagaacagaaacttggatgagtagcgagggagcttggaaacacgcccagaggatcgagacctggatactgcggcatcctggcttcacaatcatggcagccattttggcttacaccatcggcacgactcactttcagcgcgcactcattttcatcctgctgacagccgtggctccatccatgaccatgagatgcatagggatttctaacagggattttgttgaaggagtgtcgggtggctcatgggtcgacatcgtgctcgagcacgggagctgtgtaactacaatggccaagaataagcccaccttagatttcgaactgattaaaacggaggcgaagcagcctgcaacccttcggaaatattgcatcgaagccaagttgacaaacactaccacagagagtcgctgtccaactcaaggagagccctccctgaatgaagaacaggacaaacgatttgtttgcaagcattctatggtggatagaggctggggtaacgggtgtggactattcggcaagggcgggatcgtaacctgcgctatgtttacatgcaaaaagaatatggaaggaaaaattgtgcagcctgagaacctcgaatacaccatagtgatcactccacacagcggtgaggagcatgccgtcggcaatgacacggggaagcacggaaaagaaattaagatcacaccgcagtcctcagttaccgaggcagaactgactggctatggtaccgtgacaatggagtgtagtcccaggaccgggcttgatttcaacgaaatggtactgttgcaaatggaggacaaggcttggctcgtgcaccggcagtggtttctggatttacctctgccatggctccccggcgccgacactcagggaagcaattggatacagaaggagacacttgtcacgttcaagaaccctcatgcgaaaaagcaagacgtggttgtgctgggctctcaggaaggggccatgcacaccgcattgactggagctacagagattcagatgtcctcaggtaatctactgtttaccggccatctcaaatgccgtctgcgcatggataaacttcaactgaaagggatgagctacagtatgtgtacaggaaagttcaagatcgtcaaagaaatcgccgagactcagcacggcaccattgtgatcagagtacagtatgagggtgacgggtctccatgcaagattcccttcgaaataatggatttggagaaaaggcatgttctcggccggctgatcacggtgaacccgattgtcaccgaaaaggactcccctgtgaacatcgaggctgaacccccatttggagatagctacatcattataggcgtcgagcctgggcagttaaaactgaattggttcaagaagggatcgtctatcggtcaaatgtttgagacaactatgcgaggcgccaaacgcatggcaattctaggggacaccgcctgggatttcggatccctcggcggtgtgtttacatcaatcgggaaggctctgcaccaggttttcggcgcgatttacggagcagcctttagtggcgtgagctggactatgaaaatccttataggggctatcattacctggatcggaatgaactccagatctacgagcttgtcagtaagtctggtcctcgtgggcgttattacactgtatcttggtgccatggtgcaggcagactccgggtgtgtcgtgagctggaagaataaagaactgaagtgcggatctggcatcttcataaccgataacgtacacacttggacagagcagtacaagtttcaacccgaatcaccaagtaaattggccagcgctattcagaaggcctatgaggaaggtatctgtggcattaggtccgtgacccggctcgagaatctgatgtggaaacagatcactcccgagttaaaccatatactgtctgaaaatgaggttaagctaaccatcatgacaggggacattaaaggaatcatgcaggcaggcaagcgctcgctcagacctcaaccaacggaactgaaatacagctggaagacctgggggaaggcgaaaatgctttccactgagtcacacaaccagacattcttgattgatggactggaaaccgctgagtgcccgaatacaaacagggcctggaatagtctcgaggtcgaagactatggctttggtgtgttcactaccaacatctggctgaagttacgtgagaaacaggacgtgttttgtgattctaagctgatgagcgcagccataaaagacaatcgggctgtccatgccgatatggggtactggattgaatccgcacttaacgacacgtggaagatggagaaggcttcattcatcgaggttaaaagctgccactggcccaagtctcacacattgtggtccaatggagtgctcgaaagtgagatgatcattcctaagtccttcgccggcccagtgtctcagcataactatcgacccggttaccacacccaaactgcgggcccttggcatctggggaagctagaaatggattttgacttctgtgagggaaccacagtagtcgtgactgaagattgcggcaacagagggccatccctgaggaccacaacggcctcaggaaaactcatcaccgagtggtgctgtcgcagttgcactctgcccccgcttcggtacagaggcgaggacggttgttggtatgggatggaaattaggcctttgaaggagaaggaagagaatctggttaacagcttagtgacagctggacacggccagatagataatttttcgctcggtgtcctgggcatggcacttttcctggaagagatgttgcgcacccgagtggggactaaacatgccatcctcctggttgctgtgtcctttgtaacactaattaccggaaacatgtctttcaaggacctgggccgggtcatggtgatggtgggggccacgatgactgatgacatcggaatgggcgtcacctacctcgcactgcttgcggcctttaaagttcgtccaacattcgctgccggtttgctgttaagaaagctcaccagcaaagagctgatgatggcaactattgggatcgcacttctgtcacagagtacaatacccgaaaccatcctagagctcacagatgccctggcattgggaatgatggtgctgaagattgtaaggaatatggaaaagtatcaattagccgtgactatcatggctatttcctgcgtccctaacgcggtgatcctccagaatgcctggaaagtttcttgtaccatactggcagctgtgagcgtcagcccccttctgttgacgtcaagccagcagaaggccgactggattccactcgccctgacaatcaaaggcctaaaccctaccgctatctttctgactacccttagtcgcacatctaagaaacggtcctggcccctcaatgaggcaattatggccgtgggcatggttagcatactggcgtcgtcattgctgaagaacgacatcccaatgactgggccgttagtggctggaggtctcctgaccgtctgctacgtacttacgggcagatctgccgatctggaattggagagggcaacagacgtgaaatgggaggatcaagccgaaattagtgggtccagccctatcctctctattaccatcagcgaggacggatccatgtcaataaagaatgaagaggaggaacagactctgacaatcctaattcgaaccggcctgcttgttatcagtggtctcttccccgtgagcattccaatcactgctgcagcctggtatctgtgggaggtcaagaaacagcgcgcgggggtgttgtgggatgtaccctctcctccacccgtgggaaaggctgaattagaggacggcgcctaccggataaaacagaagggcattctggggtattcccaaatcggagccggtgtctacaaagaaggcacatttcacaccatgtggcacgttacgagaggggcagtgctcatgcataggggaaagcgtatcgagccttcatgggctgatgtgaagaaagacctgattagttacggcggtgggtggaaacttgagggagaatggaaagagggcgaagaggtccaggtgctggccttggaaccgggcaagaacccacgcgcagttcagactaaacccgggctattcaagaccaatacaggaaccatcggtgctgtaagcctggatttttcccctggcacatctgggtcgccaatagtggaccggaagggaaaagtcgtgggcctctatggtaacggggttgtgactagaagcggagcctacgtctcagcgattgcccagaccgagaagtccatcgaggataatcccgaaattgaggacgatatcttcaggaaaaagcgactgacgataatggaccttcaccctggcgcaggcaaaacaaagcggtatttaccggctattgtgcgcgaagccatcaagagagggctgaggactctcatcttggctcccacccgggtagtcgcagccgagatggaagaggccctgcgaggactcccaattagataccaaacccctgctatccgcgcggagcatacaggtagggaaattgtggacctgatgtgtcacgcaactttcaccatgcgtcttctgagtcccgttcgggtgccaaactataacttgataatcatggatgaggcccattttacagaccctgcttctattgccgcaagaggctacatcagcacgagggtcgaaatgggggaggccgctggaatcttcatgactgcgacacccccaggctcccgcgatccgtttcctcagtcaaatgcccccattatggacgaggaacgagagataccagaaagatcttggaacagcggtcacgagtgggtgacagatttcaaagggaagaccgtttggtttgtgcccagtatcaaagcaggaaatgacattgctgcctgcctacggaagaacggcaaaaaggtcatccagctgtccaggaagactttcgatagcgaatatgtgaaaacacgcaccaatgactgggattttgtagtgacgactgacatttctgagatgggcgcaaacttcaaggccgagcgtgttatcgatcctagacggtgtatgaaaccagtcatactcacagacggggaagagagggtgatcttagctggacccatgcctgtgacccactcatccgccgcgcaacgccgaggtagaattggccggaatccgaagaacgaaaatgaccagtacatctacatgggggagccactggaaaacgatgaggactgcgcacattggaaagaggccaagatgcttctggataatattaacacccccgaaggaatcatacctagtatgtttgagcccgaaagggagaaagtcgacgctattgatggcgaatatcgcctcagaggtgaggccaggaagactttcgtagacttgatgcggcgtggggatctgccagtgtggctcgcttaccgcgttgcagccgagggcatcaattatgctgaccgaagatggtgttttgatggagtgaagaacaatcagattctggaagagaacgtcgaagtggagatctggacaaaagagggcgaaaggaagaaacttaagcctcggtggctagacgcccgcatatacagcgatcccctggcattgaaagagttcaaggagttcgcggccgggagaaagtcgttaaccctgaacctcatcacagagatgggaaggctgccaacttttatgacgcagaaagctcgggacgcccttgataatctggcagttctccacaccgctgaagccggtggccgagcatataaccatgccttgtctgagctgcctgagacactagaaactctgctccttctgaccttattggctacagtgaccgggggaattttcctgtttctcatgtccggcaagggtgtcgggaaaatgactctgggcatgtgctgcatcattacggcgagcatccttctgtggtacgcccaaatacagccgcactggattgcagcttcaatcatcctcgagttctttttgattgtgctgttaatccccgaaccagagaagcagagaacccctcaggacaatcaactaacatatgtagtgatagccattctgactgttgtcgccgcaaccatggctaacgaaatgggattcctcgagaaaacaaagaaggaccttggcctggggagtgtggccacccaggagcccgaatctaatatcttggatattgacctgcgcccagcgtccgcttggactctctacgccgtggcaacaacgtttgtcacccctatgctgaggcacagcatcgagaactcaagtgttaatgtgagccttactgccatagctaaccaggcaacagtactcatgggactgggtaaaggctggcccttgtccaagatggatatcggggtgccgctgttagccattggatgttactctcaggtcaatccaatcaccctaaccgcggctctgctccttctggtggcccattatgcaattatcggccctggtttgcaagccaaagctacacgggaagcccagaagcgtgcagctgccgggattatgaaaaaccccactgttgacggcatcacggtgatagatctggacccaattccctacgatcctaagttcgagaagcagctcggacaggtcatgctgcttatcttatgcgtaacccaagtgctgatgatgagaacaacttgggcgctctgtgaagccttgaccctggcaacaggcccgatcagcaccctatgggaggggaatcccggaaggttttggaacactacgattgctgtttccatggccaatatattccgcggctcatatctggctggtgctgggctcctattttctatcatgaaaaacacaaccaatactcggcgaggaaccggcaacattggtgagacactgggcgaaaagtggaaaagtagattgaatgccctggggaagtcggagttccagatctacaaaaagagcggcattcaggaagtggacaggactctcgccaaagagggcatcaagcgcggggagaccgatcaccatgcggtctcccggggatctgctaagctgagatggtttgtggaacgtaacatggtcacaccagagggcaaagtggttgacttaggttgcgggaggggaggctggtcatattactgtggtggccttaagaacgtgcgggaagtaaaagggctgacgaagggaggccctgggcacgaggaacccatacctatgagcacctatggatggaatctcgtgcgcctacaatccggcgtcgatgttttcttcactccacccgagaaatgcgacacactgttgtgtgatatcggtgagagttctcctaacccaaccattgaagcagggcgaactctgagagtgctcagccttgtcgagaattggctgaacaatgacacacagttttgcatcaaggtgttgaacccctacatgccgcctgtaattgaaaagatggagaccctgcagaggaaatacggaggcgccctcgtgcggaatccattatcacgcaactccacgcatgaaatgtattgggttagtaatgctaccggcaacatcgtgagctctgtcaatatgatatccagaatgctgattaacaggttcacaatgaagcacaaaaaggccacttacgagcccgacgtggatcttgggtcaggaacccgaaatatcggtatcgagagcgaaattcctaacctggacataatcggcaaacggattgagaagatcaagcaggaacacgagacatcgtggcattatgatcaagaccacccatacaaaacttgggcatatcatgggtcttacgaaaccaagcagacaggaagtgcctccagcatggtcaatggcgtggttcgtctactcaccaaaccctgggatgtagtgccgatggtcactcagatggctatgacggacacaaccccttttggtcagcaaagagtgttcaaggagaaagttgatactcgcacccaggagcccaaggaagggacaaagaaactgatgaagattacggcggagtggttgtggaaagaactgggaaagaaaaagaccccaaggatgtgtactcgggaggagtttacaagaaaagtgcgctcaaacgccgcactcggcgctatcttcaccgacgaaaacaagtggaagtccgccagggaggcagtcgaagattctcgattttgggagcttgtggacaaagaacggaatctgcacttagagggcaagtgcgagacttgtgtatataacatgatggggaaaagagaaaagaaactgggagagttcggtaaggccaagggcagcagggctatatggtacatgtggttgggggcccgctttctcgagttcgaggcgctgggatttctaaatgaagatcactggttcagtcgtgagaactcccttagcggcgtggagggtgaagggctgcataaactcggatacatcctgcgggacgtttctaagaaagagggcggcgcaatgtatgccgacgatacagctgggtgggacaccagaattacattggaagatctgaagaatgaggaaatggtcactaaccacatggagggagagcataaaaggctcgccgaagcaatctttaaacttacctaccagaataaggtggtgcgcgtccagcgacctacgccccggggtaccgttatggacattatctcaagaagggatcaacgcggcagtggacaggtgggaacatatggcctgaacactttcaccaatatggaggctcagttaattagacaaatggaaggtgaggggatattcaaatccatccagcacctgacagtaactgaggaaattgccgtgcagaactggttggctcgggtcggaagggagcgtctcagccgaatggccatctctggcgacgattgcgtggttaagccactggacgatcgctttgcatcggcgctaaccgcccttaatgacatgggcaaagtgagaaaggatatccagcaatgggaaccctcaaaagggtggaacgactggacgcaggtccctttctgcagccatcactttcacgatctgattatgaaggacggacgggtgctcgtagttccatgtaggaatcaggacgagctgataggtcgcgctagaatctcccagggcgccgggtggagtttgaaggaaacagcatgcttaggaaaatcttacgctcaaatgtggagcctgatgtatttccatcggagggatctccgacttgccgcaaacgccatttgttccgcggtgccgtcacactgggtccccaccagtcgtactacatggtctatccatgctaagcacgagtggatgaccactgaggacatgctgaccgtgtggaatagagtgtggattcaggaaaacccttggatggaggataaaacaccagtcgaaagctgggaggaagttccctacctaggcaagcgcgaggaccagtggtgcggttccctgatcgggctcacgtcacgggccacctgggccaagaacatacagactgccatcaatcaagtgaggagcttgattggaaacgaggaatatacagattacatgccttctatgaagagatttcgccgggaggaagaggaagctggcgtactgtggtga

SEQ ID NO: 14937 - RNA, 9876 nt, synthetic construct
  misc_feature 1..9876: note = derived and/or modified CDS sequence (opt3) from DENV-2__FM210230__SS-prME
  source 1..9876: mol_type = other RNA
accgccggagtgataattatgctgatacccacagctatggcattccacctcactacgaggaatggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagacccggacagaaacttggatgagtagcgagggagcttggaaacacgcccagaggatcgagacctggatactgcggcatcctggcttcacaatcatggcagccattttggcttacaccgtgggcacgactcactttcagcgcgcactcatcttcattctgctggccgctgttgccccatccatgacaatgagatgcatcgggatatctaacagggattttgtggaaggagtctcgggtggctcatgggtggacattgtactcgagcacgggagctgtgttaccactatggcgaagaataagcccacattagatttcgaactgatcaaaaccgaggcaaagcagcctgccacgcttcggaaatattgcattgaagctaagttgaccaacacaactaccgagagtcgctgtccaacacaaggagagccctccctgaatgaagaacaggacaaacgatttgtgtgcaagcattctatggtcgatagaggctggggtaacgggtgtggactattcggcaagggcgggatcgtgacttgcgccatgtttacctgcaaaaagaatatggaaggaaaaatcgtgcagcctgagaacctcgaatacacaattgtcataaccccacacagcggtgaggagcatgcagttggcaatgacactgggaagcacggaaaagaaatcaagattacgccgcagtcccccatcacagaggctgaactgaccggctatggtactgtgaccatggagtgttcacctaggacagggcttgatttcaacgaaatggtactgttgcaaatggaggacaaagcctggctcgtgcaccggcagtggtttctggatttaccactgccctggctccctggcgcggacacccagggaagtaattggatacagaaggagactcttgtcacattcaagaacccacatgccaaaaagcaagacgtggttgtgctgggcagccaggaaggggcaatgcacacggctttgaccggagccactgagattcagatgtcttccggtaatctactgtttacaggccatctcaaatgccgtctgcgcatggataaacttcaactgaaagggatgtcatacagcatgtgtaccggaaagttcaagatcgtcaaagaaatcgctgagacacagcacggcactattgtgatcagagtacagtatgagggtgacgggagtccctgcaagattccgttcgaaataatggatttggagaaaaggcatgttctcggccggctgatcaccgtgaaccctattgtcacggaaaaggactctcccgtgaacatcgaggccgaaccaccttttggagattcctacatcattataggcgtcgagcccgggcagttaaaactgaattggttcaagaagggaagctcgatcggtcaaatgtttgagaccacaatgcgaggcgcaaaacgcatggccattctaggggacactgcttgggatttcggatctctcggcggtgtgtttacctccatcgggaaggcgctgcaccaggttttcggcgcaatttacggagccgctttttcaggcgtgagttggacaatgaaaatccttataggggtaatcattacttggatcggaatgaacagcagatccacctctttgagcgtctcactggtgctcgttggcgtgattacgctgtatcttggtgccatggtccaggcagacagtgggtgtgtggtatcctggaagaataaagaactgaagtgcggaagcggcatcttcataacagataacgtgcacacctggactgagcagtacaagtttcaaccagaatctccctcaaaattggccagtgctattcagaaggcccatgaggaaggtatctgtggcattaggagcgttacacggctcgagaatctgatgtggaaacagatcacccctgagttaaaccacatactgtccgaaaatgaggtcaagctaactatcatgaccggggacattaaaggaatcatgcaggcaggcaagcgctctctcagaccacaaccgacagaactgaaatattcgtggaagacgtgggggaaggcgaaaatgcttagcaccgagtcccataaccagactttcttgattgatggacccgaaacagctgagtgccctaataccaacagggcctggaactcactggaggtggaagactacggctttggtgtgttcacaactaacatctggctcaagctgcgtgagaaacaggacgtcttttgtgatagtaagttaatgtctgcagccataaaagacaatcgggctgttcacgccgatatggggtattggattgaaagcgcactgaacgacacctggaagatggagaaggcttccttcatcgaggtgaaatcatgccactggccaaagagccatacgctttggtctaatggagtgttggaatccgagatgatcattcccaaaagtttcgccggccctgtaagccagcacaactaccgaccaggttattacacacaaaccgcgggcccctggcatctcgggaagctggaaatggattttgacttctgtgagggaactaccgtcgtggttacagaagattgcggcaacagagggccgtctctaaggactaccacagcctccggaaaactgatcacggagtggtgctgtcgctcatgcaccctccctccactgcggtacagaggcgaggacggttgttggtatgggatggaaattaggccccttaaggagaaggaagagaatttggtgaacagtctggtcactgctggacacggccagatagataattttagcttaggtgtgctcggcatggcactgttccttgaagagatgctgcgcacacgagttgggaccaaacatgccatcttgctcgtgactgtatcgtttgtcacactgattaccggaaacatgtccttccgggacctaggccgtgtgatggtgatggtcggggctgccatgacggatgacatcggaatgggcgttacttacctggcactcctggcggcctttaaggtgagacctaccttcgctgccggtcttttgctgaggaaattaacatctaaggagctcatgatggcaaccattgggatcgctctgcttagccagtcaactatacccgaaacaatcctggagctaaccgatgccctcgcactgggaatgatggtattgaaaattgtgcgcaatatggaaaagtatcaactggccgtcacaatcatggctattagttgcgtgccaaacgcggttatcttacagaatgcctggaaggtgtcctgtactatactcgcagctgtctctgtgagccctatgctgcttacctcctcacagcagaaagccgactggattcccctggccttgacgatcaagggcctcaacccaacagctatctttctgaccactctaagccggaccagtaaaaagagatcttggccgctgaatgaggcaattatggccgttggcatggtgtccatacttgcgagctcgctcctgaaaaacgacatccctatgacagggcccttggtcgctggaggtctgttaactgtatgctacgtgctcaccggcaggtcagccgatctggaacttgagcgagcaacggacgttaagtgggaggatcaagccgaaatttctgggagttccccaatcctgagcattacaatcgctgaggacggatctatgagcatcaagaatgaagaggaggaacagaccttgactatcctcattcgcacaggcctgctagtgatctccggtctgttccccgtctcaattcctatcaccgcagccgcgtggtatctttgggaggtgaagaagcagcgggctggggtactctgggatgtgccaagtccccctccggtcggaaaagccgaactggaggacggcgcatacagaataaagcagaaaggcattttggggtatagccaaatcggagccggtgtttacaaggaaggcacttttcacacaatgtggcacgtgaccagaggggctgtgttaatgcatcgtggaaaacgcatcgagccatcttgggccgatgtcaagaaggacctgatttcctacggcggtgggtggaaactcgagggagaatggaaggagggcgaagaggtgcaggttctggcacttgaacccggcaaaaaccctcgggctgtacagacgaagccagggctgttcaaaactaataccggaacaatcggtgccgtgtcattggattttagtcccggcaccagcgggtcccctatagtcgacagaaagggaaaggtggttggcctatatggtaacggggtggtcacaaggtctggagcgtacgtgtcggccattgcacagactgagaaaagcatcgaggataatccggaaattgaggacgatatcttccgaaagaaacggctgaccataatggacctccaccccggcgctggcaagacgaaacgctatctgccagccattgtaagagaagctatcaagagggggcttcggacattaatcctggcacctactcgagtcgtggccgccgagatggaagaggctctcagaggattgcccattcgctaccaaaccccagcgatcagggcagagcatacaggtcgtgaaattgttgacctgatgtgtcacgccaccttcactatgcggctcctgtcacctgtgagagtccccaactataaccttataatcatggatgaggctcattttaccgacccagcctccattgcagccaggggctacatcagtacacgcgtggaaatgggggaggctgcgggaatcttcatgacggccactccgcctggctctcgagatccctttccacagagcaatgcacccattatggacgaggaaagagagatacctgaacggtcctggaactcaggtcacgagtgggttaccgatttcaaggggaaaacagtgtggtttgtcccatctatcaaggctggaaatgacattgccgcatgcctgaggaaaaacggcaagaaagtgatccagttgagccgcaagaccttcgatagtgaatatgtaaagactcgtacaaatgactgggattttgtggttaccacggacatttccgagatgggcgccaacttcaaagctgagagagtcatcgatccccggaggtgtatgaagcctgtgatactaactgacggggaagaacgcgtgatcctggccggaccgatgccagtcacacacagctctgcggcacaacgaagaggtcggattggcaggaatcccaaaaacgaaaatgaccagtacatctacatgggggagcctctcgaaaacgatgaggactgcgcccattggaaggaggctaaaatgttactggataatattaacacccccgaaggaatcataccatcaatgtttgagcctgaacgcgagaaggtagacgccattgatggcgaatatagacttaggggtgaggctcggaaaaccttcgtggacctgatgcgtcgcggggatctccccgtttggttggcataccgagtggccgctgagggcatcaattatgccgacagaaggtggtgttttgatggagtcaagaacaatcagattctggaagagaacgtggaagttgagatctggactaaggagggcgaacggaaaaagctcaaaccacgctggctggacgcaagaatatactccgatcctcttgcgctaaaggagttcaaagagttcgccgctgggaggaagagtctgacattgaacttaatcaccgagatgggacggctgccgacatttatgactcagaaggcccgagacgcactcgataatctggctgtgcttcacacggccgaagcaggaggtagagcctataaccatgctctgagcgagctccccgagaccttggaaacactgctactgctcactcttctggcgaccgtcacagggggaattttcttatttttgatgtcgggcaaaggtgtggggaagatgaccctgggcatgtgctgcatcattactgcctctatcctcctgtggtacgcacaaatacagccacactggattgctgcctccatcatccttgagttctttctgattgtactcttgatccctgaacccgagaaacagcgcacgccacaggacaatcaactgacctatgtggttatagccattttaacagtcgtggcagctactatggccaacgaaatgggattcctagagaagaccaaaaaggacctgggcctcgggagcatcgcgacacaggagcctgaatcaaatattcttgatatcgacctgaggcccgctagtgcctggaccttgtacgcagtggccactacatttgtcacgccgatgctgcggcactctatagagaactccagcgttaatgtgtcactcaccgctatcgcaaaccaggccactgtactgatgggacttggtaagggctggccactcagtaaaatggatattggggtgcctctgttggcgatcggatgttacagccaggtcaatcccattacactgaccgctgccttactactgctcgtggcacattatgccatcattggcccaggtcttcaagctaaggccacccgtgaagcacagaaaagagctgccgcggggatcatgaagaaccccacagttgacggcgtgactgtcatagatctggaccctattccgtacgatcccaaattcgagaagcagttgggacaggtaatgctgctcatcctgtgcgtgacgcaagttcttatgatgaggaccacatgggccttatgtgaagcactgactctcgctaccggcccaatctccacattgtgggaggggaatcctggacgcttttggaacaccactattgccgtgtctatggcaaatatattccggggcagctatctggctggtgccgggctactgttttccatcatgaagaacacgacaaatacccgaagaggaactggcaacattggtgagaccctcggcgaaaaatggaagtcaaggcttaatgccctggggaaatctgagttccagatctacaagaaaagtggcattcaggaagtcgaccgcacattggcgaaggagggcatcaaaagaggggaaactgatcaccatgctgtgtcgagaggaagcgcaaagctgcgttggtttgtcgaaaggaacatggtgacccccgagggcaaggttgtggacctcggttgcgggcggggaggctggtcctattactgtggtggcctgaaagatgtacgcgaagtgaaggggttaacaaaaggaggccctgggcacgaggaaccaatacccatgtctacgtatggatggaaccttgtccgactgcaatcaggcgttgacgtgttcttcacccctccagagaagtgcgatactctcctatgtgacatcggtgagagctcccccaatccgacaattgaagccgggagaaccctgagggtcttgagtctggtggagaactggctcaataacgacactcagttttgcatcaaagtacttaatccttacatgccatctgtgattgaaaagatggagacactgcagcggaagtacggaggcgctttggttcgcaaccccctgagcagaaattcaacccatgaaatgtattgggtgtccaacgccacgggcaatatcgtcagtagcgtgaacatgatatctaggatgctcattaatcgattcaccatgaaacacaagaaagcaacatacgagcctgatgtcgacttagggtccggaactcggaacatcggtatcgagtcagaaattccaaatctggatataatcggcaagcgtattgagaaaatcaagcaggaacacgagaccagctggcattatgaccaagatcacccctacaagacatgggcctatcatgggtcgtacgaaactaaacagaccggatctgctagttccatggtgaacggcgttgtaagacttctgacaaagccgtgggacgtggtccctatggtgacccagatggcgatgactgatacgacaccctttggtcagcaacgcgttttcaaagagaaggtggacaccaggactcaggagccaaaagaagggaccaagaagctaatgaaaattacagccgagtggctctggaaggaactgggcaagaagaaaacgcctcggatctgtaccagagaggagtttactcgcaaggtcaggagcaatgcagctttgggcgccatattcacagatgaaaacaaatggaagtcagcacgagaggccgtggaagactcccggttttgggagctggtagataaggaaagaaacctccaccttgagggcaaatgcgagacctgtgtgtataatatgatggggaagagggagaaaaagctgggagagttcggtaaagctaagggctctcgcgccatctggtacatgtggttaggggcgcgttttctggagttcgaggcattgggatttctcaacgaagaccactggttcagccgggagaatagtctgtccggcgttgagggtgaagggctacataaacttggatacattctgagagacgtcagcaaaaagggcggcggggccatgtatgctgatgacactgccggatgggatacaaggatcaccctcgaggacctgaaaaacgaagagatggtgacaaatcacatggaaggtgagcataagaaattggcagaggctatttttaagctgacttaccagaacaaggtggtccgcgttcagcgacccaccccacggggcacggtgatggatatcatttctagaagggaccaacgcgggtcaggacaggtaggcacctatggtctcaatacattcactaacatggaagcccagcttataagacaaatggagggggaaggagtgttcaaaagtatccagcggctgaccgtcacagaggagattgctgtgcagaattggttagccagggttggccgtgaacgactgtcccgcatggcaatcagcggcgatgactgcgtggtcaagcccttggatgacagatttgcgtctgccctcactgctctgaacgatatggggaaagtgcggaaggacatccagcaatgggagccttcgaggggatggaatgattggacccaggtaccattctgctcacaccattttcacgaactaattatgaaagacggtcgcgttcttgtggtcccgtgtagaaaccaggacgagctgataggccgggccaggatcagccagggggcaggatggtccctcaaggaaacggcttgcctgggcaagagttacgcccaaatgtggtctttgatgtatttccaccgacgtgatttaagactggcagccaatgcgatttgtagcgctgtgccctcccattgggtgcctacatcacgcaccacttggagtatccacgccaaacatgagtggatgacaaccgaggacatgctcactgtctggaaccgggtttggattcaggaaaatccatggatggaggataagacccccgtggaatcttgggaggaagtaccttaccttggtaaaagggaggaccagtggtgcgggagcctgatcggactaacatccagagcaacgtgggccaagaacatacagaccgctatcaaccaagtgcgctcactgattggcaatgaggaatatactgattacatgccaagcatgaaacggtttaggcgagaggaagaggaagccggcgtcctctggtga

SEQ ID NO: 14938 - RNA, 9876 nt, synthetic construct
  misc_feature 1..9876: note = derived and/or modified CDS sequence (opt3) from DENV-2__KC762665__SS-prME
  source 1..9876: mol_type = other RNA
accgcaggaatcattataatgatgatccccaccgtgatggctttccacctgactacgcgaaacggggagcctcatatgattgtcagcaggcaggaaaagggaaaatccctcctttttaagaccgagaatggtgttaacatgtgcaccctgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtgacaccatctatgaccatgcggtgcatcggcatatcgaacagggactttgtcgaaggggtgtcaggaggtagctgggtagatattgttctggagcacggcagttgtgtgactacaatggccaaaaataagcccaccctcgacttcgaattaatcaagacggaggctaaacaccctgccaccctgcggaagtactgcattgaagcgaaacttacaaacactaccacagcatcccgctgtccaactcagggggagccctctttgaatgaggaacaagataagcgatttgtctgcaaacatagcatggtggacagaggatggggcaacggttgtgggctgttcggaaagggcggcatcgtgacctgcgccatgtttacatgcaagaaaaatatggaggggaagatcgtccagcctgaaaacctagagtataccattgttataactccacactccggagaagagaatgctgtgggtaacgatacgggcaaacatgggaaggagatcaaagtaacaccgcagtcaagtattaccgaagccgagctcactggatacggcaccgtgacaatggaatgtagccccaggaccggtctggacttcaatgagatggtccttctgcagatggaaaacaaggcatggttggtgcaccggcaatggtttctcgatctgcctttaccatggctgcccggggctgacactcagggctctaactggatccagaaagagacactcgttacgttcaagaatcctcacgccaagaaacaggatgtggtcgtgcttggatcccaagagggcgcgatgcataccgccctgactggggcaacagaaatacagatgtcaagcggaaacttgctatttaccggtcacctgaagtgccgtctccgcatggacaaactgcagcttaagggcatgagttattctatgtgtacagggaaattcaaggtagttaaggagattgctgaaactcaacatggaaccatcgtgatcagagtccagtacgagggcgacggttccccatgcaaaattcccttcgagatcatggatctggaaaagaggcacgtgttggggcggctcattacggtcaatccgatagtgaccgagaaagacagccctgttaacatcgaagccgagcccccatttggcgattcgtacattatcatcggagtggaacctggccagctgaagttatcttggttcaaaaaggggtcctcaattggacagatgtttgagacaactatgcgaggtgctaagcgcatggccatactgggcgacaccgcatgggatttcgggagtctaggaggcgtatttacaagcatcggtaaagccctccatcaagtcttcggggctatttatggcgcggcattttccggagtgtcttggactatgaagatcctgattggcgttgtgatcacctggatagggatgaatagcagatcaacgagtctttccgtcagcttggtgctggtaggagtggttacactctacctgggcgtcatggtgcaggccgactctggttgtgtggtctcatggaaaaacaaggagcttaaatgcgggagtggaatcttcattaccgataatgttcacacttggacagaacagtataagtttcagcccgagagcccatccaagctggcttctgccatccaaaaagcacacgaagagggcatttgtggtatcaggtcggtgacccggttggaaaacctcatgtggaagcagataactcccgagctgaatcatattttaagcgagaacgaagtgaaactgaccatcatgacaggcgacattaaggggatcatgcaggccggaaaacgctccctaagacctcagccaacggagctcaagtactcatggaaaacctggggcaaggctaagatgctgagtactgaacttcacaatcatacattcttgatagatgggccggagaccgccgaatgccccaacgcaaatagggcgtggaactctctggaggtagaggactatggatttggcgtcttcacaactaatatctggctcaaactgaaggaacgtcaagatgctttttgtgacagcaaattaatgtccgccgcaattaaggacaaccgggccgtgcacgctgatatgggttactggatcgagtcagccctgaacgacacctggaaaattgaaaaggccagcttcatcgaggttaagtcttgccactggcctaaatcccatacgctttggagtaatggggtgttggagagcgaaatgataattccaaagaacttcgctggacccgtctctcagcacaattatcgacctggctaccatacacagaccgccggtccatggcacctcggcagactggagatggattttgacttctgtgaagggactaccgtggttgtgacagaggattgcggaaacaggggcccctccctacgcactaccacagcgtcagggaaactgatcacggaatggtgctgtcggagttgcaccctcccgcctctgagatacaggggagaggacggctgttggtatggtatggagatccgcccacttaaggaaaaagaggaaaatttggtaaacagcctggtcactgccgggcatggacagattgataatttttcgttaggcgtgctcggtatggctctgttccttgaggaaatgctgcgaacacgggtgggcaccaagcacgcaatcttgctcgtcgccgtttcctttgtgactctgattacagggaacatgtctttccgtgacctaggaagagtaatggtgatggtcggcgctaccatgacggatgacatagggatgggagtgacttacctggccctcctggcagcgtttaaggttaggcccaccttcgccgctggccttttgctgcgcaaattaacaagcaaggagctcatgatgaccactatcggtattacactgctttcacaaagtaccatccctgagacaattctggaactaactgatgccctcgcactggggatgatggtgttgaaaatcgtccggaatatggagaagtatcagctggctgtgaccataatggccatcttatgcgttcccaacgcagtgattctccagaatgcctggaaagtctcctgtacgacactggctgtagtgtctgttagcccacttctgttgacctcctcacaacagaaggcggactggatccctctcgccctgactattaagggactaaaccccaccgcaatctttctgacaactcttagcagaaccagtaaaaagaggtcttggccactcaatgaagctataatggccgtgggcatggtctccattctggccagctcgttgctgaaaaacgatatcccgatgacgggccctttagtggctgggggactcctgacagtatgctacgtgcttaccggtcgatcagcagacctggagttggaacgcgccgcggacgtccggtgggaggagcaggctgaaatctctggcagttcccccattctcagcataactatctctgaggatgggagcatgtccattaagaatgaagaggaggaacagacactgaccatcctaattagaactggactgcttgttatctcaggcctcttcccagtgagtatacccatcacagccgcagcctggtatctgtgggaggtgaaaaagcaaagggctggtgtcttgtgggacgtgcctagcccaccccctgttgggaaagcagaattagaggatggagcctaccgtattaagcagaagggcatcctgggctattctcagattggggcgggagtatacaaagaaggtacctttcacacgatgtggcatgtgactcgcggcgctgtcctcatgcacaaggggaaacggatcgagccgtcctgggccgacgtgaagaaagatctgatatcatacggaggcggttggaaacttgagggggaatggaaggagggagaagaggttcaggtgctggcattggaaccaggcaaaaaccccagagccgtccaaaccaagcctggcctattcaaaacaagtaccgggacaattggagctgtgagcctggacttttccccaggtacttctggctcgcccatcgtagataagaaagggaaggtcgtgggactctatggcaacggtgttgtgaccaggagcgggacgtacgtctcagccatcgcacagacagagaagtccattgaggacaatcctgaaatcgaggatgacatattcagaaagaaacggctgactattatggatcttcatccgggagctggcaaaaccaagcgctatttacccgccatcgtgagagaagcgattaaaaggggcctgcggacactcatcttggccccaacccgagttgtggcagctgagatggaagaggccctgagagggctccctatacgctaccagactcccgctattagggcagagcacaccggacgtgaaatcgtcgacctgatgtgtcatgccacattcacgatgcggcttctgagtccaatcagagtgcctaactataatttgattatcatggatgaggcccactttactgaccccgcttctattgcggcaaggggttacataagcacccgcgtagaaatgggcgaggccgctgggatcttcatgacagccaccccaccgggatcccgagacccttttccccagtcaaacgcaccaattatggatgaggaaagagagatccccgaacggtcttggaatagcggccacgagtgggtgactgacttcaagggtaagacagtttggtttgtccctagtatcaaagccgggaacgatattgctgcgtgcctaaggaagaatggcaaaaaggtgatacaactgtcccgcaaaaccttcgactttgaatatatcaagacgcgtactaacgattgggacttcgtggtcacaaccgatattagcgagatgggcgccaattttaaggcagagagagtaatcgacccacggaggtgtatgaaacccgtgattctcaccgatggcgaagaacgcgttatcttagctgggcctatgccggtgactcattcttcagccgcacagcgaagaggacgggtcggtaggaacccaaagaatgaaaacgaccagtacatatacatgggcgagcccctggaaaatgatgaggactgcgcccactggaaagaggctaagatgcttctggacaacatcaatacacctgaagggattatcccctccatgttcgagccagaacgcgagaaagtggatgccattgacggagaatatagactcaggggcgaggcgcggaagacctttgttgatttgatgcgtcgcggtgacctgcctgtgtggctcgcataccgagtcgccgctgaggggatcaactatgccgatagaaggtggtgtttcgacggcgtgaaaaacaatcaaatactggaagagaacgtagaagtggagatttggacaaaggagggagaacggaagaaacttaagccccgctggctagatgctagaatctacagtgacccactggcattgaaagagttcaaggaatttgccgctggcaggaagtcgttaactctgaatctcattacggagatggggcggctgcctaccttcatgacacagaaggcccgaaacgcacttgataatctggcggttctccatactgccgaagctggaggtagagcctataaccacgcattgagcgagctgccggagaccctagaaacactgctccttctgaccttattggctactgtcacgggcgggatctttctgttcctcatgtctggaaagggcataggtaaaatgaccctggggatgtgctgcatcattacagcctccatccttctgtggtacgcacagattcagccccactggatcgccgctagcataattctcgagtttttcttgatcgtgctgttaatcccagaacctgagaagcaacgcactccccaggacaatcagctaacctatgtggtcattgcgatcctgacagttgtggccgcaaccatggctaacgaaatgggctttctcgagaaaactaagaaagatttcggacttggctcaataacaacgcagcaaccagagagtaatattctggacatcgatttgaggcctgcctctgcctggaccctgtacgcagtagctactacatttattacccccatgctccggcattccatcgaaaacagctcagtgaatgtcagtctgaccgccatagcgaaccaggctacagtgcttatggggctcggaaagggttggccgctgagcaagatggacatcggcgttccattgctggccattgggtgttactcccaggtgaatcctatcactttaacggcagccctactgctccttgtcgctcactatgcaattatcggacccggcctgcaggccaaagcgacccgtgaggctcaaaagagagccgcagccggtattatgaaaaacccaacagtagacgggatcactgtgatagatttggaccccattccttacgatccgaagttcgaaaaacagctgggccaggttatgctcctggtgctttgcgtcacccaggtgttaatgatgaggacaacctgggctctgtgtgaggccctcactttggcaacgggacccatctctacactgtgggaaggcaatccagggcgcttttggaacaccactatcgctgtcagcatggccaatattttccggggatcctatctagcgggcgccggtctgctcttttcaataatgaagaacaccgcaaacacacgaagagggactggaaataccggcgagacacttggtgagaagtggaaaaacaggctgaatgctttgggcaagtctgagttccaaatctacaaaaagagtgggattcaggaggtggaccgcacgctggccaaagaaggaatcaagcggggcgagaccgatcatcacgcagtttcgagagggagcgctaaactccgttggttcgtggagaggaacctggtagcccctgaaggaaaggtggtcgacttaggctgcggtagagggggatggtcctattactgtggcggtcttaagaatgttaaagaggtgaagggcctgactaaagggggacccggccatgaagaacctattccaatgtctacatatgggtggaacctcgtccgcctacagtcaggagtggatgtatttttcacaccccctgaaaagtgcgacactctgttgtgtgatatcggcgagagctccccaaatcccacagtggaggccggtcgaaccctgagagttctcaaccttgtggaaaattggctgaacaataacacgcaattttgcataaaagtcttgaatccgtacatgcctagtgtgatcgagaagatggaagcgctgcagaggaagtacgggggagctctcgtccggaacccattatctcgcaatagcacccacgagatgtattgggtgtcaaacgcatccggcaacattgttagtagcgtaaatatgatctctagaatgctgattaacaggttcacaatgcgacacaaaaaggccacttacgaacccgacgtggatcttggctccgggacccggaatatcggaatagagtcagagacacctaacctggacattatcggtaaacgtatcgaaaagattaaacaggagcatgaaactagctggcactatgatcaggaccatccatacaagacctgggcttatcacggctcgtacgagacaaagcaaaccgggtctgccagttccatggtcaatggagtggttagactactcactaaaccctgggacgtgataccgatggtcacgcagatggcaatgacagataccactccttttggccagcagcgcgtgttcaaggaaaaagtagacaccaggacacaagagcccaaggagggtacgaaaaagctgatgaagatcaccgccgaatggttgtggaaagagctggggaagaaaaagactccacggatgtgtacaagagaagagtttacccgcaaagtgaggagcaacgctgcgctcggagccattttcactgatgagaataagtggaaatcagcacgagaagctgttgaggactccggcttttgggaacttgtcgataaggagcggaacctgcacttagaaggcaagtgcgagacatgtgtgtataatatgatggggaaaagagagaagaaactgggagagttcggtaaggccaaaggctctagggcaatctggtacatgtggttgggggcccgctttctcgagttcgaagctctgggatttctaaacgaggaccattggttcagccgtgaaaatagtctttccggcgtggagggtgaggggctgcacaagctcggatacattctgcgggatgtcagcaagaaagaaggcggcgccatgtatgcggacgataccgcagggtgggacacaagaatcactttggaggatctgaagaacgaagagatggttaccaatcatatggaaggagagcacaaaaagctcgccgaggctatattcaaacttacgtaccagaacaaggtggtaagggtgcagcgccctacaccccgaggtacagtcatggacatcatttctcggagagaccagaggggctcagggcaagtggttacttatggactgaatacctttacaaacatggaagcccagttaatccgccagatggagggcgaaggtgtgttcaagagtattcaacagctgactgtcaccgaggagatcgcagtgaaaaactggttggtaagagttgggcgggaaaggctctcccgtatggctattagcggagatgactgcgtggtcaagccactggatgaccgatttgcctctgctctaacggcccttaatgatatgggcaaagtgcgcaaggacatacagcagtgggagccctcgagaggctggaacgattggacacaagtgcctttctgctcacatcactttcacgaactgatcatgaaagacgggcgggtcctcgttgtgccatgtaggaatcaggatgagctgattggacgcgcaagaatcagccagggtgcgggctggtccttgcgggaaaccgcctgcttagggaagagttacgctcagatgtggtctctgatgtatttccataggcgagacctccgtcttgccgcaaacgctatctgtagcgccgtaccgtcccactgggtgcccacttcaagaacaacctggagtattcatgcaactcacgagtggatgaccacagaggatatgctgacggtctggaatcgcgtgtggatacaagaaaacccttggatggaggacaagaccccagttgaatcttgggaggaaatcccctacctaggaaaacgggaggatcagtggtgcggcagcctgattggtctcacttccagggccacatgggcgaagaatatccagaccgctattaaccaggtgagatcattgatcgggaatgaggaatatactgactacatgcctagcatgaaacgctttcggagggaggaagaggaagccggagtcctgtggtga

SEQ ID NO: 14939 - RNA, 9876 nt, synthetic construct
  misc_feature 1..9876: note = derived and/or modified CDS sequence (opt3) from DENV-2__KC762669__SS-prME
  source 1..9876: mol_type = other RNA
accgccggcatcattataatggtgatccccacagtcatggctttccacctgactacgagaaacggggagcctcatatgattgttagcaggcaggaaaagggaaaatccctcctttttaagaccgagaatggtgtgaacatgtgcacactgatggcaatggacttgggcgaattatgtgaggatactatcacctacaattgcccactgctacggcaaaacgaaccggaggacattgattgttggtgcaattctacatcaacctgggtaacttatgggacatgtaccgccacgggagagcaccgccgagaaaaacgtagtgtggcgctcgtcccccatgtgggcatgggtctggagactagaaccgaaacatggatgagctccgagggggcttggaagcacgcccagaggatcgagacttgggttcttcggcatcctggattcaccataatggcagccatcctggcttacacaattggcaccacgtattttcagcgcgtgttgatcttcattctcctgactgcagtcgccccatctatgacaatgagatgcatcggcatatcgaacagggactttgtggaaggggtatcaggaggtagctgggttgatattgtgctggagcacggcagttgtgtcaccactatggctaaaaataagcccacactcgacttcgaattaatcaagaccgaggccaaacaccctgcgacgctgcggaagtactgcattgaagcaaaacttaccaacacaactaccgcctcccgctgtccaacacagggggagccctctttgaatgaggaacaagataagcgatttgtgtgcaaacatagcatggtggacagaggatggggcaacggttgtgggctgttcggaaagggcggcatcgtcacttgcgctatgtttacctgcaagaaaaatatggaggggaagatcgttcagcctgaaaacctagagtatacaattgtgataaccccacactccggagaagagaatgccgtaggtaacgatactggcaaacatgggaaggagatcaaagtgacgccgcagtcaagtattacagaagcagagctcaccggatacggcactgtcaccatggaatgtagccccaggacaggtctggacttcaatgagatggtgcttctgcagatggaaaacaaggcttggttggttcaccggcaatggtttctcgatctgcctttaccatggctgcccggggccgacacccagggctctaactggatccagaaagagactctcgtgacattcaagaatcctcacgcgaagaaacaggatgtcgtggtacttggatcccaagagggcgccatgcatacggcactgaccggggctactgaaatacagatgtcaagcggaaacttgctatttacaggtcacctgaagtgccgtctccgcatggacaaactgcagcttaagggcatgagttattctatgtgtaccgggaaattcaaggttgtgaaggagattgccgaaacacaacatggaactatcgtcatcagagtgcagtacgagggcgacggttccccatgcaaaattcccttcgagatcatggatctggaaaagaggcacgtcttggggcggctcattaccgtgaatccgatagttacggagaaagacagccctgtgaacatcgaagctgagcccccatttggcgattcgtacattatcatcggagtagaacctggccagctgaagttatcttggttcaaaaaggggtcctcaattggacagatgtttgagaccacaatgcgaggtgccaagcgcatggcaatactgggcgacactgcctgggatttcgggagtctaggaggcgtctttaccagcatcggtaaagctctccatcaagtgttcggggcgatttatggcgcagccttttccggagtttcttggacaatgaagatcctgattggcgtggtcatcacttggatagggatgaatagcagatcaaccagtctttccgtgagcttggtactggtgggagttgtcacgctctacctgggcgtgatggtgcaggctgactctggttgtgtcgtttcatggaaaaacaaggagcttaaatgcgggagtggaatcttcattacagataatgtgcacacctggactgaacagtataagtttcagcccgagagcccatccaagctggcctctgcaatccaaaaagcccacgaagagggcatttgtggtatcaggtcggtgacacggttggaaaacctcatgtggaagcagataacccccgagctgaatcatattttaagcgagaacgaagtaaaactgactatcatgaccggcgacattaaggggatcatgcaggctggaaaacgctccctaagacctcagccaacagagctcaagtactcatggaaagcctggggcaaggcaaagatgctgagtacggaacttcacaatcataccttcttgatagatgggccggagactgcggaatgccccaacacaaatagggcttggaactctctggaggtcgaggactatggatttggcgtgttcaccacaaatatctggctcaaactgaaggaacgtcaagatgttttttgtgacagcaaattaatgtccgccgcaattaaggacaaccgggccgtgcacgctgatatgggttactggatcgagtcagccctgaacgacacttggaaaattgaaaaggcaagcttcatcgaggtcaagtcttgccactggcctaaatcccataccctttggagtaatggggtgttggagagcgaaatgataattccaaagaacttcgctggacccgtttctcagcacaattatcgacctggctaccatacgcagacagccggtccatggcacctcggcagactggagatggattttgacttctgtgaagggaccactgtggtagtcaccgaggattgcggaaacaggggcccctccctacgcacaactaccgcgtcagggaaactgatcacagaatggtgctgtcggagttgcacgctcccgcctctgagatacaggggagaggacggctgttggtatggtatggagatccgcccacttaaggaaaaagaggaaaatttggtgaacagcctggtgaccgccgggcatggacagattgataatttttcgttaggcgtcctcggtatggctctgttccttgaggaaatgctgcgaactcgggttggcacaaagcacgcaatcttgctcgtggccgtatcctttgtgaccctgattactgggaacatgtctttccgtgacctaggaagagtcatggtgatggttggcgctacaatgaccgatgacatagggatgggagtgacgtacctggccctcctggcagcgtttaaggtcaggcccactttcgccgctggccttttgctgcgcaaattaaccagcaaggagctcatgatgacaaccatcggtattgtgctgctttcacaaagtactatccctgagacaattctggaactaaccgatgccctcgcactggggatgatggttttgaaaatcgtgcggaatatggagaagtatcagctggctgtcacaataatggccatcttatgcgtacccaacgcagtgattctccagaatgcctggaaagtttcctgtactaccctggctgtggtctctgtgagcccacttctgttgacgtcctcacaacagaaggcggactggatccctctcgccctgacaattaagggactaaaccccaccgcaatctttctgactacccttagcagaacaagtaaaaagaggtcttggccactcaatgaagctataatggccgtaggcatggtgtccattctggccagctcgttgctgaaaaacgatatcccgatgactggccctttagtcgctgggggactcctgaccgtttgctacgtgcttacgggtcgatcagcagacctggagttggaacgcgccgcggacgtgcggtgggaggagcaggctgaaatctctggcagttcccccattctcagcataacaatctctgaggatgggagcatgtccattaagaatgaagaggaggaacagaccctgactatcctaattagaacaggactgcttgtcatctcaggcctcttcccagtgagtatacccatcaccgccgcagcctggtatctgtgggaggttaaaaagcaaagggctggtgtattgtgggacgtgcctagcccaccccctgtcgggaaagcagaattagaggatggagcctaccgtattaagcagaagggcatcctgggctattctcagattggggcgggagtgtacaaagaaggtacttttcacacaatgtggcatgttacccgcggcgctgtgctcatgcacaaggggaaacggatcgagccgtcctgggccgacgtcaagaaagatctgatatcatacggaggcggttggaagcttgagggggaatggaaggagggagaagaggtgcaggtactggcattggaaccaggcaaaaaccccagagccgtccaaacgaagcctggcctattcaaaactaacaccgggattatcggagctgtgagtctggactttagcccaggtacatccggctctcccatcgttgataagaaagggaaggtggtcggactctatggcaatggtgtggttaccaggtcggggacatacgtgagcgccattgcacagactgagaagtcaatcgaggacaaccctgaaatagaggatgacattttccgaaaaaagcggctgaccatcatggatcttcatccgggagctggcaaaacgaagcgctatttacccgccattgtcagagaagcgatcaaaaggggcctgcggacactcatattggccccaactcgagtggtagcagctgagatggaagaggccctgagagggctccctattcgctaccagacccccgctatcagggcagagcacacaggacgtgaaatcgtggacctgatgtgtcatgccaccttcactatgcggcttctgtccccaattagagttcctaattataacttgatcattatggatgaggcccactttaccgaccccgctagtatagcggcaaggggttacatctctacacgcgtcgaaatgggcgaggccgctgggattttcatgacggccactccaccgggaagccgagacccttttccccagtccaatgcaccaatcatggatgaggaaagagagatccccgaacggtcatggaactctggccacgagtgggtgaccgacttcaagggtaagacagtgtggtttgtccctagcattaaagccgggaatgatatagctgcgtgcctaaggaagaacggaaaaaaggtaatccaactgagtcgcaaaaccttcgactttgaatatattaagactcgtacaaatgattgggacttcgtggttaccacggatatctccgagatgggcgccaactttaaggcagagagagtgattgacccacggaggtgtatgaaacccgtcatcctcactgatggcgaagagcgcgtgatattagctgggcctatgccggttacacatagctctgccgcacagcgaagaggacgggtgggtaggaatccaaagaacgaaaatgaccagtacatctacatgggcgagcccctggaaaacgatgaggactgcgcccactggaaagaggctaagatgcttctggacaatattaacacccctgaagggatcattccctcaatgttcgagccagaacgcgagaaagtcgatgccatcgacggagaatatagactcaggggcgaggcgcggaagacctttgtggatttgatgcgtcgcggtgacctgcctgtatggctcgcataccgagtggccgctgaggggataaactatgccgatagaaggtggtgtttcgacggcgttaaaaataaccaaattctggaagagaatgtcgaagtggagatctggactaaggagggagaacggaagaaacttaagccccgctggctagatgctagaatttactccgacccactggcattgaaagagttcaaggaatttgccgctggcaggaaaagtttaacactgaacctcatcaccgagatggggcggctgcctacattcatgactcagaaggcccgaaatgcacttgataacctggcggtgctccatacggccgaagctggaggtagagcctataatcacgcattgagcgagctgccggagaccctagaaacactgctccttctgactttattggctaccgtcacaggcgggatatttctgttcctcatgtcgggaaagggcatcggtaaaatgaccctggggatgtgctgcattatcactgcctctattcttctgtggtacgcacagatccagccccactggatagccgcttccattatcctcgagtttttcttgatcgttctgttaattccagaacctgagaagcaacgcacgccccaggacaaccagctaacctatgtggtaatcgcgatactgacagtggtcgccgcaactatggctaatgaaatgggctttctcgagaaaaccaagaaagatttcggacttggcagcattacaacccagcaactggagtcaaacatcttggacattgatctgaggccagccagtgcctggactctctacgcagtggctacaacgtttatcacccctatgctgcggcattctatagaaaattccagcgttaacgtgtcacttactgccatcgcgaatcaggctacagtcctcatggggctgggaaagggttggcccttgagtaagatggacattggcgtaccgctgttagccatcgggtgttacagccaggtgaacccaattaccctaaccgcagccctgctccttctggttgctcactatgcaatcattggacctggcttgcaggccaaagcgacacgtgaggctcaaaagagagccgcagccggtatcatgaaaaatcccactgtggacgggataacggtcattgatctggacccaatcccctacgatcctaagttcgaaaaacagctcggccaggtgatgctgcttgtcttatgcgtgacccaggttctgatgatgaggacaacttgggctctctgtgaggccttgaccctggcaacaggaccgatctccaccctatgggaaggcaaccccgggcgcttttggaatactacgattgctgtgtctatggccaacatattccggggaagctatctggcgggcgccggtctccttttttccatcatgaagaacacagcaaatacccgaagagggactggaaacaccggcgagacactgggtgagaagtggaaaaataggttgaacgctctgggcaagtcagaattccaaatttacaaaaagtctgggatccaggaggtagaccgcactctcgccaaagaaggaattaagcggggcgagaccgatcatcacgcagtgagtagagggtcggctaaactgcgttggttcgtcgagaggaatttagttacaccagaaggaaaggtggtcgaccttggctgcggtcgggggggatggagctattactgtggcggtctgaagaacgtgaaagaggtaaagggcctcacgaaagggggacctggccatgaagagcccatccctatgtccacctatgggtggaatctagtgcgcctgcagtctggagttgatgtgtttttcactccacccgaaaagtgcgacacattgctgtgtgatataggcgagtcaagccctaacccaaccgtcgaggccggtcgaactctcagagtgcttaatctggtcgaaaactggttgaataacaatacacaattttgcatcaaagtgctgaacccctacatgccgtccgttattgagaagatggaagccctccagaggaagtacgggggagcgttagtacggaatcctctgagtcgcaactctacccacgagatgtattgggtgagcaacgcttcaggcaatatcgtctccagtgtgaacatgattagcagaatgcttatcaataggttcacgatgcgacacaaaaaggcaacctacgaaccagacgttgatctgggctctgggacacggaacataggaattgagtccgagactcccaatctagacatcatcggtaaacgtattgaaaagataaaacaggagcatgaaacctcatggcactatgatcaggaccatccttacaagacatgggcctatcacggcagctacgagactaagcaaaccgggtcggcttctagtatggtgaacggagtcgtgagactcctgacaaaaccatgggacgtaatccccatggtgacccagatggccatgactgatacgacaccgtttggccagcagcgcgttttcaaggaaaaagtcgacaccaggactcaagagcctaaggagggtaccaaaaagttgatgaagattacagcagaatggctgtggaaagagctcgggaagaaaaagacgccccggatgtgtaccagagaagagtttactcgcaaagtgaggtccaatgccgctcttggagcgatcttcacagatgagaacaagtggaaaagcgcccgagaagcagtggaggactcaggcttttgggaactggtcgataaggagcggaatttacacctggaaggcaagtgcgagacctgtgtttataacatgatggggaaaagagagaagaaattgggagaattcggtaaggctaaaggctccagggccatttggtacatgtggctcggggcacgctttctggagttcgaagccctaggatttcttaatgaggaccattggttctctcgtgaaaacagcctgagtggcgtggagggtgaggggctccacaagctgggatacatcttgcgggatgtatccaagaaagaaggcggcgctatgtatgccgacgatactgcggggtgggacacaagaataaccctggaggatctcaagaatgaagagatggtgacaaaccatatggaaggagagcacaaaaggcttgcagaggccatcttccgcctgacttaccagaataaggtcgtgcgagttcagcggccaacccctagaggtacggtgatggacattatcagcaggcgcgaccagagaggctctgggcaagtcgtgacctatggattaaacacatttactaacatggaagctcagctgattcggcagatggagggcgaaggtgtattcaaatcaatccaacatttgaccgttacagaggagattgccgtgaagaattggctcgcaagggtcgggcgtgaacgactgagtcgcatggctatatccggagatgactgcgtggtgaagcccctagatgacagatttgccagcgctcttactgccctgaacgatatgggcaaagtccggaaggacatccagcagtgggagccatctaggggctggaatgattggacccaggttcccttctgctcgcaccactttcatgaactcattatgaaagacgggcgcgtgctggtagtgccttgtagaaaccaagatgagttgatcggacgggcaaggatctcacagggtgcgggctggagcttacgagaaacggcctgcctggggaagtcctacgctcagatgtggagtctcatgtatttccaccgtagagaccttcgcctggccgcaaatgctatttgttctgccgtcccaagccattgggtgccgacatcccggaccacttggtcaatacacgcaacacacgagtggatgaccactgaggatatgctaaccgtttggaacagggtgtggatccaggaaaatccctggatggaggacaaaacacctgtcgaaagttgggaggaaattccatacctgggaaagagagaggatcaatggtgcggctctctcatcggtttgacgagccgcgccacctgggcgaagaacattcagactgctatcaatcaggtgcggtccctgatagggaacgaggaatatacagactacatgccctcaatgaaaaggtttcgaagagaggaagaggaagccggagtactttggtga

SEQ ID NO: 14940 - RNA, 9876 nt, synthetic construct
  misc_feature 1..9876: note = derived and/or modified CDS sequence (opt3) from DENV-2__KC762658__SS-prME
  source 1..9876: mol_type = other RNA
accgcaggaatcattataatgatgatccccactgtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgcccccggagagcaccgccgagaaaaacgtagtgtagcgctcgtgcctcatgtcggcatgggtctggagacgcggactgaaacctggatgagctccgagggggctggaaagcacgcccagaggatcgagacatgggtgcttcggcatccaggcttcactataatggcagccatcctggcttacaccattggcacaacctattttcagcgcgttttgatcttcattctcctgacggcagtgactccctctatgacaatgagatgcatcgggatatcgaacagggactttgtcgaaggagtgtcaggtggcagctgggttgatattgttctggagcacgggagttgtgtgaccactatggccaaaaataagcctacactcgacttcgaattaatcaagaccgaggctaaactgccagccacgcttcggaagtactgcattgaagcgaaattgaccaacacaactaccgcatcccgctgtcccacacagggagagccttctctgaatgaggaacaagataagcgatttgtctgcaaacacagcatggtggacagaggctggggtaacgggtgtggacttttcggcaagggcgggatcgtgacttgcgccatgtttacctgcaagaaaaatatggagggaaagatcgtccagccagaaaacctcgagtatacaattgttataaccccgcattccggtgaagagaatgctgtgggcaacgatactgggaaacacggaaaggagatcaaagtaacgccccagtcaagtattacagaagccgagctgaccggctacggtactgtgaccatggaatgtagccctaggacagggcttgacttcaatgagatggtcctgttgcagatggaaaacaaggcatggctcgtgcatcggcaatggtttctggatttaccactgccctggctccctggcgctgacacccagggatctaactggatccagaaagagactcttgttacattcaagaatccacacgccaagaaacaggatgtggtcgtgctgggctcccaagagggggcgatgcacacggccttgaccggagcaactgaaatacagatgtcaagcggtaacctactgtttacaggccatctcaagtgccgtctgcgcatggacaaacttcagctgaaggggatgagttattctatgtgtaccggaaaattcaaggtagttaaggagattgctgaaacacaacacggcactatcgtgatcagagtccagtacgagggtgacgggtccccctgcaaaattccgttcgagatcatggatttggaaaagaggcatgtgctcggccggctgattaccgtcaatcctatagtgacggagaaagacagccccgttaacatcgaagccgagccaccttttggagattcgtacattatcatcggcgtggaacccgggcagttaaagctgtcttggttcaaaaagggatcctcaattggtcagatgtttgagaccacaatgcgaggcgctaagcgcatggccatactaggggacactgcatgggatttcggaagtctcggcggtgtatttaccagcatcgggaaagccctgcaccaagtcttcggcgctatttatggagcggcattttccggcgtgtcttggacaatgaagatccttattggggttgtgatcacttggataggaatgaatagcagatcaaccagtttgtccgtcagcctggtgctcgtaggcgtggttacgctgtaccttggtgtcatggtgcaggccgactctgggtgtgtggtctcatggaaaaacaaggagctgaaatgcggaagtggcatcttcattacagataatgttcatacctggactgaacagtataagtttcagccagagagcccctccaagttggcttctgccatccaaaaagcacacgaagagggtatttgtggcatcaggtcggtgacacggctcgaaaacctgatgtggaagcagataacccctgagttaaatcacattctgagcgagaacgaagtgaaactaactatcatgaccggggacattaagggaatcatgcaggccggcaaacgctccctcagaccacagccgacagagctgaagtactcatggaaaacgtgggggaaggctaagatgcttagtaccgaattgcataatcacactttcctgatagatggacccgagacagccgaatgccctaacaccaatagggcatggaactctctcgaggtagaggactatggctttggtgtcttcacaactaatatctggctgaaattaaaggaacgtcaagatgtgttttgtgacagcaaactgatgtccgcggctattaaggacaaccgggccgttcatgcagatatggggtactggatcgagtcagcccttaacgacacctggaaaattgaaaaggctagcttcatcgaggtgaagtcttgccactggccaaaatcccacacgttgtggagtaatggagtcctcgagagcgaaatgataattcccaagaacttcgccggccctgtgtctcagcataattatcgaccaggttaccacacacagaccgcaggcccctggcatctggggagactagagatggattttgacttctgtgaaggaactaccgttgtggtaacagaggattgcggcaacagggggccgtccctgcgcactaccacagcttcaggaaaactcatcacggaatggtgctgtcggagttgcaccctgcctccacttagatacaggggcgaggacggttgttggtatgggatggagatccgccccttgaaggaaaaagaggaaaatctggtcaacagcttagtgactgccggacacggccagattgataatttttcgctcggtgtgctgggcatggcgcttttcctggaggaaatgttgcgaacacgggtcgggaccaagcatgccatcctcctggttgctgtgtcctttgtaactctaattacaggaaacatgtctttccgtgacctgggcagagtgatggtcatggtgggggcaaccatgacggatgacataggaatgggcgttacttacctcgccctgcttgctgcctttaaggtgaggcctaccttcgcagcgggtttgctgttacgcaaactcacaagcaaggagctgatgatgaccactatcgggattgtccttctgtcacaaagtacaatccccgagaccattctagaactcacagatgccctggctttgggaatgatggtgctgaaaatcgttcggaatatggagaagtatcagttagccgtgactataatggcaatcctctgcgtcccaaacgctgtaattctgcagaatgcctggaaagtgtcctgtaccacgcttgcagttgtgtctgtcagccctctgttgctcacatcctcacaacagaaggccgactggatccccctggctctaaccattaagggcctgaacccaactgcgatctttcttaccacactcagcagaacaagcaaaaagaggtcttggccgctgaatgaagccataatggcagtgggcatggtatccattttggctagctcgctgctaaagaacgatatccctatgaccgggcccctcgtggccggaggtctgcttacggtctgctacgttctgacaggccgatcagccgacttggagctcgaacgcgctgcagacgtgcggtgggaggagcaggccgaaatctctgggagttccccaattctgagcataaccatctctgaggatggaagcatgtccattaagaatgaagaggaggaacagactctaacaatcctgattagaaccggccttctcgtgatctcaggtctgttccccgtcagtatacctatcactgcggctgcctggtatttgtgggaggtgaaaaagcaaagggcaggggttttatgggacgtaccaagtccccctccggtgggaaaagccgaactggaggatggcgcttaccgtattaagcagaagggcatcctcgggtattctcagattggagccggtgtctacaaagaaggcacatttcacaccatgtggcacgtgacgcgcggggccgttctgatgcataagggaaaacggatcgagccatcctgggcggacgtgaagaaagatcttatatcatacggcggtgggtggaagctggagggagaatggaaggagggcgaagaggtccaggtgttggctctagaacccggcaaaaaccctagagccgtacaaactaagccagggctgttcaaaaccaacacaggaaccattggtgcagtcagtctcgactttagccccggcacatccgggtctcctatcgtggataagaaaggaaaggttgtgggcctgtatggtaatggggtcgtgactaggtcgggaacctacgttagcgccatcgctcagacggagaagtcaattgaggacaacccggaaatcgaggatgacatattccggaaaaagagacttacaattatggatttacaccccggcgccggcaaaactaagcgctatctgccagcaatcgtgagagaagctattaaaagggggctccggaccttgatcctggcccctacacgagtcgtggcggccgagatggaagaggcactcagaggactgcccatacgctaccagaccccagctattagggccgagcatactggtcgtgaaatcgtagaccttatgtgtcacgctaccttcacaatgcggctgttgtcccctatcagagtgcccaattataacctaattatcatggatgaggcacattttacggacccagccagtattgccgctaggggctacatatctactcgcgttgaaatgggggaggcggcaggaatcttcatgaccgccacaccgcctggcagccgagacccctttccacagtccaatgctcccattatggatgaggaaagagagatccctgaacggtcatggaactctggtcacgagtgggtcaccgacttcaaggggaagactgtgtggtttgtgccaagcatcaaagccggaaatgatattgcagcctgcctgaggaagaacggcaaaaaggtcatacaactcagtcgcaaaacattcgactttgaatatatcaagacccgtacgaatgattgggacttcgtagtgactacagatatttccgagatgggcgctaactttaaggcggagagagttatcgacccccggaggtgtatgaaacctgtgattttaaccgatggggaggaacgcgtcatcctggccggaccgatgccagtgacccacagctctgcagctcagcgaagaggtcgggttggcaggaatcccaagaacgaaaatgaccagtacatatacatgggggagcctcttgaaaacgatgaggactgcgcccattggaaagaggcaaagatgctgctcgacaatatcaacactcccgaaggaattatcccatcaatgttcgagcctgaacgcgagaaagtggatgccattgacggcgaatatagattgaggggtgaggctcggaagacatttgtcgagctgatgcgtcgcggggatctccccgtgtggctggcctaccgagtagcggcagaaggcatcaactatgccgacagaaggtggtgtttcgatggagtgaaaaataaccaaatacttgaggaaaatgttgaggtcgagatttggaccaaggaaggcgagcggaagaaactaaagccacgctggctggacgctagaatctactccgatcctttggccttaaaagagttcaaggagtttgctgcagggaggaaaagtctgacactcaacctgattactgaaatgggacggcttccgacgttcatgacccagaaggcccgaaatgctctggacaacctcgccgtgttgcacacagcagaggcgggtggcagagcctataatcatgctctgagcgagctacccgaaactctggagaccctccttctgttaacattgctggccaccgtgactgggggaatctttctcttcctgatgtcgggcaagggtatagggaaaatgacgcttggcatgtgctgcatcattaccgcatctatcctgctctggtacgctcagattcagccacactggatcgccgcatccataattttggaatttttcctgatcgtcttactaatccctgagcccgaaaagcaacgcacaccacaggataaccagctgacttatgttgtgattgccatcctcaccgtagtggctgcgacaatggccaatgagatgggatttcttgagaaaaccaagaaagacttcggcctggggagcataactacacagcaacctgaatcaaacattttggatatcgacctgaggcccgcaagtgcttggacgctctacgccgtcgccaccacttttattacaccgatgctgcggcactctatcgaaaattccagcgtgaacgtttcacttaccgcaatagctaatcaggccaccgtgctcatgggactgggtaagggctggccattgagtaagatggatatcggggtccctctgttagcgattggatgttacagccaggtaaaccccatcacactaactgctgccctgctccttctggtggcacattatgccattatcggcccaggtttgcaggctaaagcaacgcgtgaagcccaaaagagagcggctgccgggattatgaaaaatcccaccgttgacggcatcacagtgatagacctggatcctattccgtacgaccccaagttcgagaaacagctcggacaggtcatgctgcttgtgttatgcgtcactcaggtgctgatgatgaggaccacatgggcactctgtgaagccttgaccctggctactggcccaatctccacgctatgggaggggaaccctggacgcttttggaatacaaccatcgccgtttctatggcaaacattttccggggcagctatctggctggtgccgggctcctattttccataatgaagaacactgcgaatacccgaagaggaacaggcaacactggtgagaccctgggcgaaaagtggaaaaataggttgaacgccctggggaagtcagagttccaaatctacaaaaagtctggcattcaggaagtggatcgcacactcgcaaaagagggcatcaagagaggggaaacggaccaccatgctgtaagtagaggatcggccaaactgcgttggttcgtggaaaggaatttagtcacccccgagggcaaggttgtggatcttggttgcgggcggggaggctggagctattactgtggtggcctgaagaacgtcaaagaagtgaaggggctcactaaaggaggccctgggcacgaggaaccaattcccatgtccacatatggatggaatctagtacgcctgcagtctggcgtggacgtatttttcacccctccagagaagtgcgatactttgctgtgtgacatcggtgagtcaagccccaacccgacagtggaagcagggcgaaccctcagagtccttaatctggtggagaactggttgaataacaatacgcaattttgcataaaagtcctgaacccttacatgccatccgtgatcgaaaagatggaggctctccagaggaagtacggaggcgccttagttcggaatcccctgagtcgcaactctacccatgaaatgtattgggtaagcaacgcctcaggcaatattgtgtccagtgtcaacatgatcagcagaatgcttattaataggttcacaatgcgacacaaaaaggcgacttacgagcctgatgtggacctggggtctggaacccggaacatcggtatagagtccgaaacaccaaatctagatattatcggcaaacgtatcgagaagattaaacaggaacacgagacttcatggcattatgaccaggatcacccctacaagacctgggcttatcatgggagctacgaaacaaagcaaaccggatcggcatctagtatggttaacggcgtggtcagactcctgactaaaccgtgggacgtgatacctatggtaacgcagatggccatgacagacaccactccctttggtcagcagcgcgtgttcaaggagaaagttgataccaggacacaagagccaaaggaagggacgaaaaagttgatgaagatcaccgctgagtggctgtggaaagaactcggaaagaaaaagactcctcggatgtgtacaagagaggagtttacccgcaaagtcaggtccaatgccgcacttggcgccattttcactgacgaaaacaagtggaaaagcgctcgagaggcggtggaagattcaggcttttgggagctggtggacaaggaacggaatttacacctggaggggaagtgcgagacatgtgtctataacatgatgggaaaaagagaaaagaaattgggtgagttcggcaaggccaaagggtccagggcaatctggtacatgtggctcggagctcgctttctggagttcgaggccctaggctttcttaatgaagatcactggttctctcgtgagaacagcctgagtggtgttgagggggaaggactccataagctgggctacattttgcgggacgtgtccaagaaagagggcggggcaatgtatgccgatgacaccgctggatgggatacaagaatcactctggaagacctcaagaatgaggaaatggtaaccaaccacatggagggtgagcataagaaacttgccgaagcgatattcaaactgacgtaccagaataaagtggtcagggtgcagcgccccaccccacgaggcacagttatggatatcattagccggagagaccagagggggtctggacaagtggtcacttatggcttaaacacctttacaaacatggaggcacagctgatccgccagatggaaggtgagggggtgttcaagtcaattcaacagttgactgtaaccgaggaaatcgccgttaaaaattggctcgtgagagtcggacgggagaggctgagtcgtatggctatttccggcgacgattgcgtggtgaagcccctagacgatcgatttgccagcgcacttacggctctgaacgacatgggcaaagtccgcaaggatatacagcagtgggaaccttctagagggtggaatgactggacacaagttccattctgctcgcaccattttcacgagctcatcatgaaagatggacgggtgctggtagtgccgtgtaggaaccaggacgaattgattggtcgcgccagaatctcacagggcgctgggtggagcttacgggagaccgcctgcctgggaaagtcctacgcacagatgtggagtctcatgtatttccacaggcgagatcttcgtctggcggccaatgctatctgttctgccgtccccagccattgggtgcctacttccagaacaacctggtcaattcacgcaactcatgagtggatgaccacagaagacatgctaacggtttggaaccgcgtgtggatacaagagaatccatggatggaagataagacccccgtcgagagttgggaagagatcccttacctgggcaaacgggaggaccagtggtgcggttctctcattgggttgactagcagggctacatgggccaagaacatccagaccgcaattaatcaggtgagatccctgatcggaaacgaaaaatatactgattacatgccatcaatgaagcgctttcggagggaggaagaggaagccggcgtactttggtga

SEQ ID NO: 14941 - RNA, 9876 nt, synthetic construct
  misc_feature 1..9876: note = derived and/or modified CDS sequence (opt3) from DENV-2__KC762660__SS-prME
  source 1..9876: mol_type = other RNA
accgccggaatcattataatgatgatccccacagtgatggctttccacctgactacgcgaaacggggaacctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtgacaccatctatgaccatgaggtgcatcggcatatcgaacagggactttgtcgaaggggtgtcaggaggtagctgggtagatattgttctggagcacggcagttgtgtgactacaatggccaaaaataagcccaccctcgacttcgaattaatcaagacggaggctaaacaccctgccaccctgcggaagtactgcattgaagcgaaacttacaaacactaccacagcatcccgctgtccaactcagggggagccctctttgaatgaggaacaagataagcgatttgtctgcaaacatagcatggtggacagaggatggggcaacggttgtgggctgttcggaaagggcggcatcgtgacctgcgccatgtttacatgcaagaaaaatatggaggggaaggtcgttcagcctgaaaacctagagtataccatcgtgattactccacactccggagaagagaatgctgtaggtaacgatacgggcaaacatgggaaggagataaaagtgacaccgcagtcaagtatcaccgaagccgagctcactggatacggcaccgtcacaatggaatgtagccccaggaccggtctggacttcaatgagatggtgcttctgcagatggaaaacaaggcatggttggttcaccggcaatggtttctcgatctgcctttaccatggctgcccggggctgacactcagggctctaactggattcagaaagagacactcgtgacgttcaagaatcctcacgccaagaaacaggatgtcgtggtacttggatcccaagagggcgcgatgcataccgccctgactggggcaacagaaatccagatgtcaagcggaaacttgctatttaccggtcacctgaagtgccgtctccgcatggacaaactgcagcttaagggcatgagttattctatgtgtacagggaaattcaaggttgtgaaggagatagctgaaactcaacatggaaccattgtcatcagagtgcagtacgagggcgacggttccccatgcaaaatccccttcgagattatggatctggaaaagaggcacgtcttggggcggctcatcacggtgaatccgattgttaccgagaaagacagccctgtgaacatagaagccgagcccccatttggcgattcgtacatcattatcggagtagaacctggccagctgaagttatcttggttcaaaaaggggtcctcaatcggacagatgtttgagacaactatgcgaggtgctaagcgcatggccattctgggcgacaccgcatgggatttcgggagtctaggaggcgtctttacaagcataggtaaagccctccatcaagtgttcggggctatctatggcgcggcattttccggagtttcttggactatgaagattctgatcggcgtggtcattacctggatcgggatgaatagcagatcaacgagtctttccgtgagcttggtactggtgggagttgtcacactctacctgggcgtgatggtgcaggccgactctggttgtgtcgtttcatggaaaaacaaggagcttaaatgcgggagtggaatattcatcaccgataatgtgcacacttggacagaacagtataagtttcagcccgagagcccatccaagctggcttctgccattcaaaaagcacacgaagagggcatctgtggtattaggtcggtgacccggttggaaaacctcatgtggaagcagatcactcccgagctgaatcatatattaagcgagaacgaagtaaaactgaccattatgacaggcgacatcaaggggattatgcaggccggaaaacgctccctaagacctcagccaacggagctcaagtactcatggaaaacctggggcaaggctaagatgctgagtactgaacttcacaatcatacattcttgatcgatgggccggagaccgccgaatgccccaacacaaatagggcatggaactctctggaggtcgaggactatggatttggcgtgttcactaccaatatatggctcaaactgaaggaacgtcaagatgtattttgtgacagcaaattaatgtccgcggctatcaaggacaaccgggccgtgcacgcagatatgggttactggattgagtcagccctgaacgacacgtggaaaatcgaaaaggctagcttcattgaggtcaagtcttgccactggcctaaatcccatacactttggagtaatggggtgttggagagcgaaatgatcataccaaagaacttcgccggacccgtttctcagcacaattatcgacctggctaccatacccagactgcaggtccatggcacctcggcagactggagatggattttgacttctgtgaagggaccacagtggtagtcactgaggattgcggaaacaggggcccctccctacgcaccacaacggcttcagggaaactgattaccgaatggtgctgtcggagttgcactctcccgcctctgagatacaggggagaggacggctgttggtatggtatggagatccgcccacttaaggaaaaagaggaaaatttggtgaacagcctggtgacagccgggcatggacagatcgataatttttcgttaggcgtcctcggtatggcgctgttccttgaggaaatgctgcgaacccgggttggcactaagcacgccattttgctcgtggctgtatcctttgtgacactgatcaccgggaacatgtctttccgtgacctaggaagagtcatggtgatggttggcgcaacgatgactgatgacattgggatgggagtgacctacctggccctcctggctgcctttaaggtcaggcccacattcgcagcgggccttttgctgcgcaaattaaccagcaaggagctcatgatgactacaataggtatcgtgctgctttcacaaagtaccattcctgagtccatcctggaactaacagatgccctcgctctggggatgatggttttgaaaattgtgcggaatatggagaagtatcagctggccgtcactatcatggcaatattatgcgtacccaacgctgtgatcctccagaatgcctggaaagtttcttgtaccacgctggcagtggtcagcgtgtccccacttctgttgacatcaagccaacagaaggccgactggattcctctcgctctgaccatcaagggactaaaccccactgcgatttttctgaccacacttagtagaacttctaaaaagaggtcctggccactcaatgaagccatcatggcagtaggcatggtgagcatactggcttcgtcattgctgaaaaacgatattccgatgaccggccctttagtcgccgggggactcctgacggtttgctacgtgcttacaggtcgatctgccgacctggagttggaacgcgctgcagacgtgcggtgggaggagcaggccgaaatcagtggctccagccccatcctctctattaccataagcgaggatgggtccatgtcaatcaagaatgaagaggaggaacagactctgacaattctaatcagaaccggactgcttgtcattagtggcctcttcccagtgagcatccccataactgcggctgcctggtatctgtgggaggttaaaaagcaaagggccggtgttttgtgggacgtgccttctccaccccctgtcgggaaagcagaattagaggatggagcttaccgtatcaagcagaagggcattctgggctattcccagatcggggcaggagtgtacaaagaaggtacatttcacaccatgtggcatgttacgcgcggcgccgtgctcatgcacaaggggaaacggattgagccgtcatgggcggacgtcaagaaagatctgatcagttacggaggcggttggaaacttgagggggaatggaaggagggagaagaggtgcaggtactggctttggaaccaggcaaaaaccccagagccgtccaaactaagcctggcctattcaaaaccaacacagggaccataggagcagtgagcctggacttttccccaggtacatctggctcgcccattgttgataagaaagggaaggtggtcggactctatggcaatggtgtggttactaggagcgggacctacgtgtcagccatcgctcagacggagaagtccatcgaggacaaccctgaaattgaggatgacatcttcagaaagaaacggctgacaataatggatcttcatccgggagccggcaaaactaagcgctatttacccgcaattgtcagagaagctatcaaaaggggcctgcggaccctcattttggccccaacacgagtggtagcggccgagatggaagaggcactgagagggctccctatccgctaccagacccccgctataagggccgagcacactggacgtgaaattgtggacctgatgtgtcatgctaccttcacaatgcggcttctgagtccaatcagagttcctaattataacttgatcattatggatgaggcacactttatcgaccccgcctctattgccgctaggggttacataagcacgcgcgtcgaaatgggcgaggcggcagggatcttcatgactgccaccccaccgggatcccgagacccttttccccagtcaaatgctccaattatggatgaggaaagagagatccccgaacggtcttggaacagcggccacgagtgggtgacagacttcaagggtaagaccgtgtggtttgtccctagtatcaaagccgggaatgatattgcagcctgcctaaggaagaacggcaagaaggtaatacaactgtcccgcaaaactttcgactttgaatatatcaagacacgtaccaatgattgggacttcgtggttacgactgatattagcgagatgggcgctaactttaaggcggagagagtgatcgacccacggaggtgtatgaaacccgtcattctcacagatggcgaagaacgcgtgatcttagccgggcctatgccggttacccattcttcagcagctcagcgaagaggacgggtgggtaggaatccaaagaacgaaaatgaccagtacatatacatgggcgagcccctggaaaacgatgaggactgcgcccactggaaagaggcaaagatgcttctggacaatatcaacacccctgaagggattatcccctccatgttcgagccagaacgcgagaaagtcgatgccattgacggagaatatagactcaggggcgaggctcggaagacttttgtggatttgatgcgtcgcggtgacctgcctgtatggctcgcctaccgagtggcggcagaggggatcaactatgccgatagaaggtggtgtttcgacggcgttaaaaataaccaaatactggaagagaatgtcgaagtggagatttggacaaaggagggagaacggaagaaacttaagccccgctggctagatgctagaatctacagtgacccactggccttgaaagagttcaaggaatttgctgcaggcaggaagtcgttaaccctgaacctcattacagagatggggcggctgcctactttcatgacgcagaaggccaagaatgctcttgataacctggccgtgctccataccgcagaagcgggaggtcgagcctataatcacgctttgagcgagctgccggagacactagaaactctgctccttctgaccttattggccacagtcaccggcgggatctttctgttcctcatgtctggaaaaggcataggtaagatgactctggggatgtgctgcatcattacggcatccatccttctgtggtacgctcagattcagccccactggatcgccgcaagcataattctcgagtttttcttgatcgttctgttaatcccagaacctgagaaacaaagaacaccccaggacaaccagctaacatatgtggtaattgccatcctgactgtggtcgctgcgaccatggccaatgaaatgggctttctcgagaagaccaagaaggatttcggacttggctcaataaccactcagcaaccagagagtaacattctggacatcgatttgcgccctgcatctgcttggacactgtacgccgtggccacgacctttattactcccatgctcaggcattccatcgaaaatagctcagttaacgtgagtctgacagcaatagctaatcaggccaccgtccttatggggctcggaaagggttggccgctgagcaaaatggacatcggcgtaccattgctggcgattgggtgttactcccaggtgaaccctatcaccttaacagctgccctactgctccttgttgcacactatgccattatcggacccggcctgcaggctaaggcaactcgggaggcccaaaaacgtgcggctgccggtattatgaagaatccaacggtggacgggatcaccgtcatagatttggaccccattccttacgatccgaaattcgaaaagcagctgggccaggtgatgctcctggtcctttgcgtgacacaggttttaatgatgagaactacctgggcactgtgtgaggccctcacattggctaccggacccatctctactctgtgggaaggcaacccagggaggttttggaatacgacaatcgccgtgagcatggcaaacattttccgcggatcctatctagctggcgccggtctgctcttttcaataatgaagaacaccgcgaatactcggcgagggaccggaaacacaggcgagactcttggtgagaaatggaagaatagactgaacgccttgggcaaatctgagttccaaatctacaagaaaagtgggattcaggaggtagacaggaccctggcaaaggaaggaatcaaacgcggcgagacagatcatcacgctgtgtcgcgggggagcgccaagctcagatggttcgtcgagcgtaatctggttacgcctgaaggaaaggtggtcgacttaggctgcggtagagggggatggtcctattactgtggcggtcttaaaaacgtgaaggaggtaaaaggcctgaccaaagggggacccggccatgaagaacctattccaatgtctacttatgggtggaatctcgtgcggctacagtcaggagttgatgtgtttttcacaccccctgaaaaatgcgacaccctgttgtgtgatatcggcgagagctccccaaaccccactgtcgaggcaggtcgcacactgcgagtgctcaatcttgtcgaaaactggctgaataacaatacccaattttgcataaaggtgttgaacccgtacatgcctagtgttatcgagaagatggaagctctgcagagaaaatacgggggagccctcgtaaggaatccattatctcggaacagcacgcacgagatgtattgggtgtcaaacgcctccggcaatattgtcagtagcgtgaacatgatctctcgcatgctgattaatagattcaccatgaggcacaagaaagcgacatacgaacccgacgttgatcttggctccgggactcgaaacatcggaatagagtcagagacccctaatctggacattatcggtaagcggatcgagaaaattaagcaggagcatgaaacaagctggcactatgatcaggaccatccatacaagacttgggcttatcacggctcgtacgagaccaaacaaacagggtctgcaagttccatggtgaacggagtcgtgcgtctactcaccaagccctgggacgtaataccgatggtgactcagatggccatgacggatacaaccccttttggccagcagagagttttcaaagaaaaggtcgacactcgcacccaagagcccaaagagggtacaaagaagctgatgaaaatcacggctgaatggttgtggaaggagctggggaaaaagaaaaccccaaggatgtgtactcgggaagagtttacaagaaaggtgcgcagcaatgccgcactcggagccattttcaccgatgagaacaaatggaagtcagctagggaagcggtggaggactccggcttttgggaacttgtcgataaggagcgaaatctgcacttagaaggcaaatgcgagacttgtgtttataacatgatggggaagcgggagaaaaagctgggagagttcggtaaagccaagggctctagagcaatctggtacatgtggttgggggctaggtttctcgagttcgaagccctgggatttctaaatgaggaccattggttcagccgcgaaaacagtctttccggcgtggagggtgaggggctgcacaagctcggatacattctgcgtgatgtaagcaaaaaggaaggcggcgcaatgtatgccgacgatacagctgggtgggacacccggatcacattggaggatctgaaaaatgaagagatggtgactaaccatatggaaggagagcacaagaaactcgccgaggcgatattcaaacttacctaccagaataaggtcgtgagagttcagaggcctacgccccgcggtaccgtgatggacatcatttctcgacgggaccagagaggctcagggcaagtcgtgacatatggactgaacacttttaccaacatggaagcacagttaatcaggcagatggagggcgaaggtgtattcaaaagtattcaacagctgacagttactgaggagatcgccgtgaagaattggttggtccgcgtggggagagaacggctctccaggatggctattagcggagatgactgcgtggtcaaaccactggatgaccgttttgcctctgcactaaccgctcttaacgatatgggcaaggttcgaaaagacatacagcagtgggagccctcgcgcggctggaatgattggacgcaagtgcctttctgctcacatcactttcacgaactgatcatgaaggacgggagagtactcgtggtcccatgtcggaaccaggatgagctgattggaagggcccgcatcagccagggtgctggctggtccttgcaggaaacagcctgcttagggaagagttacgcacaaatgtggtctctgatgtatttccatagacgggacctcaggcttgcggccaatgctatctgtagcgccgtgccgtcccactgggttcccacctcacgaactacatggagtattcatgcaacccacgagtggatgactaccgaggatatgctgacagtgtggaaccgtgtctggatacaggaaaatccttggatggaggacaaaacgccagtggaatcttgggaggaaatcccctacctaggaaagagagaggatcagtggtgcggcagcctgattggtctcacctcccgcgctacttgggccaaaaacatccagacagcaattaatcaagtacggtcattgatcgggaacgaggaatataccgactacatgcctagcatgaagaggtttagacgcgaggaagaggaagccggagttctgtggtga

SEQ ID NO: 14942 - RNA, 9876 nt, synthetic construct
  misc_feature 1..9876: note = derived and/or modified CDS sequence (opt3) from DENV-2__KC762676__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgcactttcagcgcgttttgatcttcattctcctgactgcagtggccccatctatgacaatgagatgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaacatcctgcgacgctgcggaagtattgcattgaagcaaaacttaccaacacaactaccgcctcccgctgtccaacacagggggagccctctttgaatgaggaacaagataagcgatttgtctgcaaacacagcatggtggacagaggatggggcaacggttgtgggctgttcggaaagggcggcatcgtgacttgcgctatgtttacctgcaagaaaaatatggaggggaagatcgtccagcctgaaaacctagagtacacaattgttataaccccacattccggagaagagaatgccgtgggtaacgatactggcaaacacgggaaggagatcaaagtaacgccgcagtcaagtattacagaagcagagctcaccggatatggcactgtgaccatggaatgtagccccaggacaggtctggacttcaatgagatggtccttctgcagatggaaaacaaggcttggttggtgcaccggcaatggtttctcgatctgcctttaccatggctgcccggggccgacacccagggctctaactggatccagaaagagactctcgttacattcaagaatcctcatgcgaagaaacaggatgtggtcgtgcttggatcccaagagggcgccatgcacacggcactgaccggggctactgaaatacagatgtcaagcggaaacttgctatttacaggtcatctgaagtgccgtctccgcatggacaaactgcagcttaagggcatgagttactctatgtgtaccgggaaattcaaggtagttaaggagattgccgaaacacaacacggaactatcgtgatcagagtccagtatgagggcgacggttccccatgcaaaattcccttcgagatcatggatctggaaaagaggcatgtgttggggcggctcattaccgtcaatccgatagtgacggagaaagacagccctgttaacatcgaagctgagcccccatttggcgattcgtacattatcatcggagtggaacctggccagctgaagttatcttggttcaaaaaggggtcctcaattggacagatgtttgagaccacaatgcgaggtgccaagcgcatggcaatactgggcgacactgcctgggatttcgggagtctaggaggcgtatttaccagcatcggtaaagctctccaccaagtcttcggggcgatttacggcgcagccttttccggagtgtcttggacaatgaagatcctgattggcgttgtgatcacttggatagggatgaatagcagatcaaccagtctttccgtcagcttggtgctggtaggagtggttacgctctatctgggcgtcatggtgcaggctgactctggttgtgtggtctcatggaaaaacaaggagcttaaatgcgggagtggaatcttcattacagataatgttcacacctggactgaacagtacaagtttcagcccgagagcccatccaagctggcctctgcaatccaaaaagcccatgaagagggcatttgtggtatcaggtcggtgacacggttggaaaacctcatgtggaagcagataacccccgagctgaatcacattttaagcgagaacgaagtgaaactgactatcatgaccggcgacattaaggggatcatgcaggctggaaaacgctccctaagacctcagccaacagagctcaagtattcatggaaaacgtggggcaaggccaagatgctgagtaccgaacttcataatcacactttcttgatagatgggccggagacagcagaatgccccaacaccaatagggcgtggaactctctggaggtagaggactacggatttggcgtcttcacaactaatatctggctcaaactgaaggaacgtcaagatgtgtattgtgacagcaaattaatgtccgctgccattaaggacaaccgggcagttcacgccgatatgggttactggatcgagtcagctctgaacgacacctggaaaattgaaaaggccagctttatcgaggtgaagtcttgctattggcctaaatcccatacgctttggagtaatggggtcttggagagcgaaatgataattccaaagaacttcgcaggacccgtgtctcagcacaattaccgacctggctaccatacacagaccgctggtccatggcacctcggcagactggagatggatttcgacttttgtgaagggactaccgttgtggtaacagaggattgcggaaacaggggcccctccctacgcactaccacagcctcagggaaactgatcacggaatggtgctgtcggagttgcaccctcccgcctctgagatataggggagaggacggctgttggtacggtatggagatccgcccacttaaggaaaaagaggaaaatttggtcaacagcctggtgactgcggggcatggacagattgataatttctcgttaggcgtgctcggtatggccctgtttcttgaggaaatgctgcgaacacgggtcggcaccaagcacgctatcttgctcgttgcagtgtccttcgtaactctgattacagggaacatgtcttttcgtgacctaggaagagtgatggtcatggtgggcgccaccatgacggatgacatagggatgggagttacttatctggctctcctggccgcattcaaggtgaggcccacctttgcggccggccttttgctgcgcaaattaacaagcaaggagctcatgatgaccactatcggtattgtcctgctttcacaaagtacaatccctgagaccattctggaactaacagatgctctcgccctggggatgatggcattgaaaatcgtgcggaatatggagaagtaccagctggctgttactataatggccatcttatgcgtgcccaacgcagtcattctccagaatgcctggaaagtatcctgtaccacgctggctgtggtttctgtgagcccacttctgttgacatcctcacaacagaaggcggactggatccctctcgccctgaccattaagggactaaaccccactgcaatcttcctgaccacacttagcagaactagtaaaaagaggtcttggccactcaatgaagctataatggccgtcggcatggtgtccattctggccagctcgttgctgaaaaacgatatcccgatgaccggccctttagtagctgggggactcctgacggtgtgctatgtccttacaggtcgatcagcagacctggagttggaacgcgccgcggacgttcggtgggaggagcaggctgaaatctctggcagttcccccattctcagcataaccatctctgaggatgggagcatgtccattaagaatgaagaggaggaacagactctgacaatcctaattagaaccggactgcttgtgatctcaggcctctttccagtgagtatacccatcactgccgcagcctggtacctgtgggaggtcaaaaagcaaagggctggtgtgttgtgggacgttcctagcccaccccctgtagggaaagcagaattagaggatggagcctatcgtattaagcagaagggcatcctgggctactctcagattggggcgggagtgtacaaagaaggtacattccacaccatgtggcatgtcacgcgcggcgctgtgctcatgcacaaggggaaacggatcgagccgtcctgggccgacgttaagaaagatctgatatcatatggaggcggttggaagcttgagggggaatggaaggagggagaagaggtgcaggtcctggcattggaaccaggcaaaaaccccagagccgtgcaaactaagcctggcctatttaaaaccaacacagggaccattggagctgtaagtctggacttcagcccaggtacatccggctctcccatcgtcgataagaaagggaaggtggttggactctacggcaatggtgtggtcactaggtcggggacctatgtgagcgccatcgcacagacggagaagtcaattgaggacaaccctgaaatcgaggatgacatatttcgaaaaaagcggctgacaattatggatcttcatccgggagctggcaaaactaagcgctacttacccgccatcgttagagaagcgattaaaaggggcctgcggaccctcatcttggccccaacacgagtggtcgcagctgagatggaagaggccctgagagggctccctatacgctatcagacccccgctattagggcagagcacactggacgtgaaatcgtggacctgatgtgtcatgccaccttcacaatgcggcttctgtccccaatcagagtacctaattacaacttgattatcatggatgaggcccacttcacggaccccgctagtattgcggcaaggggttatatatctactcgcgtggaaatgggcgaggccgctgggatctttatgaccgccacaccaccgggaagccgagaccctttcccccagtccaatgcaccaattatggatgaggaaagagagatccccgaacggtcatggaactctggccacgagtgggttaccgactttaagggtaagactgtctggttcgtgcctagcatcaaagccgggaatgatattgctgcgtgcctaaggaagaacggaaaaaaggtgatacaactgagtcgcaaaacatttgacttcgaatacatcaagacccgtacgaatgattgggactttgtcgtaactacagatatttccgagatgggcgccaacttcaaggcagagagagtgatcgacccacggaggtgtatgaaacccgttattctcaccgatggcgaagagcgcgtgatcttagctgggcctatgccggtcacccatagctctgccgcacagcgaagaggacgggtgggtaggaatccaaagaacgaaaatgaccagtacatatatatgggcgagcccctggaaaacgatgaggactgcgcccactggaaagaggctaagatgcttctggacaatatcaacactcctgaagggattatcccctcaatgtttgagccagaacgcgagaaagttgatgccattgacggagaatacagactcaggggcgaggcgcggaagacattcgtggatttgatgcgtcgcggtgacctgcctgtctggctcgcatatcgagtggccgctgaggggatcaactacgccgatagaaggtggtgttttgacggcgtaaaaaataaccaaatactggaagagaatgtggaagttgagatttggaccaaggagggagaacggaagaaacttaagccccgctggctagatgctagaatctattccgacccactggcattgaaagagttcaaggaattcgccgctggcaggaaaagtttaacactgaacctcattactgagatggggcggctgcctacgtttatgacccagaaggcccgaaatgcacttgataacctggcggtcctccatacagccgaagctggaggtagagcctacaatcacgcattgagcgagctgccggagactctagaaaccctgctccttctgacattattggctaccgtgactggcgggatcttcctgtttctcatgtcgggaaagggcataggtaaaatgacgctggggatgtgctgcatcattaccgcctctatccttctgtggtatgcacagattcagccccactggatcgccgcttccataattctcgagttctttttgatcgtgctgttaatcccagaacctgagaagcaacgcacaccccaggacaaccagctaacttacgtcgttattgcgatcctgaccgtggtagccgcaacaatggctaatgaaatgggcttcctcgagaaaaccaagaaagattttggacttggcagcataactacacagcaaccagagtcaaacattctggacatcgatttgaggcctgccagtgcctggacgctgtacgcagtggctaccactttcattacacccatgctccggcattctatcgaaaattccagcgtcaacgtgtcactgaccgccatagcgaatcaggctaccgttcttatggggctcggaaagggttggccgctgagtaagatggacatcggcgtgagcttgctggccattgggtgttattcccaggtcaacccaatcacattaactgcagccctactgctccttgtagctcactacgcaattatcggacctggcctgcaggccaaagcgacgcgtgaggctcaaaagagagccgcagccggtattatgaaaaatcccaccgtggacgggatcacagttatagatttggacccaattccctatgatcctaagtttgaaaaacagctgggccaggtgatgctcctggtcctttgcgtgactcaggtcttaatgatgaggaccacatgggctctgtgtgaggccctcaccttggcaactggaccgatctctacgctgtgggaaggcaaccccgggcgcttctggaatacaaccatcgctgtgagcatggccaacatttttcggggatcctacctagcgggcgccggtctgctcttctcaataatgaagaacactgcaaatacccgaagagggacaggaaacactggcgagacccttggtgagaagtggaaaaataggctgaacgctttgggcaagtctgaatttcaaatctataaaaagagtgggattcaggaggttgaccgcacactggccaaagaaggaatcaagcggggcgagacggatcatcacgcagtgtcgagagggagcgctaaactccgttggttcgtagagaggaatctggtgaccccagaaggaaaggtcgttgacttaggctgcggtcgggggggatggtcctactattgtggcggtcttaagaacgtgaaagaggtcaagggcctgactaaagggggacctggccatgaagagcccattcctatgtctacatacgggtggaatctcgtgcgcctacagtcaggagtagatgtgttctttaccccacccgaaaagtgcgacactctgttgtgtgatatcggcgagagctcccctaacccaacagttgaggccggtcgaaccctgagagtgctcaatcttgtcgaaaactggctgaataacaatacgcaattctgcataaaagtgttgaacccctacatgccgagtgtcatcgagaagatggaagccctgcagaggaagtatgggggagcgctcgtgcggaatcctttatctcgcaacagcacccacgagatgtactgggtttcaaacgcttccggcaatattgtaagtagcgtgaacatgatctctagaatgctgattaataggtttacaatgcgacacaaaaaggcaacttatgaaccagacgtcgatcttggctccgggacccggaacatcggaatagagtcagagattcccaatctggacatcatcggtaaacgtattgaaaagataaaacaggagcatgaaacaagctggcactacgatcaggaccatccttatagaacttgggcctaccacggctcgtatgagaccaagcaaacagggtctgctagttccatggtgaacggagttgtgcgcctactcaccaagccatgggacgtcatccccatggtgactcagatggccatgacggatacaaccccgttcggccagcagagggtatttaaagaaaaggtggacactcggacccaagagcctaaagagggtacaaagaaactgatgaagattacggcagaatggttgtggaaggagctggggaaaaagaaaacccccagaatgtgtactcgcgaagagttcacaaggaaggttcgaagcaatgccgctctcggagcgatctttaccgatgagaacaaatggaagtcagcccgggaagcagtcgaggactccggcttctgggaacttgtggataaagagagaaatctgcacttagaaggcaagtgcgagacttgtgtgtacaacatgatggggaagagggagaaaaagctgggagaatttggtaaagctaagggctctcgcgccatttggtacatgtggttgggggcacgtttcctcgagtttgaagccctgggattcctaaatgaggaccattggtttagccgggaaaacagtctttccggcgtcgagggtgaggggctgcacaaactcggatatatcctgagagatgttagcaagaaggaaggcggcgctatgtacgccgacgatacagcggggtgggacaccaggataacattggaggatctgaaaaatgaagagatggtgactaaccatatggaaggagagcacaagaaactcgcagaggccatcttcaagcttacctatcagaataaagtagtgcgcgtccagcgaccaacgcctcggggtaccgtgatggacattatctctagaagggaccagcgcggctcagggcaagttgtgacatacggactgaacactttcaccaacatggaagctcagttaattagacagatggagggcgaaggtgtctttaagagtatccaacagctgacagtgactgaggagattgccgtaaagaattggttggttcgggtggggagggaacgtctctcccgaatggcaataagcggagatgactgcgtcgtgaaacccctggatgaccgcttcgctaacgccctaaccgctcttaatgatatgggcaaggtgagaaaagacatccagcagtgggagccatctcggggctggaacgattggacgcaagtccccttttgctcgcatcacttccacgaactgattatgaaggacgggagggttctcgtggtaccttgtcgcaatcaggatgagctgatcggaagagcccggatctcacagggtgcaggctggagcttgagggaaacagcgtgcttagggaaatcctatgcccagatgtggagtctgatgtactttcatcgacgtgacctcagacttgctgccaacgcaatttgttctgctgtgccaagccactgggtcccgacctcccgcactacatggtcaatacatgccacccacgagtggatgactaccgaggatatgctgacagtgtggaatcgggtttggatccaagaaaacccctggatggaggacaagacgcctgtggaaagttgggaggaaattccatatctaggaaagagggaggatcagtggtgcggctctctgatcggtctcaccagcagagcaacttgggccaaaaatattcagacagcgatcaaccaggtccgctccttgatagggaatgaggaatacaccgactacatgccctcaatgaagcggttcaggcgagaggaagaggaagctggagtgctgtggtga

SEQ ID NO: 14943 - RNA, 9876 nt, synthetic construct
  misc_feature 1..9876: note = derived and/or modified CDS sequence (opt3) from DENV-2__KC762662__SS-prME
  source 1..9876: mol_type = other RNA
accgcaggaatcattataatgatgatccccacagtgatggctttccacctgactacgcgaaacggggagcctcatatgattgtaagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtgacaccatctatgaccatgcggtgcatcggcatatcgaacagggactttgtcgaaggggtgtcaggaggtagctgggtagatattgttctggagcacggcagttgtgtgactacaatggccaaaaataagcccaccctcgacttcgaattaatcaagacggaggctaaacaccctgccaccctgcggaagtactgcattgaagcgaaacttacaaacactaccacagcatcccgctgtccaactcagggggagccctctttgaatgaggaacaagataagcgatttgtctgcaaacatagcatggtggacagaggatggggcaacggttgtgggctgttcggaaagggcggcatcgtgacctgcgccatgtttacatgcaagaaaaatatggaggggaagatcgtccagcctgaaaacctagagtataccattgttataactccacactccggagaagagaatgctgtgggtaacgatacgggcaaacatgggaaggagatcaaagtaacaccgcagtcaagtattaccgaagccgagctcactggatacggcaccgtgacaatggaatgtagccccaggaccggtctggacttcaatgagatggtccttctgcagatggaaaacaaggcatggttggtgcaccggcaatggtttctcgatctgcctttaccatggctgcccggggctgacactcagggctctaactggatccagaaagagacactcgttacgttcaagaatcctcacgccaagaaacaggatgtggtcgtgcttggatcccaagagggcgcgatgcataccgccctgactggggcaacagaaatacagatgtcaagcggaaacttgctatttaccggtcacctgaagtgccgtctccgcatggacaaactgcagcttaagggcatgagttattctatgtgtacagggaaattcaaggtagttaaggagattgctgaaactcaacatggaaccatcgtgatcagagtccagtacgagggcgacggttccccatgcaaaattcccttcgagatcatggatctggaaaagaggcacgtgttggggcggctcattacggtcaatccgatagtgaccgagaaagacagccctgttaacatcgaagccgagcccccatttggcgattcgtacattatcatcggagtggaacctggccagctgaagttatcttggttcaaaaaggggtcctcaattggacagatgtttgagacaactatgcgaggtgctaagcgcatggccatactgggcgacaccgcatgggatttcgggagtctaggaggcgtatttacaagcatcggtaaagccctccatcaagtcttcggggctatttatggcgcggcattttccggagtgtcttggactatgaagatcctgattggcgttgtgatcacctggatagggatgaatagcagatcaacgagtctttccgtcagcttggtgctggtaggagtggttacactctacctgggcgtcatggtgcaggccgactctggttgtgtggtctcatggaaaaacaaggagcttaaatgcgggagtggaatcttcattaccgataatgttcacacttggacagaacagtataagtttcagcccgagagcccatccaagctggcttctgccatccaaaaagcacacgaagagggcatttgtggtatcaggtcggtgacccggttggaaaacctcatgtggaagcagataactcccgagctgaatcatattttaagcgagaacgaagtgaaactgaccatcatgacaggcgacattaaggggatcatgcaggccggaaaacgctccctaagacctcagccaacggagctcaagtactcatggaaaacctggggcaaggctaagatgctgagtactgaacttcacaatcatacattcttgatagatgggccggagaccgccgaatgccccaacgcaaatagggcgtggaactctctggaggtagaggactatggatttggcgtcttcacaactaatatctggctcaaactgaaggaacgtcaagatgctttttgtgacagcaaattaatgtccgccgcaattaaggacaaccgggccgtgcacgctgatatgggttactggatcgagtcagccctgaacgacacctggaaaattgaaaaggccagcttcatcgaggttaagtcttgccactggcctaaatcccatacgctttggagtaatggggtgttggagagcgaaatgataattccaaagaacttcgctggacccgtctctcagcacaattatcgacctggctaccatacacagaccgccggtccatggcacctcggcagactggagatggattttgacttctgtgaagggactaccgtggttgtgacagaggattgcggaaacaggggcccctccctacgcactaccacagcgtcagggaaactgatcacggaatggtgctgtcggagttgcaccctcccgcctctgagatacaggggagaggacggctgttggtatggtatggagatccgcccacttaaggaaaaagaggaaaatttggtaaacagcctggtcactgccgggcatggacagattgataatttttcgttaggcgtgctcggtatggctctgttccttgaggaaatgctgcgaacacgggtgggcaccaagcacgcaatcttgctcgtcgccgtttcctttgtgactctgattacagggaacatgtctttccgtgacctaggaagagtaatggtgatggtcggcgctaccatgacggatgacatagggatgggagtgacttacctggccctcctggcagcgtttaaggttaggcccaccttcgccgctggccttttgctgcgcaaattaacaagcaaggagctcatgatgaccactatcggtattacactgctttcacaaagtaccatccctgagacaattctggaactaactgatgccctcgcactggggatgatggtgttgaaaatcgtccggaatatggagaagtatcagctggctgtgaccataatggccatcttatgcgttcccaacgcagtgattctccagaatgcctggaaagtctcctgtacgacactggctgtagtgtctgttagcccacttctgttgacctcctcacaacagaaggcggactggatccctctcgccctgactattaagggactaaaccccaccgcaatctttctgacaactcttagcagaaccagtaaaaagaggtcttggccactcaatgaagctataatggccgtgggcatggtctccattctggccagctcgttgctgaaaaacgatatcccgatgacgggccctttagtggctgggggactcctgacagtatgctacgtgcttaccggtcgatcagcagacctggagttggaacgcgccgcggacgtccggtgggaggagcaggctgaaatctctggcagttcccccattctcagcataactatctctgaggatgggagcatgtccattaagaatgaagaggaggaacagacactgaccatcctaattagaactggactgcttgttatctcaggcctcttcccagtgagtatacccatcacagccgcagcctggtatctgtgggaggtgaaaaagcaaagggctggtgtcttgtgggacgtgcctagcccaccccctgttgggaaagcagaattagaggatggagcctaccgtattaagcagaagggcatcctgggctattctcagattggggcgggagtatacaaagaaggtacctttcacacgatgtggcatgtgactcgcggcgctgtcctcatgcacaaggggaaacggatcgagccgtcctgggccgacgtgaagaaagatctgatatcatacggaggcggttggaaacttgagggggaatggaaggagggagaagaggttcaggtgctggcattggaaccaggcaaaaaccccagagccgtccaaaccaagcctggcctattcaaaacaagtaccgggacaattggagctgtgagcctggacttttccccaggtacttctggctcgcccatcgtagataagaaagggaaggtcgtgggactctatggcaacggtgttgtgaccaggagcgggacgtacgtctcagccatcgcacagacagagaagtccattgaggacaatcctgaaatcgaggatgacatattcagaaagaaacggctgactattatggatcttcatccgggagctggcaaaaccaagcgctatttacccgccatcgtgagagaagcgattaaaaggggcctgcggacactcatcttggccccaacccgagttgtggcagctgagatggaagaggccctgagagggctccctatacgctaccagactcccgctattagggcagagcacaccggacgtgaaatcgtcgacctgatgtgtcatgccacattcacgatgcggcttctgagtccaatcagagtgcctaactataatttgattatcatggatgaggcccactttactgaccccgcttctattgcggcaaggggttacataagcacccgcgtagaaatgggcgaggccgctgggatcttcatgacagccaccccaccgggatcccgagacccttttccccagtcaaacgcaccaattatggatgaggaaagagagatccccgaacggtcttggaatagcggccacgagtgggtgactgacttcaagggtaagacagtttggtttgtccctagtatcaaagccgggaacgatattgctgcgtgcctaaggaagaatggcaaaaaggtgatacaactgtcccgcaaaaccttcgactttgaatatatcaagacgcgtactaacgattgggacttcgtggtcacaaccgatattagcgagatgggcgccaattttaaggcagagagagtaatcgacccacggaggtgtatgaaacccgtgattctcaccgatggcgaagaacgcgttatcttagctgggcctatgccggtgactcattcttcagccgcacagcgaagaggacgggtcggtaggaacccaaagaatgaaaacgaccagtacatatacatgggcgagcccctggaaaatgatgaggactgcgcccactggaaagaggctaagatgcttctggacaacatcaatacacctgaagggattatcccctccatgttcgagccagaacgcgagaaagtggatgccattgacggagaatatagactcaggggcgaggcgcggaagacctttgttgatttgatgcgtcgcggtgacctgcctgtgtggctcgcataccgagtcgccgctgaggggatcaactatgccgatagaaggtggtgtttcgacggcgtgaaaaacaatcaaatactggaagagaacgtagaagtggagatttggacaaaggagggagaacggaagaaacttaagccccgctggctagatgctagaatctacagtgacccactggcattgaaagagttcaaggaatttgccgctggcaggaagtcgttaactctgaatctcattacggagatggggcggctgcctaccttcatgacacagaaggcccgaaacgcacttgataatctggcggttctccatactgccgaagctggaggtagagcctataaccacgcattgagcgagctgccggagaccctagaaacactgctccttctgaccttattggctactgtcacgggcgggatctttctgttcctcatgtctggaaagggcgtgggtaaaatgaccctggggatgtgctgcataatcacagcctccattcttctgtggtacgcacagatccagccccactggattgccgctagcatcatactcgagtttttcttgattgtgctgttaatcccagaacctgagaagcaacgcactccccaggacaatcagctaacctatgtcgttatcgcgattctgacagtggtagccgcaaccatggctaacgaaatgggctttctcgagaaaactaagaaagatttcggacttggctcaatcacaacgcagcaaccagagagtaatatactggacattgatttgaggcctgcctctgcctggaccctgtacgcagtggctactacatttatcacccccatgctccggcattccattgaaaacagctcagtcaatgtgagtctgaccgccatcgcgaaccaggctacagttcttatggggctcggaaagggttggccgctgagcaagatggacataggcgtgccattgctggccatcgggtgttactcccaggtcaatcctattactttaacggcagccctactgctccttgtagctcactatgcaatcattggacccggcctgcaggccaaagcgacccgtgaggctcaaaagagagccgcagccggtatcatgaaaaacccaacagtggacgggattactgttatcgatttggaccccataccttacgatccgaagttcgaaaaacagctgggccaggtgatgctcctggtcctttgcgtgacccaggtcttaatgatgaggacaacctgggctctgtgtgaggccctcactttggcaacgggacccatttctacactgtgggaaggcaatccagggcgcttttggaacaccactatcgctgtgagcatggccaatatcttccggggatcctatctagcgggcgccggtctgctcttttcaattatgaagaacaccgcaaacacacgaagagggactggaaataccggcgagacacttggtgagaagtggaaaaacaggctgaatgctttgggcaagtctgagttccaaatatacaaaaagagtgggatccaggaggttgaccgcacgctggccaaagaaggaattaagcggggcgagaccgatcatcacgcagtgtcgagagggagcgctaaactccgttggttcgtagagaggaacctggtgactcctgaaggaaaggtcgttgacttaggctgcggtagagggggatggtcctattactgtggcggtcttaagaatgtgaaagaggtcaagggcctgacaaaagggggacccggccatgaagaacctatcccaatgtctacctatgggtggaacctcgtgcgcctacagtcaggagtagatgtgtttttcactccccctgaaaagtgcgacacactgttgtgtgatattggcgagagctccccaaatcccaccgttgaggccggtcgaacgctgagagtgctcaaccttgtcgaaaattggctgaacaataacacccaattttgcatcaaagtgttgaatccgtacatgcctagtgtcatagagaagatggaagccctgcagaggaagtacgggggagcgctcgtgcggaacccattatctcgcaatagcacacacgagatgtattgggtttcaaacgcttccggcaacatcgtaagtagcgtgaatatgatttctagaatgctgatcaacaggttcactatgcgacacaaaaaggcaacctacgaacccgacgtcgatcttggctccgggacacggaatattggaatcgagtcagagactcctaacctggacataattggtaaacgtatcgaaaagatcaaacaggagcatgaaaccagctggcactatgatcaggaccatccatacaagacatgggcctatcacggctcgtacgagaccaagcaaactgggtctgctagttccatggtgaatggagttgtgagactactcacgaaaccctgggacgtcattccgatggtgacacagatggccatgaccgatactaccccttttggccagcagcgcgtattcaaggaaaaagtggacacaaggacgcaagagcccaaggagggtaccaaaaagctgatgaagataactgcagaatggttgtggaaagagctggggaagaaaaagacaccacggatgtgtaccagagaagagtttactcgcaaagttaggagcaacgccgctctcggagcgatcttcacagatgagaataagtggaaatcagcccgagaagcagtcgaggactccggcttttgggaacttgtggataaggagcggaacctgcacttagaaggcaagtgcgagacctgtgtgtataatatgatggggaaaagagagaagaaactgggagagttcggtaaggctaaaggctctagggccatttggtacatgtggttgggggcacgctttctcgagttcgaagccctgggatttctaaacgaggaccattggttcagccgtgaaaatagtctttccggcgtcgagggtgaggggctgcacaagctcggatacatcctgcgggatgttagcaagaaagaaggcggcgctatgtatgccgacgatacagcggggtgggacactagaattaccttggaggatctgaagaacgaagagatggtgacgaatcatatggaaggagagcacaaaaagctcgcagaggccatcttcaaacttacctaccagaacaaggtagtgagggtccagcgccctacaccccgaggtactgtgatggacataatctctcggagagaccagaggggctcagggcaagttgtgacctatggactgaatacatttactaacatggaagctcagttaattcgccagatggagggcgaaggtgtcttcaagagtatccaacagctgaccgtgacggaggagattgccgtcaaaaactggttggttacagtggggagagaacggctctccaggatggcaatcagcggagatgactgcgtcgtgaagccactggatgaccgttttgcttctgccctaaccgctcttaatgatatgggcaaagtgcgaaaggacattcagcagtgggagccctcgcgcggctggaacgattggactcaagtccctttctgctcacatcactttcacgaactgataatgaaagacgggagagttctcgtggtaccatgtcggaatcaggatgagctgatcggaagggcccgcattagccagggtgcaggctggtccttgagagaaacagcgtgcttagggaagagttacgcccagatgtggtctctgatgtatttccatcggagggacctccgacttgctgccaacgcaatctgtagcgctgtgccgtcccactgggtccccacctcacgtactacctggagtatccatgccacacacgagtggatgacgaccgaggatatgctgactgtgtggaatagagtttggattcaagaaaacccttggatggaggacaagacaccagtggaatcttgggaggaaataccctacctaggaaaacgcgaggatcagtggtgcggcagcctgatcggtctcacctcccgggcaacttgggccaagaatattcagacagcgatcaaccaggtcaggtcattgattgggaatgaggaatataccgactacatgcctagcatgaaaagatttcgccgggaggaagaggaagctggagtgctgtggtga

SEQ ID NO: 14944 - RNA, 9876 nt, synthetic construct
  misc_feature 1..9876: note = derived and/or modified CDS sequence (opt3) from DENV-2__KC762661__SS-prME
  source 1..9876: mol_type = other RNA
accgcaggaatcattataatgatgatccccacagtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtgacaccatctatgaccatgcggtgcatcggcatatcgaacagggactttgtcgaaggggtgtcaggaggtagctgggtagatattgttctggagcacggcagttgtgtgactacaatggccaaaaataagcccaccctcgacttcgaattaatcaagacggaggctaaacaccctgccaccctgcggaagtactgcattgaagcgaaacttacaaacactaccacagcatcccgctgtccaactcagggggagccctctttgaatgaggaacaagataagcgatttgtctgcaaacatagcatggtggacagaggatggggcaacggttgtgggctgttcggaaagggcggcatcgtgacctgcgccatgtttacatgcaagaaaaatatggaggggaagatcgtccagcctgaaaacctagagtataccattgttataactccacactccggagaagagaatgctgtgggtaacgatacgggcaaacatgggaaggagatcaaagtaacaccgcagtcaagtattaccgaagccgagctcactggatacggcaccgtgacaatggaatgtagccccaggaccggtctggacttcaatgagatggtccttctgcagatggaaaacaaggcatggttggtgcaccggcaatggtttctcgatctgcctttaccatggctgcccggggctgacactcagggctctaactggatccagaaagagacactcgttacgttcaagaatcctcacgccaagaaacaggatgtggtcgtgcttggatcccaagagggcgcgatgcataccgccctgactggggcaacagaaatacagatgtcaagcggaaacttgctatttaccggtcacctgaagtgccgtctccgcatggacaaactgcagcttaagggcatgagttattctatgtgtacagggaaattcaaggtagttaaggagattgctgaaactcaacatggaaccatcgtgatcagagtccagtacgagggcgacggttccccatgcaaaattcccttcgagatcatggatctggaaaagaggcacgtgttggggcggctcattacggtcaatccgatagtgaccgagaaagacagccctgttaacatcgaagccgagcccccatttggcgattcgtacattatcatcggagtggaacctggccagctgaagttatcttggttcaaaaaggggtcctcaattggacagatgtttgagacaactatgcgaggtgctaagcgcatggccatactgggcgacaccgcatgggatttcgggagtctaggaggcgtatttacaagcatcggtaaagccctccatcaagtcttcggggctatttatggcgcggcattttccggagtgtcttggactatgaagatcctgattggcgttgtgatcacctggatagggatgaatagcagatcaacgagtctttccgtcagcttggtgctggtaggagtggttacactctacctgggcgtcatggtgcaggccgactctggttgtgtggtctcatggaaaaacaaggagcttaaatgcgggagtggaatcttcattaccgataatgttcacacttggacagaacagtataagtttcagcccgagagcccatccaagctggcttctgccatccaaaaagcacacgaagagggcatttgtggtatcaggtcggtgacccggttggaaaacctcatgtggaagcagataactcccgagctgaatcatattttaagcgagaacgaagtgaaactgaccatcatgacaggcgacattaaggggatcatgcaggccggaaaacgctccctaagacctcagccaacggagctcaagtactcatggaaaacctggggcaaggctaagatgctgagtactgaacttcacaatcatacattcttgatagatgggccggagaccgccgaatgccccaacgcaaatagggcgtggaactctctggaggtagaggactatggatttggcgtcttcacaactaatatctggctcaaactgaaggaacgtcaagatgctttttgtgacagcaaattaatgtccgccgcaattaaggacaaccgggccgtgcacgctgatatgggttactggatcgagtcagccctgaacgacacctggaaaattgaaaaggccagcttcatcgaggttaagtcttgccactggcctaaatcccatacgctttggagtaatggggtgttggagagcgaaatgataattccaaagaacttcgctggacccgtctctcagcacaattatcgacctggctaccagacacagaccgccggtccatggcatctcggcagactggagatggattttgacttctgtgaagggactaccgtggttgtgacagaggattgcggaaacaggggcccctccctacgcactaccacagcgtcagggaaactgatcacggaatggtgctgtcggagttgcaccctcccgcctctgagatacaggggagaggacggctgttggtatggtatggagatccgcccacttaaggaaaaagaggaaaatttggtaaacagcctggtcactgccgggcacggacaaattgataatttttcgttaggcgtgctcggtatggctctgttccttgaggaaatgctgcgaacacgggtgggcaccaagcatgcaatcttgctcgtcgccgtttcctttgtgactctgattacagggaacatgtctttccgtgacctaggaagagtaatggtgatggtcggcgctaccatgacggatgacatagggatgggagtgacttacctggccctcctggcagcgtttaaggttaggcccaccttcgccgctggccttttgctgcgcaaattaacaagcaaggagctcatgatgaccactatcggtattacactgctttcacagagtaccatccctgagacaattctggaactaactgatgccctcgcactggggatgatggtgttgaaaatcgtccggaatatggagaagtatcagctggctgtgaccataatggccatcttatgcgttcccaacgcagtgattctccaaaatgcctggaaagtctcctgtacgacactggctgtagtgtctgttagcccacttctgttgacctcctcacagcagaaggcggactggatccctctcgccctgactattaagggactaaaccccaccgcaatctttctgacaactcttagcagaaccagtaaaaagaggtcttggccactcaatgaagctataatggccgtgggcatggtctccattctggccagctcgttgctgaaaaacgatatcccgatgacgggccctttagtggctgggggactcctgacagtatgctacgtgcttaccggtcgatcagcagacctggagttggaacgcgccgcggacgtccggtgggaggagcaggctgaaatctctggcagttcccccattctcagcataactatctctgaggatgggagcatgtccattaagaatgaagaggaggaacaaacactgaccatcctaattagaactggactgcttgttatctcaggcctcttcccagtgagtatacccatcacagccgcagcctggtatctgtgggaggtgaaaaagcagagggctggtgtcttgtgggacgtgcctagcccaccccctgttgggaaagcagaattagaggatggagcctaccgtattaagcagaagggcatcctgggctattctcagattggggcgggagtatacaaagaaggtacctttcacacgatgtggcacgtgactcgcggcgctgtcctcatgcataaggggaaacggatcgagccgtcctgggccgacgtgaagaaagatctgatatcatacggaggcggttggaaacttgagggggaatggaaggagggagaagaggttcaagtgctggcattggaaccaggcaaaaaccccagagccgtccagaccaagcctggcctattcaaaacaagtaccgggacaattggagctgtgagcctggacttttccccaggtacttctggctcgcccatcgtagataagaaagggaaggtcgtgggactctatggcaacggtgttgtgaccaggagcgggacgtacgtctcagccatcgcacagacagagaagtccattgaggacaatcctgaaatcgaggatgacatattcagaaagaaacggctgactattatggatcttcacccgggagctggcaaaaccaagcgctatttacccgccatcgtgagagaagcgattaaaaggggcctgcggacactcatcttggccccaacccgagttgtggcagctgagatggaagaggccctgagagggctccctatacgctaccagactcccgctattagggcagagcataccggacgtgaaatcgtcgacctgatgtgtcacgccacattcacgatgcggcttctgagtccaatcagagtgcctaactataatttgattatcatggatgaggcccattttactgaccccgcttctattgcggcaaggggttacataagcacccgcgtagaaatgggcgaggccgctgggatcttcatgacagccaccccaccgggatcccgagacccttttccccaatcaaacgcaccaattatggatgaggaaagagagatccccgaacggtcttggaatagcggccacgagtgggtgactgacttcaagggtaagacagtttggtttgtccctagtatcaaagccgggaacgatattgctgcgtgcctaaggaagaatggcaaaaaggtgatacagctgtcccgcaaaaccttcgactttgaatatatcaagacgcgtactaacgattgggacttcgtggtcacaaccgatattagcgagatgggcgccaattttaaggcagagagagtaatcgacccacggaggtgtatgaaacccgtgattctcaccgatggcgaagaacgcgttatcttagctgggcctatgccggtgactcactcttcagccgcacagcgaagaggacgggtcggtaggaacccaaagaatgaaaacgaccaatacatatacatgggcgagcccctggaaaatgatgaggactgcgcccattggaaagaggctaagatgcttctggacaacatcaatacacctgaagggattatcccctccatgttcgagccagaacgcgagaaagtggatgccattgacggagaatatagactcaggggcgaggcgcggaagacctttgttgatttgatgcgtcgcggtgacctgcctgtgtggctcgcataccgagtcgccgctgaggggatcaactatgccgatagaaggtggtgtttcgacggcgtgaaaaacaatcagatactggaagagaacgtagaagtggagatttggacaaaggagggagaacggaagaaacttaagccccgctggctagatgctagaatctacagtgacccactggcattgaaagagttcaaggaatttgccgctggcaggaagtcgttaactctgaatctcattacggagatggggcggctgcctaccttcatgacacagaaggcccgaaacgcacttgataatctggcggttctccacactgccgaagctggaggtagagcctataaccatgcattgagcgagctgccggagaccctagaaacactgctccttctgaccttattggctactgtcacgggcgggatctttctgttcctcatgtctggaaagggcataggtaaaatgaccctggggatgtgctgcatcattacagcctccatccttctgtggtacgcacagattcaaccccactggatcgccgctagcataattctcgagtttttcttgatcgtgctgttaatcccagaacctgagaagcagcgcactccccaggacaatcagctaacctatgtggtcattgcgatcctgacagttgtggccgcaaccatggctaacgaaatgggctttctcgagaaaactaagaaagatttcggacttggctcaataacaacgcaacagccagagagtaatattctggacatcgatttgaggcctgcctctgcctggaccctgtacgcagtagctactacatttattacccccatgctccggcactccatcgaaaacagctcagtgaatgtcagtctgaccgccatagcgaaccaggctacagtgcttatggggctcggaaagggttggccgctgagcaagatggacatcggcgttccattgctggccattgggtgttactcccaggtgaatcctatcactttaacggcagccctactgctccttgtcgctcattatgcaattatcggacccggcctgcaagccaaagcgacccgtgaggctcagaagagagccgcagccggtattatgaaaaacccaacagtagacgggatcactgtgatagatttggaccccattccttacgatccgaagttcgaaaaacagctgggccaggttatgctcctggtgctttgcgtcacccaagtgttaatgatgaggacaacctgggctctgtgtgaggccctcactttggcaacgggacccatctctacactgtgggaaggcaatccagggcgcttttggaacaccactatcgctgtcagcatggccaatattttccggggatcctatctagcgggcgccggtctgctcttttcaataatgaagaacaccgcaaacacacgaagagggactggaaataccggcgagacacttggtgagaagtggaaaaacaggctgaatgctttgggcaagtctgagttccagatctacaaaaagagtgggattcaggaggtggaccgcacgctggccaaagaaggaatcaagcggggcgagaccgatcaccatgcagtttcgagagggagcgctaaactccgttggttcgtggagaggaacctggtaactcctgaaggaaaggtggtcgacttaggctgcggtagaggcgggtggtcctattactgtgggggtcttaagaatgttaaagaggtgaagggcctgacaaaagggggacccggccacgaagaacctattccaatgtctacctatgggtggaacctcgtccgcctacaatcaggagtggatgtatttttcactccccctgaaaagtgcgacacactgttgtgtgatatcggcgagagctccccaaatcccaccgtggaggccggtcgaacgctgagagttctcaaccttgtggaaaattggctgaacaataacacccagttttgcataaaagtcttgaatccgtacatgcctagtgtgatcgagaagatggaagccctgcagaggaagtacgggggagcgctcgtccggaacccattatctcgcaatagcacacatgagatgtattgggtgtcaaacgcttccggcaacattgttagtagcgtaaatatgatctctagaatgctgattaacaggttcactatgcgacacaaaaaggcaacctacgaacccgacgtggatcttggctccgggacacggaatatcggaatagagtcagagactcctaacctggacattatcggtaaacgtatcgaaaagattaaacaggagcacgaaaccagctggcattatgatcaagaccacccatacaagacatgggcctatcatggctcgtacgagaccaagcagactgggtctgctagttccatggtcaatggagtggttagactactcacgaaaccctgggacgtgataccgatggtcacacagatggccatgaccgatactaccccttttggccagcaacgcgtgttcaaggaaaaagtagacacaaggacgcaggagcccaaggagggtaccaaaaagctgatgaagatcactgcagaatggttgtggaaagagctggggaagaaaaagacaccacggatgtgtaccagagaagagtttactcgcaaagtgaggagcaacgccgctctcggagcgattttcacagatgagaataagtggaaatcagcccgagaagcagttgaggactccggcttttgggaacttgtcgataaggagcggaacctgcacttagaaggcaagtgcgagacctgtgtgtataatatgatggggaaaagagagaagaaactgggagagttcggtaaggctaaaggctctagggccatctggtacatgtggttgggggcacgctttctcgagttcgaagccctgggatttctaaacgaggaccactggttcagccgtgaaaatagtctttccggcgtggagggtgaggggctgcataagctcggatacattctgcgggatgtcagcaagaaagaaggcggcgctatgtatgccgacgatacagcggggtgggacactagaatcaccttggaggatctgaagaacgaagagatggttacgaatcacatggaaggagagcataaaaagctcgcagaggccatattcaaacttacctaccagaacaaggtggtaagggtgcagcgccctacaccccgaggtactgtcatggacatcatttctcggagagaccaaaggggctcaggacaggtggttacctatggactgaatacatttactaacatggaagctcagttaatccgccaaatggagggcgaaggtgtgttcaagagtattcagcagctgaccgtcacggaggagatcgccgtgaaaaactggttggtaagagttgggcgggaaaggctctcccgtatggcaattagcggagatgactgcgtggtcaagccactggatgaccgatttgcttctgccctaacagctcttaatgatatgggcaaagtgcgcaaggacatacagcaatgggagccctcgagaggctggaacgattggacccaggtgcctttctgctcacaccattttcacgaactgatcatgaaagacgggcgggtcctcgttgtgccatgtaggaatcaggatgagctgattggacgcgccagaatcagccagggtgcaggctggtccttgcgggaaactgcgtgcttagggaagagttacgcccaaatgtggtctctgatgtatttccacaggcgagacctccgtcttgctgccaacgcaatctgtagcgctgtaccgtcccattgggtgcccacatcaagaaccacttggagtattcacgccacccatgagtggatgacaacggaggatatgctgaccgtctggaatcgcgtgtggatacaggaaaacccttggatggaggacaagactccagttgaatcttgggaggaaatcccctacctaggaaaacgggaggatcagtggtgcggcagcctgattggtctcacatccagggcaacctgggccaagaatatccagactgcgattaaccaagtgagatcattgatcgggaatgaggaatatacagactacatgcctagcatgaaacgctttcggagggaggaagaggaagctggagtcctgtggtga

SEQ ID NO: 14945 - RNA, 9876 nt, synthetic construct
  misc_feature 1..9876: note = derived and/or modified CDS sequence (opt3) from DENV-2__KC762655__SS-prME
  source 1..9876: mol_type = other RNA
accgcaggcatcattataatgatgatccccactgtgatggctttccacctgactacgagaaacggggaacctcatatgattgtaagcaggcaggaaaagggaaaatccctcctttttaagaccgagaatggtgttaacatgtgcaccctgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactaggaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtgacaccatctatgaccatgagatgcatcggcatatcgaacagggactttgtcgaaggggtgtcaggaggtagctgggtagatattgttctggagcacggcagttgtgtgactacaatggccaaaaataagcccaccctcgacttcgaattaatcaagacggaggctaaacaccctgccaccctgcggaagtactgcattgaagcgaaacttacaaacactaccacagcatcccgctgtccaactcagggggagccctctttgaatgaggaacaagataagcgatttgtctgcaaacatagcatggtggacagaggatggggcaacggttgtgggctgttcggaaagggcggcatcgtgacctgcgccatgtttacatgcaagaaaaatatggaggggaaggtcgttcagcctgaaaacctagagtataccatcgtgattactccacactccggagaagagaatgctgtaggtaacgatacgggcaaacatgggaaggagataaaagtgacaccgcagtcaagtatcaccgaagccgagctcactggatacggcaccgtcacaatggaatgtagccccaggaccggtctggacttcaatgagatggtgcttctgcagatggaaaacaaggcatggttggttcaccggcaatggtttctcgatctgcctttaccatggctgcccggggctgacactcagggctctaactggattcagaaagagacactcgtgacgttcaagaatcctcacgccaagaaacaggatgtcgtggtacttggatcccaagagggcgcgatgcataccgccctgactggggcaacagaaatccagatgtcaagcggaaacttgctatttaccggtcacctgaagtgccgtctccgcatggacaaactgcagcttaagggcatgagttattctatgtgtacagggaaattcaaggttgtgaaggagatagctgaaactcaacatggaaccattgtcatcagagtgcagtacgagggcgacggttccccatgcaaaatccccttcgagattatggatctggaaaagaggcacgtcttggggcggctcatcacggtgaatccgattgttaccgagaaagacagccctgtgaacatagaagccgagcccccatttggcgattcgtacatcattatcggagtagaacctggccagctgaagttatcttggttcaaaaaggggtcctcaatcggacagatgtttgagacaactatgcgaggtgctaagcgcatggccattctgggcgacaccgcatgggatttcgggagtctaggaggcgtctttacaagcataggtaaagccctccatcaagtgttcggggctgtttatggcgcggcattttccggagtgtcttggactatgaagatcctgattggcgtcgtgatcacctggattgggatgaatagcagatcaacgagtctttccgtcagcttggtgctggttggagtcgtgacactctacctgggcgtgatggtccaggccgactctggttgtgttgtgtcatggaaaaacaaggagcttaaatgcgggagtggaatcttcataaccgataatgtgcacacttggacagaacagtataagtttcagcccgagagcccatccaagctggcttctgccatccaaaaagcacacgaagagggcatttgtggtatcaggtcggtaacccggttggaaaacctcatgtggaagcagattactcccgagctgaatcatatcttaagcgagaacgaagtcaaactgaccataatgacaggcgacattaaggggatcatgcaggccggaaaacgctccctaagacctcagccaacggagctcaagtactcatggaaggcttggggcaaggccaagatgctgagtaccgaacttcacaatcatactttcttgattgatgggccggagacagcagaatgccccaacaccaatagggcgtggaactctctggaggtggaggactatggatttggcgttttcacaactaatatctggctcaaactgaaggaacgtcaagatgtgttttgtgacagcaaattaatgtccgctgccataaaggacaacaaagcagtccacgccgatatgggttactggatcgagtcagctctgaacgacacctggaagattgaaaaggccagcttcatcgaggtgaaatcttgccactggcctaagtcccatacgctttggagtaatggggttttggagagcgaaatgattatccccaagaacttcgcaggacccgtgtctcagcacaattatcggcctggctaccatacacagaccgctggtccatggcacctcggccgactggagatggattttgacttctgtgaagggactaccgtagtcgtgacagaggattgcggaaacagaggcccctccctaaggactaccacagcctcagggaagctgataacggaatggtgctgtcgcagttgcaccctcccgcctctgcggtacagaggagaggacggctgttggtatggtatggagattaggccacttaaagaaaaggaggaaaatttggtgaacagcctggtcactgcggggcatggacagatcgataatttttcgttaggcgttctcggtatggccctgttccttgaggaaatgctgcgcacacgagtgggcaccaagcacgctatcttgctcgtagcagtgtcctttgtcactctgattacagggaacatgtctttccgggacctaggacgtgtgatggttatggtgggcgccaccatgacggatgacatcgggatgggagtcacttacctggctctcctggccgcatttaaagtgagacccaccttcgcggccggccttttgctgaggaagttaacaagcaaagagctcatgatgaccactattggtatagttctgctttcacaaagtacaatccctgagaccattctggaactaacagatgctctcgccctggggatgatggtgttgaagatcgtccgcaatatggagaaatatcagctggcagtaactattatggctatcttatgcgtgcccaacgccgttatactccagaatgcatggaaggtgtcctgtaccacgctggccgtcgtgtctgtaagcccacttctgttgacatcctcacaacagaaggctgactggatccctctcgcgctgaccattaaaggactaaaccccactgccatctttctgaccacacttagccggacaagtaagaaaagatcttggccactcaatgaagcaattatggctgtgggcatggtctccatcctggccagctcgttgctgaagaacgatataccgatgaccggccctttagttgccgggggactcctgacggtgtgctacgtgcttacaggtaggtcagctgacctggagttggaacgagcagccgacgtccgctgggaggagcaggcggaaatttctggcagttcccccatcctcagcatcaccatttctgaggatgggagcatgtccatcaagaatgaagaggaggaacagactctgacaatcctaattcggaccggactgcttgtgatctcaggcctcttcccagttagtattcccatcactgctacagcctggtatctgtgggaggtaaagaaacaaagagccggtgtgttgtgggacgtccctagcccaccccctgtggggaaggccgaattagaggatggagcttacaggataaagcagaaaggcatcctgggctattctcagattggggcaggagtttacaaggaaggtacctttcacacgatgtggcatgtgactcgtggcgccgtcctcatgcacaaagggaagcgcatcgagccgtcctgggcggacgtgaaaaaggatctgatttcatacggaggcggttggaaacttgagggggaatggaaagagggagaagaggtacaggtcctggctttggaaccaggcaagaacccccgggccgtgcaaaccaaacctggcctattcaagacaaacaccgggacaatcggagcagttagtctggactttagcccaggtacttccggctctcccatagtggataaaaaggggaaggtcgtgggactctatggcaatggtgttgtgaccagatcggggacgtacgtcagcgccattgctcagacagagaaatcaatcgaggacaaccctgaaatcgaggatgacattttcaggaagaaacgactgactatcatggatcttcatccgggagccggcaagaccaaacggtatttacccgcaatagtgcgcgaagctattaagagaggcctgaggacactcatcttggccccaacccgggtagtggcggccgagatggaagaggcactgcgagggctccctattagataccagactcccgctatccgcgccgagcacaccggaagggaaatagttgacctgatgtgtcatgctacattcacgatgcgtcttctgtccccaattcgggtccctaattataacttgatcatcatggatgaggcacactttactgaccccgccagtattgccgctagaggttacatctctaccagggtggaaatgggcgaggcggcagggattttcatgacagccaccccaccgggaagccgcgacccttttccccagtccaatgctccaataatggatgaggaacgagagatccccgaaagatcatggaactctggccacgagtgggtgactgacttcaagggtaaaacagtctggtttgtacctagcattaaggccgggaatgatatcgcagcctgcctacggaaaaacggaaagaaagtgatccaactgagtaggaagaccttcgactttgaatatattaagacgcgcactaatgattgggacttcgttgtgacaaccgatatatccgagatgggcgctaactttaaagcggagcgtgtcatcgacccaagacggtgtatgaagcccgtgattctcaccgatggcgaagagagggttatcttagccgggcctatgccggtgactcatagctctgcagctcagcgccgaggaagagtcggtcggaatcccaagaacgaaaatgaccagtacatttacatgggcgagcccctggaaaacgatgaggactgcgcccactggaaggaggcaaaaatgcttctggacaatatcaacacacctgaagggataatcccctcaatgttcgagccagaaagggagaaggtggatgccattgacggagaatatcgcctcagaggcgaggctaggaaaacctttgtagatttgatgcggcgtggtgacctgcctgtgtggctcgcctaccgcgttgcggcagaggggatcaactatgccgatcgaagatggtgtttcgacggcgtcaagaataaccaaattctggaagagaatgtggaagtggagatctggacaaaggagggagaaaggaaaaagctaaaaccccggtggcttgatgctcgcatatactccgacccactggccttgaaggagttcaaagaatttgctgcaggcagaaagagtttaactctgaacctcattacggagatggggaggctgcctaccttcatgacacagaaggcccggaatgctcttgataacctggccgtcctccatactgcagaagcgggaggtcgagcctataatcacgctttgagcgagctgccggagaccctagaaacactgctccttctgaccttattggccactgttacgggcgggatctttctgttcctcatgtcgggaaaaggcattggtaagatgaccctggggatgtgctgcatcataacagcatctatccttctgtggtacgctcagattcagccccactggatcgccgcatccattatcctcgagtttttcttgatagtgctgttaattccagaacctgagaaacaaagaactccccaggacaaccagctaacctatgtagtgatcgccatcctgacagtcgtggctgcgaccatggccaatgaaatgggctttctcgagaagactaaaaaggatttcggacttggcagcattgcaacacagcaaccagagtcaaacatcctggacatagatttgcgccctgctagtgcctggacgctgtacgccgttgcaaccacttttattacacccatgctcaggcattctatcgaaaattccagcgtgaacgtctcactgaccgctattgccaatcaggcgaccgtacttatggggctcggaaagggttggccgctgagtaaaatggacatcggcgtgccattgctggctatagggtgttacagccaggttaaccctatcacattaactgccgcactactgctccttgtggcccactatgctattatcggacccggcctgcaggcaaaggccacgcgggaggcgcaaaaacgtgctgccgcaggtattatgaagaatccaaccgtcgacgggatcacagtgattgatttggaccccatcccttacgatccgaaattcgaaaagcagctgggccaggtcatgctcctggtgctttgcgttactcaggtgttaatgatgagaaccacatgggccctgtgtgaggctctcaccttggccactggacccatatccacgctgtgggaaggcaacccagggaggttttggaatacaaccattgcagtatctatggctaacatcttccgcggaagctatctagccggcgcgggtctgctcttttccatcatgaagaacactgccaatacccggcgagggacaggaaacactggcgagacccttggtgagaaatggaagaatagactgaacgcattgggcaaatcagagttccaaatttacaagaaatctgggatacaggaggtggacaggacactggctaaggaaggaatcaaacgcggcgagacggatcatcacgccgtcagtcgggggtcggcaaagctcagatggttcgttgagcgtaatctggtgacccctgaaggaaaggtcgtggacttaggctgcggtagagggggatggagctattactgtggcggtcttaaaaacgtaaaggaggtgaaaggcctgactaaagggggacccggccatgaagaacctattccaatgtccacatatgggtggaatctcgttcggctacagtctggagtggatgtctttttcacaccacctgaaaaatgcgacactctgttgtgtgatatcggcgagtcaagcccaaaccccacagtggaggctggtcgcaccctgcgagtcctcaatcttgtggaaaactggctgaataacaatacgcaattttgcattaaggttttgaacccgtacatgccttccgtaatcgagaagatggaagccctgcagagaaaatacgggggagccctcgtgaggaatccattaagtcggaactctacccacgagatgtattgggtcagcaacgcgtcaggcaatatagtgtccagtgttaacatgatcagccgcatgctgattaatagattcacaatgaggcacaagaaagctacttacgaacccgacgtggatcttggctctgggacccgaaacatcggaattgagtccgagacacctaatctggacatcataggtaagcggattgagaaaataaagcaggaacatgaaacttcatggcactatgatcaggaccatccatacaagacctgggcatatcacggcagctacgagacaaaacaaaccgggtcggcctctagtatggtcaacggagtggtacgtctactcactaagccctgggacgtgatcccgatggttacgcagatggctatgacagataccactccttttggccagcagagagtcttcaaagaaaaggtggacacccgcacacaagagcccaaagagggtacgaagaagctgatgaaaattaccgccgaatggttgtggaaggagctggggaaaaagaaaactccaaggatgtgtacacgggaagagtttaccagaaaggtgcgctccaatgcagccctcggagctatattcactgatgagaacaaatggaaaagcgcgagggaagccgtcgaggactcaggcttttgggaacttgttgataaggagcgatccctgcacttagaaggcaaatgcgagacatgtgtgtataatatgatggggaagcgggagaaaaagctgggagagttcggtaaagcaaagggctctagagctatctggtacatgtggttgggggccaggtttctcgagttcgaagcactgggatttctaaacgaggaccattggttcagccgcgaaaatagtctttccggcgtagagggtgaggggctgcacaagctcggatacattctgcgtgatgtgagcaaaaaggaaggcggcgccatgtatgctgacgataccgccgggtgggacacacggatcactttggaggatctgaaaaacgaagagatggtcaccaatcatatggaaggagagcacaagaaactcgcggaggcaattttcaaacttacgtaccagaacaaggtggttagagtgcagaggcctaccccacgcggtatcgtcatggacataatctctcgacgggaccagagaggctcagggcaagtggtaacatatggactgaatacttttaccaacatggaagcccagttaattaggcagatggagggcgaaggtgttttcaaaagtatccaacagctgacagtgactgaggagattgctgtcaagaactggttggcccgcgtggggagagaacggctctccaggatggcaatcagcggagatgactgcgtggtcaaaccactggatgaccgttttgcttctgccctaaccgctcttaatgatatgggcaaggttcgaaaagacattcagcagtgggagccctcgcgcggctggaacgattggacgcaagtgcctttctgctcacatcactttcacgaactgataatgaaggacgggagagtactcgtggtcccatgtcggaatcaggatgagctgatcggaagggcccgcattagccagggtgcaggctggtccttgagagaaacagcgtgcttagggaagagttacgcccagatgtggtctctgatgtatttccatcggagggacctccgacttgctgccaacgcaatctgtagcgctgtgccgtcccactgggttcccacctcacgtactacatggagtatccatgccacccacgagtggatgactaccgaggatatgctgacagtgtggaatagagtctggattcaagaaaacccttggatggaggacaaaacgccagtggaatcttgggaggaaataccctacctaggaaagcgcgaggatcagtggtgcggcagcctgatcggtctcacctcccgggcaacttgggccaggaatattcagacagcgatcaaccaggtaagatcattgattgggaatgaggaatataccgactacatgcctagcatgaaacgctttcggagggaggaagaggaagctggagttctgtggtga

SEQ ID NO: 14946 - RNA, 9876 nt, synthetic construct
  misc_feature 1..9876: note = derived and/or modified CDS sequence (opt3) from DENV-2__KC762656__SS-prME
  source 1..9876: mol_type = other RNA
accgccggaatcattataatgatgatccccacagtgatggctttccacctgactacgcgaaacggggagcctcatatgattgtaagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgttgcgctcgtgccccatgtcggcatgggtctggagactagagctgaaacctggatgagctccgagggggcctggaagcacgcacagaggatcgagacatgggtgcttcggcatcctggattcactataatggccgctatcctggcatacaccattggcacaacctattttcagcgcgttttgatcttcattctcctgacggccgtgactccatctatgacaatgcggtgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaacaccctgcgacgctgcggaagtactgcattgaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaaggtcgttcagcctgaaaacctagagtatacaatcgtgattaccccacactccggagaagagaatgccgtaggtaacgatactggcaaacatgggaaggagataaaagtgacgccgcagtcaagtatcacagaagcagagctcaccggatacggcactgtcaccatggaatgtagccccaggacaggtctggacttcaatgagatggtgcttctgcagatggaaaacaaggcttggttggttcaccggcaatggtttctcgatctgcctttaccatggctgcccggggccgacacccagggctctaactggattcagaaagagactctcgtgacattcaagaatcctcacgcgaagaaacaggatgtcgtggtacttggatcccaagagggcgccatgcatacggcactgaccggggctactgaaatccagatgtcaagcggaaacttgctatttacaggtcacctgaagtgccgtctccgcatggacaaactgcagcttaagggcatgagttattctatgtgtaccgggaaattcaaggttgtgaaggagatagccgaaacacaacatggaactattgtcatcagagtgcagtacgagggcgacggttccccatgcaaaatccccttcgagattatggatctggaaaagaggcacgtcttggggcggctcatcaccgtgaatccgattgttacggagaaagacagccctgtgaacatagaagctgagcccccatttggcgattcgtacatcattatcggagtagaacctggccagctgaagttatcttggttcaaaaaggggtcctcaatcggacagatgtttgagaccacaatgcgaggtgccaagcgcatggcaattctgggcgacactgcctgggatttcgggagtctaggaggcgtctttaccagcataggtaaagctctccatcaagtgttcgggacaatctatggcgcggcattttccggagtttcttggactatgaagattctgatcggcgtggtcattacctggatcgggatgaatagcagatcaacgagtctttccgtgagcttggtactggtgggagttgtcacactctacctgggcgtgatggtgcaggccgactctggttgtgtcgtttcatggaaaaacaaggagcttaaatgcgggagtggaatattcatcaccgataatgtgcacacttggacagaacagtataagtttcagcccgagagcccatccaagctggcttctgccattcaaaaagcacacgaagagggcatctgtggtattaggtcggtgacccggttggaaaacctcatgtggaagcagatcactcccgagctgaatcatatattaagcgagaacgaagtaaaactgaccattatgacaggcgacatcaaggggattatgcaggccggaaaacgctccctaagacctcagccaacggagctcaagtactcatggaaggcttggggcaaggccaagatgctgagtaccgaacttcacaatcatactttcttgatcgatgggccggagacagcagaatgccccaacaccaatagggcgtggaactctctggaggtcgaggactatggatttggcgtgttcacaactaatatatggctcaaactgaaggaacgtcaagatgtattttgtgacagcaaattaatgtccgctgccatcaaggacaaccgggcagtgcacgccgatatgggttactggattgagtcagctctgaacgacacctggaaaatcgaaaaggccagcttcattgaggtcaagtcttgccagtggcctaaatcccacacgctttggagtaatggggtgttggagagcgaaatgatcataccaaagaacttcgcaggacccgtttctcagcataattatcgacctggctaccacacacagaccgctggtccatggcatctcggcagactggagatggattttgacttctgtgaagggactaccgtggtagtcacagaggattgcggaaacaggggcccctccctacgcactaccacagcctcagggaaactgattacggaatggtgctgtcggagttgcaccctcccgcctctgagatacaggggagaggacggctgttggtatggtatggagatccgcccacttaaggaaaaagaggaaaatttggtgaacagcctggtgactgcggggcacggacaaatcgataatttttcgttaggcgtcctcggtatggccctgttccttgaggaaatgctgcgaacacgggttggcaccaagcatgctattttgctcgtggcagtatcctttgtgactctgatcacagggaacatgtctttccgtgacctaggaagagtcatggtgatggttggcgccaccatgacggatgacattgggatgggagtgacttacctggctctcctggccgcatttaaggtcaggcccaccttcgcggccggccttttgctgcgcaaattaacaagcaaggagctcatgatgaccactataggtatcgtgctgctttcacagagtacaattcctgagaccatcctggaactaacagatgctctcgccctggggatgatggttttgaaaattgtgcggaatatggagaagtatcagctggcagtcactatcatggctatattatgcgtacccaacgccgtgatcctccaaaatgcatggaaagtttcctgtaccacgctggccgtggtctctgtgagcccacttctgttgacatcctcacagcagaaggctgactggattcctctcgcgctgaccatcaagggactaaaccccactgccatttttctgaccacacttagcagaacaagtaaaaagaggtcttggccactcaatgaagcaatcatggctgtaggcatggtgtccatactggccagctcgttgctgaaaaacgatattccgatgaccggccctttagtcgccgggggactcctgacggtttgctacgtgcttacaggtcgatcagctgacctggagttggaacgcgcagccgacgtgcggtgggaggagcaggcggaaatctctggcagttcccccatcctcagcattaccatatctgaggatgggagcatgtccatcaagaatgaagaggaggaacaaactctgacaattctaatcagaaccggactgcttgtcgtgtcaggcctcttcccagttagtattcccatcactgctgccgcatggtatctgtgggaggtcaagaaacagagggccggtgtgttgtgggacgtccctagcccaccccctgtggggaaagctgaattagaggatggagcataccgtataaagcagaagggcatcctgggctattctcagattggggccggagtttacaaagaaggtacatttcacaccatgtggcacgtgacgcgcggcgcggtcctcatgcataaggggaaacggatcgagccgtcctgggctgacgtgaagaaagatctgatttcatacggaggcggttggaaacttgagggggaatggaaggagggagaagaggtacaagtcctggccttggaaccaggcaaaaaccccagagcagtgcagactaagcctggcctattcaaaaccaacacagggaccatcggagccgttagtctggactttagcccaggtacatccggctctcccatagtggataagaaagggaaggtcgtgggactctatggcaatggtgttgtgactaggtcggggacctacgtcagcgctattgcccagacggagaagtcaatcgaggacaaccctgaaatcgaggatgacattttccggaaaaagagactgacaatcatggatcttcacccgggagcaggcaaaactaagcgctatttacccgctatagtgagagaagccattaaaaggggcctgcggaccctcatcttggcgccaacacgagtagtggccgcagagatggaagaggctctgagagggctccctattcgctaccagacccccgccatcagggctgagcatactggacgtgaaatagttgacctgatgtgtcacgcaaccttcacaatgcggcttctgtccccaattagagtccctaattataacttgatcatcatggatgaggcccattttacggaccccgccagtattgctgcgaggggttacatctctactcgcgtggaaatgggcgaggcagccgggattttcatgaccgctacaccaccgggaagccgagacccttttccccaatccaatgccccaataatggatgaggaaagagagatccccgaacggtcatggaactctggccacgagtgggtgaccgacttcaagggtaagactgtctggtttgtacctagcattaaagcagggaatgatatcgccgcttgcctaaggaagaacggcaaaaaggtgatccagctgagtcgcaaaacattcgactttgaatatattaagacccgtacgaatgattgggacttcgttgtgactacagatatatccgagatgggcgcgaactttaaggccgagagagtcatcgacccacggaggtgtatgaaacccgtgattctcaccgatggcgaagaacgcgttatcttagcagggcctatgccggtgacccacagctctgctgcccagcgaagaggacgggtcggtaggaatccaaagaacgaaaatgaccaatacatttacatgggcgagcccctggaaaacgatgaggactgcgcacattggaaagaggccaagatgcttctggacaatatcaacactcctgaagggataatcccctcaatgttcgagccagaacgcgagaaagtggatgctattgacggagaatatagactcaggggcgaggcccggaagacatttgtagatttgatgcgtcgcggtgacctgcctgtgtggctcgcgtaccgagttgcagccgaggggatcaactatgctgatagaaggtggtgtttcgacggcgtcaaaaataaccagattctggaagagaatgtggaagtggagatctggaccaaggagggagaacggaagaaacttaagccccgctggctagatgccagaatatactccgacccactggctttgaaagagttcaaggaatttgcagccggcaggaaaagtttaacactgaacctcattactgagatggggcggctgcctacgttcatgacccagaaggctcgaaatgcccttgataacctggcagtcctccacacagcggaagccggaggtagagcttataatcatgccttgagcgagctgccggagactctagaaaccctgctccttctgacattattggcaaccgttactggcgggatctttctgttcctcatgtcgggaaagggcattggtaaaatgacgctggggatgtgctgcatcataaccgcttctatccttctgtggtacgcccagattcaaccccactggatcgcagcctccattatcctcgagtttttcttgatagtgctgttaattccagaacctgagaagcagcgcacaccccaggacaaccagctaacttatgtagtgatcgctatcctgaccgtcgtggcggccacaatggcaaatgaaatgggctttctcgagaaaaccaagaaagatttcggacttggcagcattgctactcaacagccagagtcaaacatcctggacatagatttgaggcctgccagtgcctggacactgtacgcagttgctacgacctttattactcccatgctccggcactctatcgaaaattccagcgtgaacgtctcactgacagccattgcgaatcaggctaccgtacttatggggctcggaaagggttggccgctgagtaagatggacatcggcgtgccattgctggccatagggtgttacagccaggttaaccctatcaccttaacagcagccctactgctccttgtggctcattatgcaattatcggacccggcctgcaagccaaagcgactcgtgaggctcagaagagagccgcagccggtattatgaaaaatccaacggtcgacgggatcaccgtgattgatttggaccccatcccttacgatccgaagttcgaaaaacagctgggccaggtcatgctcctggtgctttgcgttacacaagtgttaatgatgaggactacctgggctctgtgtgaggccctcacattggcaaccggacccatatccactctgtgggaaggcaacccagggcgcttttggaatacgacaattgctgtatctatggccaacatcttccggggaagctatctagcgggcgccggtctgctcttttccatcatgaagaacaccgcaaatactcgaagagggaccggaaacacaggcgagactcttggtgagaagtggaaaaataggctgaacgctttgggcaagtcagagttccagatttacaaaaagtctgggatacaggaggtggaccgcaccctggccaaagaaggaatcaagcggggcgagacagatcaccatgcagtcagtagagggtcggctaaactccgttggttcgttgagaggaatctggtgacgcctgaaggaaaggtcgtggacttaggctgcggtagaggcgggtggagctattactgtgggggtcttaagaacgtaaaagaggtgaagggcctgaccaaagggggacccggccacgaagaacctattccaatgtccacttatgggtggaatctcgttcgcctacaatctggagtggatgtctttttcacaccccctgaaaagtgcgacaccctgttgtgtgatatcggcgagtcaagcccaaaccccactgtggaggccggtcgaacactgagagtcctcaatcttgtggaaaactggctgaataacaatacccagttttgcattaaagttttgaacccgtacatgccttccgtaatcgagaagatggaagccctgcagaggaagtacgggggagcgctcgtgcggaatccattaagtcgcaactctacgcatgagatgtattgggtcagcaacgcttcaggcaatatagtgtccagtgttaacatgatcagcagaatgctgattaataggttcaccatgcgacacaaaaaggcaacatacgaacccgacgtggatcttggctctgggactcggaacatcggaattgagtccgagacccctaatctggacatcataggtaaacgtattgaaaagatcaaacaggagcacgaaacatcatggcattatgatcaagaccacccatacaagacttgggcctatcatggcagctacgagaccaagcagacagggtcggcttctagtatggtcaacggagtggtaagactactcaccaaaccctgggacgtgatcccgatggttactcagatggccatgacggatacaaccccttttggccagcaacgcgtcttcaaggaaaaagtggacactaggacccaggagcccaaggagggtactaaaaagctgatgaagattacggcagaatggttgtggaaagagctggggaagaaaaagaccccacggatgtgtactagagaagagtttacacgcaaagtgaggtccaatgccgctctcggagcgatattcaccgatgagaacaagtggaaaagcgcccgagaagcagtcgaggactcaggcttttgggaacttgttgataaggagcggaatctgcacttagaaggcaagtgcgagacttgtgtgtataacatgatggggaaaagagagaagaaactgggagagttcggtaaggctaaaggctccagggccatctggtacatgtggttgggggcacgctttctcgagttcgaagccctgggatttctaaatgaggaccactggttctctcgtgaaaacagccttagtggcgtagagggtgaggggctgcataagctcggatacattctgcgggatgtgtccaagaaagaaggcggcgctatgtatgccgacgatacagcggggtgggacaccagaatcacattggaggatctgaagaatgaagagatggtcactaaccacatggaaggagagcataaaaagctcgcagaggccattttcaaacttacctaccagaataaggtggttagggtgcagcgccctacgccccgaggtaccgtcatggacatcataagccggagagaccaaaggggctctggacaggtggtaacatatggactgaacacttttaccaacatggaagctcagttaatccgccaaatggagggcgaaggtgttttcaagtcaattcagcagctgacagtgactgaggagatcgccgtcaaaaattggttggtgagagtggggcgggaaaggctcagtcgtatggcaatttccggagatgactgcgtcgttaagccactggatgaccgatttgctagcgccctaaccgctcttaacgatatgggcaaagtgcgcaaggacatccagcaatgggagccctctagaggctggaatgattggacgcaggtacctttctgctcgcaccattttcacgaactgattatgaaagacgggcgggtgctcgtcgtgccatgtaggaaccaggatgagctgataggacgcgccagaatctcacagggtgcaggctggagcttgcgggaaacagcgtgcttagggaagtcctacgcccaaatgtggagtctgatgtatttccacaggcgagacctccgtcttgctgccaatgcaatttgttctgctgttccgagccattgggtgcccacctccagaactacatggtcaatccacgccacccatgagtggatgactaccgaggatatgctgacagtctggaaccgcgtgtggatccaggaaaatccttggatggaggacaagacgccagtagaaagttgggaggaaattccctacctaggaaaacgggaggatcagtggtgcggctctctgataggtctcaccagcagggcaacttgggccaagaacatccagacagcgattaatcaagttagatccttgatcgggaacgaggaatataccgactacatgccttcaatgaaacgctttcggagggaggaagaggaagctggagtgctgtggtga

SEQ ID NO: 14947 - RNA, 9876 nt, synthetic construct
  misc_feature 1..9876: note = derived and/or modified CDS sequence (opt3) from DENV-2__KC762673__SS-prME
  source 1..9876: mol_type = other RNA
accgccggcatcattataatgatgatccccacagtgatggctttccacctgactacgagaaacggggagcctcatatgattgtaagcaggcaggaaaagggaaaatccctcctttttaagaccgagaatggtgttaacatgtgcacactgatggcaatggacttgggcgaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgtggcgctcgtgccccatgtcggcatgggtctggagactaggaccgaaacatggatgagctccgagggggcttggaagcacgcccagaggatcgagacttgggtgcttcggcatcctggattcaccataatggcagccatcctggcttacacaattggcaccacgcactttcagcgcgttttgatcttcattctcctgactgcagtggccccatctatgacaatgagatgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaacatcctgcgacgctgcggaagtattgcattgaagcaaaacttaccaacacaactaccgcctcccgctgtccaacacagggggagccctctttgaatgaggaacaagataagcgatttgtctgcaaacacagcatggtggacagaggatggggcaacggttgtgggctgttcggaaagggcggcatcgtgacttgcgctatgtttacctgcaagaaaaatatggaggggaagatcgtccagcctgaaaacctagagtacacaattgttataaccccacattccggagaagagaatgccgtgggtaacgatactggcaaacacgggaaggagatcaaagtaacgccgcagtcaagtattacagaagcagagctcaccggatatggcactgtgaccatggaatgtagccccaggacaggtctggacttcaatgagatggtccttctgcagatggaaaacaaggcttggttggtgcaccggcaatggtttctcgatctgcctttaccatggctgcccggggccgacacccagggctctaactggatccagaaagagactctcgttacattcaagaatcctcatgcgaagaaacaggatgtggtcgtgcttggatcccaagagggcgccatgcacacggcactgaccggggctactgaaatacagatgtcaagcggaaacttgctatttacaggtcatctgaagtgccgtctccgcatggacaaactgcagcttaagggcatgagttactctatgtgtaccgggaaattcaaggtagttaaggagattgccgaaacacaacacggaactatcgtgatcagagtccagtatgagggcgacggttccccatgcaaaattcccttcgagatcatggatctggaaaagaggcatgtgttggggcggctcattaccgtcaatccgatagtgacggagaaagacagccctgttaacatcgaagctgagcccccatttggcgattcgtacattatcatcggagtggaacctggccagctgaagttatcttggttcaaaaaggggtcctcaattggacagatgtttgagaccacaatgcgaggtgccaagcgcatggcaatactgggcgacactgcctgggatttcgggagtctaggaggcgtatttaccagcatcggtaaagctctccaccaagtcttcggggcgatttacggcgcagccttttccggagtgtcttggacaatgaagatcctgattggcgttgtgatcacttggatagggatgaatagcagatcaacaccccttagtgtctccttggtgctggtaggagtggttacgctctatctgggcgtcatggtgcaggctgacagcggttgtgtggtctcttggaaaaacaaggagcttaaatgcgggtcaggaatcttcattacagataatgttcacacctggactgaacagtacaagtttcagccagagagtcccagcaagctggcctccgcaatccaaaaagcccatgaagagggcatttgtggtatcaggtctgtgacacggttggaaaacctcatgtggaagcagataacccctgagctgaatcacattttatcggagaacgaagtgaaactgactatcatgaccggcgacattaaggggatcatgcaggctggaaaacgcagcctaagaccacagccgacagagctcaagtattcctggaaaacgtggggcaaggccaagatgctgtcaaccgaacttcataatcacactttcttgatagatgggcccgagacagcagaatgccctaacaccaatagggcgtggaacagtctggaggtagaggactacggatttggcgtcttcacaactaatatctggctcaaactgaaggaacgtcaagatgtgtattgtgactctaaattaatgagcgctgccattaaggacaaccgggcagttcacgccgatatgggttactggatcgagtccgctctgaacgacacctggaaaattgaaaaggcctcatttatcgaggtaaagagctgctattggccaaaatctcatacgctttggtccaatggggtcttggagagtgaaatgataattcccaagaacttcgcaggacctgtgagccagcacaattaccgaccaggctaccatacacagaccgctggtccctggcacctcggcagactggagatggatttcgacttttgtgaagggactaccgttgtggtaacagaggattgcggaaacaggggcccgtctctacgcactaccacagcctccgggaaactgatcacggaatggtgctgtcggtcatgcaccctccctccactgagatataggggagaggacggctgttggtacggtatggagatccgcccccttaaggaaaaagaggaaaatttggtcaacagtctggtgactgcggggcatggacagattgataatttcagcttaggcgtgctcggtatggccctgtttcttgaggaaatgctgcgaacacgggtcggcaccaagcacgctatcttgctcgttgcagtgtcgttcgtaactctgattacagggaacatgtcctttcgtgacctaggaagagtgatggtcatggtgggcgccaccatgacggatgacatagggatgggagttacttatctggctctcctggccgcattcaaggtgaggcctacctttgcggccggccttttgctgcgcaaattaacatctaaggagctcatgatgaccactatcggtattgtcctgcttagccaatcaacaatccccgagaccattctggaactaacagatgctctcgccctggggatgatggcattgaaaatcgtgcggaatatggagaagtaccagctggctgttactataatggccatcttatgcgtgccaaacgcagtcattctccagaatgcctggaaagtaagttgtaccacgctggctgtggtttccgtgtctcctcttctgttgacaagctcccaacagaaggcggactggatccccctcgccctgaccattaagggactaaacccaactgcaatcttcctgaccacactttcaagaactagcaaaaagaggagttggccgctcaatgaagctataatggccgtcggcatggtgtctattctggcctccagcttgctgaaaaacgatatccctatgaccggccccttagtagctgggggactcctgacggtgtgctatgtccttacaggtcgatcggcagacctggagttggaacgcgccgcggacgttcggtgggaggagcaggctgaaatctcaggctctagtccaattctctccataaccatcagcgaggatgggtctatgagcattaagaatgaagaggaggaacagactctgacaatcctaattagaaccggactgcttgtgatctccggcctctttcccgtgtcaatacctatcactgccgcagcctggtacctgtgggaggtcaaaaagcaaagggctggtgtgttgtgggacgttccaagtccccctccggtagggaaagcagaattagaggatggagcctatcgtattaagcagaagggcatcctgggctacagccagattggggcgggagtgtacaaagaaggtacattccacaccatgtggcatgtcacgcgcggcgctgtgctcatgcacaaggggaaacggatcgagccatcttgggccgacgttaagaaagatctgatatcctatggaggcggttggaaacttgagggggaatggaaggagggagaagaggtgcaggtcctggcattggaacccggcaaaaaccctagagccgtgcaaactaagccaggcctatttaaaaccaacacagggaccattggagctgtatcactggacttcagtcccggtacaagcggctcccctatcgtcgataagaaagggaaggtggttggactctacggcaatggtgtggtcactaggtctgggacctatgtgtcggccatcgcacagacggaaaagagcattgaggacaacccggaaatcgaggatgacatatttagaaagaagcggctgacaattatggatcttcatcccggagctggcaaaactaagcgctacttaccagccatcgttagagaagcgattaaaaggggcctgcggaccctcatcttggcccctacacgagtggtcgcagctgagatggaagaggccctgagagggctccccatacgctatcagaccccagctattaaggcagagcacactggaagggaaatcgtggacctgatgtgtcatgccaccttcacaatgcgtcttctgtcacctatccgggtacccaattacaacttgattatcatggatgaggcccacttcacggacccagcttccattgcggcaagaggttatataagtactagggtggaaatgggcgaggccgctgggatctttatgaccgccacaccgcctggatctcgcgaccccttcccacagagcaatgcacccattatggatgaggaacgagagatccctgaaagatcctggaactcaggccacgagtgggttaccgactttaagggtaaaactgtctggttcgtgccatctatcaaggccgggaatgatattgctgcgtgcctacggaaaaacggaaagaaagtgatacaactgagcaggaagacatttgacttcgaatacatcaagacccgcacgaatgattgggactttgtcgtaactacagatattagtgagatgggcgccaacttcaaagcagagcgtgtgatcgaccccagacggtgtatgaagcctgttattctcaccgatggcgaagagagggtgatcttagctgggccgatgccagtcacccattccagcgccgcacagcgccgaggaagagtgggtcggaatcccaaaaacgaaaatgaccagtacatatatatgggcgagcctctggaaaacgatgaggactgcgcccactggaaggaggctaaaatgcttctggacaatatcaacactcccgaagggattatcccatctatgtttgagcctgaaagggagaaggttgatgccattgacggagaataccgcctcagaggcgaggcgaggaaaacattcgtggatttgatgcggcgtggtgacctgcccgtctggctcgcatatcgcgtggccgctgaggggatcaactacgccgatcgaagatggtgttttgacggcgtaaagaataaccaaatactggaagagaatgtggaagttgagatttggaccaaggagggagaaaggaagaaacttaaaccacggtggctagatgctcgcatctattcagaccctctggcattgaaagagttcaaagagttcgccgctggcagaaagtccttaacactgaacctcattactgagatggggaggctgccgacgtttatgacccagaaggcccggaatgcacttgataacctggcggtcctccatacagccgaagctggaggtcgagcctacaatcacgcattgagtgagctgcccgagactctagaaaccctgctccttctgacattattggctaccgtgactggcgggatcttcctgtttctcatgagcggaaaaggcataggtaagatgacgctggggatgtgctgcatcattaccgcctcgatccttctgtggtatgcacagattcagccacactggatcgccgcttctataattctcgagttctttttgatcgtgctgttaatccctgaacccgagaaacaaagaacaccacaggacaaccagctaacttacgtcgttattgcgatcctgaccgtggtagccgcaacaatggctaatgaaatgggcttcctcgagaagaccaaaaaggattttggacttggctccataactacacagcaacctgagagcaacattctggacatcgatttgcgccccgcctcagcctggacgctgtacgcagtggctaccactttcattacaccgatgctcaggcatagtatcgaaaattcttccgtcaacgtgagcctgaccgccatagcgaatcaggctaccgttcttatggggctcggaaagggttggccactgtcaaaaatggacatcggcgtgcctttgctggccattgggtgttatagtcaggtcaaccccatcacattaactgcagccctactgctccttgtagctcactacgcaattatcggaccaggcctgcaggccaaggcgacgcgggaggctcaaaaacgtgccgcagccggtattatgaagaatcccaccgtggacgggatcacagttatagatttggaccctattccgtatgatcccaaatttgaaaagcagctgggccaggtgatgctcctggtcctttgcgtgactcaggtcttaatgatgagaaccacatgggctctgtgtgaggccctcaccttggcaactggaccaatcagcacgctgtgggaaggcaaccctgggaggttctggaatacaaccatcgctgtgtccatggccaacatttttcgcggatcttacctagcgggcgccggtctactcttcagcataatgaagaacactgcaaatacccggcgagggacaggaaacactggcgagacccttggtgagaaatggaagaatagactgaacgctttgggcaaatccgaatttcaaatctataagaaatcagggattcaggaggttgacaggacactggccaaggaaggaatcaaacgcggcgagacggatcatcacgcagtgtctcgggggagtgctaagctcagatggttcgtagagcgtaatctggtgacccccgaaggaaaggtcgttgacttaggctgcggtagaggcgggtggtcgtactattgtgggggtcttaaaaacgtgaaggaggtcaaaggcctgactaaagggggacctggccatgaagaaccaattcccatgagcacatacgggtggaatctcgtgcggctacagtccggagtagatgtgttctttacccctccagaaaaatgcgacactctgttgtgtgatatcggcgagtcttcacccaacccgacagttgaggccggtcgcaccctgcgagtgctcaatcttgtcgaaaactggctgaataacaatacgcaattctgcataaaggtgttgaacccttacatgccaagcgtcatcgagaagatggaagccctgcagagaaaatatgggggagcgctcgtgaggaatcccttatcccggaacagtacccacgagatgtactgggtttctaacgctagcggcaatattgtatcatccgtgaacatgatcagtcgcatgctgattaatagatttacaatgaggcacaagaaagcaacttatgaacctgacgtcgatcttggcagcgggacccgaaacatcggaatagagtctgagattccaaatctggacatcatcggtaagcggattgagaagataaagcaggagcatgaaacatcctggcactacgatcaggaccatccctatcgtacttgggcctaccacggctcatatgagaccaagcaaacagggagcgcttcgtctatggtgaacggagttgtgagactactcaccaaaccgtgggacgtcatccctatggtgactcagatggccatgacggatacaacccccttcggccagcagcgcgtatttaaggaaaaagtggacactaggacccaagagccaaaggagggtaccaagaagctgatgaagattacggcagaatggttgtggaaagagctggggaagaaaaagacccctcggatgtgtactagagaagagttcacacgcaaagttaggagtaatgccgctctcggagcgatctttaccgatgagaacaagtggaaatccgcccgagaagcagtcgaggacagcggcttctgggaacttgtggataaggagcggaatctgcacttagaaggcaagtgcgagacttgtgtgtacaacatgatggggaaaagagagaagaaactgggagaatttggtaaggctaaaggctcaagggccatttggtacatgtggttgggggcacgcttcctcgagtttgaagccctgggattcctaaatgaggaccattggttttcccgtgaaaactctcttagcggcgtcgagggtgaggggctgcacaagctcggatatatcctgcgggatgttagtaagaaagaaggcggcgctatgtacgccgacgatacagcggggtgggacaccagaataacattggaggatctgaagaatgaagagatggtgactaaccatatggaaggagagcacaaaaagctcgcagaggccatcttcaaacttacctatcagaataaggtagtgagggtccagcgccccacgccacgaggtaccgtgatggacattatctcccggagagaccagaggggcagcgggcaagttgtgacatacggactgaacactttcaccaacatggaagctcagttaattcgccagatggagggcgaaggtgtctttaagtctatccaacagctgacagtgactgaggagattgccgtcaaaaattggttggttagagtggggcgggaaaggctctcacgtatggcaataagtggagatgactgcgtcgtgaagcccctggatgaccgattcgcttccgccctaaccgctcttaacgatatgggcaaagtgcgcaaggacatccagcagtgggagcctagcagaggctggaatgattggacgcaagtcccattttgctctcatcacttccacgaactgattatgaaagacgggcgggttctcgtggtaccgtgtaggaaccaggatgagctgatcggacgcgccagaatctcgcagggtgcaggctggtcattgcgggaaacagcgtgcttaggaaagagctatgcccagatgtggtccctgatgtactttcataggcgagacctccgtcttgctgccaatgcaatttgtagtgctgtgccctctcactgggtccctaccagcagaactacatggtccatacatgccacccacgagtggatgactaccgaggatatgctgacagtgtggaaccgcgtttggatccaagaaaatccatggatggaggacaagacgcccgtggaatcatgggaggaaattccttatctaggaaaacgggaggatcagtggtgcggcagtctgatcggtctcacctctagggcaacttgggccaagaacattcagacagcgatcaatcaggtccgcagcttgatagggaacgaggaatacaccgactacatgccatccatgaaacgattccggagggaggaagaggaagctggagtgctgtggtga

SEQ ID NO: 14948 - RNA, 9876 nt, synthetic construct
  misc_feature 1..9876: note = derived and/or modified CDS sequence (opt3) from DENV-2__KC762663__SS-prME
  source 1..9876: mol_type = other RNA
accgccggaatcattataatgatgatccccaccgtgatggctttccacctgactacgagaaacggggaacctcatatgattgtcagcaggcaggaaaagggaaaatccctcctttttaagaccgaaaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtgacaccatctatgaccatgagatgcatcggcatatcgaacagggactttgtcgaaggggtgtcaggaggtagctgggtagatattgttctggagcacggcagttgtgtgactacaatggccaaaaataagcccaccctcgacttcgaattaatcaagacggaggctaaacaccctgccaccctgcggaagtactgcattgaagcgaaacttacaaacactaccacagcatcccgctgtccaactcagggggagccctctttgaatgaggaacaagataagcgatttgtctgcaaacatagcatggtggacagaggatggggcaacggttgtgggctgttcggaaagggcggcatcgtgacctgcgccatgtttacatgcaagaaaaatatggaggggaagatcgtccagcctgaaaacctagagtataccattgttataactccacactccggagaagagaatgctgtgggtaacgatacgggcaaacatgggaaggagatcaaagtaacaccgcagtcaagtattaccgaagccgagctcactggatacggcaccgtgacaatggaatgtagccccaggaccggtctggacttcaatgagatggtccttctgcagatggaaaacaaggcatggttggtgcaccggcaatggtttctcgatctgcctttaccatggctgcccggggctgacactcagggctctaactggatccagaaagagacactcgttacgttcaagaatcctcacgccaagaaacaggatgtggtcgtgcttggatcccaagagggcgcgatgcataccgccctgactggggcaacagaaatacagatgtcaagcggaaacttgctatttaccggtcacctgaagtgccgtctccgcatggacaaactgcagcttaagggcatgagttattctatgtgtacagggaaattcaaggtagttaaggagattgctgaaactcaacatggaaccatcgtgatcagagtccagtacgagggcgacggttccccatgcaaaattcccttcgagatcacggatctggaaaagaggcacgtgttggggcggctcattaccgtcaatccgatagtgacagagaaagacagccctgttaacatcgaagccgagcccccatttggcgattcgtacattatcatcggagtggaacctggccagctgaagttatcttggttcaaaaaggggtcctcaattggacagatgtttgagactaccatgcgaggtgctaagcgcatggccatactgggcgacacagcatgggatttcgggagtctaggaggcgtatttactagcatcggtaaagccctccatcaagtcttcggggctatttatggcgcggcattttccggagtgtcttggaccatgaagatcctgattggcgttgtgatcacgtggatagggatgaatagcagatcaacaagtctttccgtcagcttggtgctggtaggagtggttaccctctacctgggcgtcatggtgcaggccgactctggttgtgtggtctcatggaaaaacaaggagcttaaatgcgggagtggaatcttcattactgataatgttcacacatggaccgaacagtataagtttcagcccgagagcccatccaagctggcttctgccatccaaaaagcacacgaagagggcatttgtggtatcaggtcggtgactcggttggaaaacctcatgtggaagcagataacccccgagctgaatcatattttaagcgagaacgaagtgaaactgacaatcatgacgggcgacattaaggggatcatgcaggccggaaaacgctccctaagacctcagccaaccgagctcaagtactcatggaaaacttggggcaaggctaagatgctgagtacagaacttcacaatcataccttcttgatagatgggccggagacagccgaatgccccaacgcaaatagggcgtggaactctctggaggtagaggactatggatttggcgtcttcactaccaatatctggctcaaactgaaggaacgtcaagatgctttttgtgacagcaaattaatgtccgccgcaattaaggacaaccgggccgtgcacgctgatatgggttactggatcgagtcagccctgaacgacacgtggaaaattgaaaaggccagcttcatcgaggttaagtcttgccactggcctaaatcccatacactttggagtaatggggtgttggagagcgaaatgataattccaaagaacttcgctggacccgtctctcagcacaattatcgacctggctaccatacccagactgccggtccatggcacctcggcagactggagatggattttgacttctgtgaagggaccacagtggttgtgactgaggattgcggaaacaggggcccctccctacgcaccacaacggcgtcagggaaactgatcaccgaatggtgctgtcggagttgcactctcccgcctctgagatacaggggagaggacggctgttggtatggtatggagatccgcccacttaaggaaaaagaggaaaatttggtaaacagcctggtcacagccgggcatggacagattgataatttttcgttaggcgtgctcggtatggctctgttccttgaggaaatgctgcgaacccgggtgggcactaagcacgcaatcttgctcgtcgccgtttcctttgtgacactgattaccgggaacatgtctttccgtgacctaggaagagtaatggtgatggtcggcgctacgatgactgatgacatagggatgggagtgacctacctggccctcctggcagcgtttaaggttaggcccacattcgccgctggccttttgctgcgcaaattaaccagcaaggagctcatgatgactacaatcggtattaccctgctttcacaaagtacaatccctgagactattctggaactaaccgatgccctcgcactggggatgatggtgttgaaaatcgtccggaatatggagaagtatcagctggctgtgacgataatggccatcttatgcgttcccaacgcagtgattctccagaatgcctggaaagtctcctgtacaaccctggctgtagtgtctgttagcccacttctgttgacttcctcacaacagaaggcggactggatccctctcgccctgaccattaagggactaaaccccacagcaatctttctgactacccttagcagaacgagtaaaaagaggtcttggccactcaatgaagctataatggccgtgggcatggtctccattctggccagctcgttgctgaaaaacgatatcccgatgacaggccctttagtggctgggggactcctgaccgtatgctacgtgcttactggtcgatcagcagacctggagttggaacgcgccgcggacgtccggtgggaggagcaggctgaaatctctggcagttcccccattctcagcataacaatctctgaggatgggagcatgtccattaagaatgaagaggaggaacagaccctgactatcctaattagaacaggactgcttgttatctcaggcctcttcccagtgagtatacccatcaccgccgcagcctggtatctgtgggaggtgaaaaagcaaagggctggtgtcttgtgggacgtgcctagcccaccccctgttgaaaaagcagagttagaagatggggcctaccgtattaagcagaagggaatcctgggctattctcagattggcgcgggggtatacaaagagggaacgtttcacactatgtggcatgtgacccgcggtgctgtcctcatgcacaagggcaaacggatcgagccgtcctgggccgacgtgaagaaagatctgatatcatacgggggaggctggaaacttgaaggtgagtggaaggaaggggaggaagttcaggtgctggcattggagccaggcaagaaccccagagccgtccaaacaaagcctggcctattcaaaaccagtacaggcactattggggctgtgagcctggacttttccccaggaacctctggttcgcccatcgtagataagaaaggcaaggtcgtggggctctatggaaacggcgttgtgacgaggagcggtacatacgtctcagccatcgcacagactgagaagtccattgaagacaatcctgagatcgaagatgacatattcaggaagaaacggctgaccattatggatcttcatccgggggctggaaaaacaaaacgctatttacccgccatcgtgagagaggcgattaaaaggggcctgcggaccctcatcttggccccaactcgagttgtggcagctgaaatggaggaggccctgagaggcctccctatacgctaccagacccccgctattagggcagaacacacagggcgtgagatcgtcgacctgatgtgtcatgccacgttcactatgcggcttctgagtccaatcagagtgcctaactataatttgattatcatggatgaagcccactttaccgaccccgcttctattgcggcaaggggatacataagcacacgcgtagagatgggtgaggccgctggcatcttcatgaccgccactccaccggggtcccgagacccttttccccagtcaaacgcaccaattatggatgaagagagagaaatccccgagcggtcttggaatagcggacacgaatgggtgacagacttcaagggcaagaccgtttggtttgtccctagtatcaaagccggtaacgatattgctgcgtgcctaaggaagaatgggaaaaaggtgatacaactgtcccgcaaaacgttcgactttgagtatatcaagactcgtacaaacgattgggacttcgtggtcaccaccgatattagcgagatgggagccaattttaaggcagaaagagtaatcgacccacggaggtgtatgaaacccgtgattctcactgatggcgaggaacgcgttatcttagctggccctatgccggtgacacattcttcagccgcacagcgaagagggcgggtcggaaggaacccaaagaatgagaacgaccagtacatatacatgggtgaacccctggagaatgatgaggactgcgcccactggaaagaagctaagatgcttctggacaacatcaatacccctgagggcattatcccctccatgttcgaaccagagcgcgaaaaagtggatgccattgacggggagtatagactcaggggagaggcgcggaagacatttgttgatttgatgcgtcgcggcgacctgcctgtgtggctcgcataccgagtcgccgctgaaggtatcaactatgccgatagaaggtggtgtttcgacggggtgaaaaacaatcaaatactggaggaaaacgtagaggtggagatttggactaaggaaggcgagcggaagaaacttaagccccgctggctagatgctagaatctacagtgacccactggcattgaaagagttcaaggagtttgccgctggaagaaagagcttaacgctgaatctcattaccgaaatgggccggctgcctacattcatgactcagaaggcccgaaacgcacttgataatctggcggttctccataccgccgaggctgggggacgagcatataaccacgcattgtcggagctgccggaaacactagagaccctgctccttctgactttattggctacggtcaccggtggcatctttctgttcctcatgtctgggaagggaataggcaaaatgacactgggtatgtgctgcatcattactgcctccatccttctgtggtacgcacagattcagccccactggatcgccgctagcataattctcgaatttttcttgatcgtgctgttaatcccagagcctgaaaagcaacgcacaccccaggacaatcagctaacatatgtggtcattgcgatcctgaccgttgtggccgcaactatggctaacgagatggggtttctcgagaaaacaaagaaagatttcggccttggatcaataacgacccagcaaccagaaagtaatattctggacatcgatttgaggcctgcctctgcctggactctgtacgcagtagctacaacctttattacccccatgctccggcattccatcgagaacagctcagtgaatgtcagtctgacagccatagcgaaccaggctactgtgcttatgggcctcgggaagggatggccgctgagcaagatggacatcggtgttccattgctggccattggctgttactcccaggtgaatcctatcacgttaaccgcagccctactgctccttgtcgctcactatgcaattatcgggcccggactgcaggccaaagcgacacgtgaagctcaaaagagagccgcagccggcattatgaaaaacccaactgtagacggtatcaccgtgatagatttggaccccattccttacgatccgaagttcgagaaacagctggggcaggttatgctcctggtgctttgcgtcacacaggtgttaatgatgaggaccacttgggctctgtgtgaagccctcacgttggcaacaggccccatctctaccctgtgggagggaaatccaggccgcttttggaacactaccatcgctgtcagcatggccaatattttccgggggtcctatctagcgggagccggcctgctcttttcaataatgaagaacacagcaaacactcgaagaggtaccgggaatacaggagagacgcttggcgaaaagtggaaaaacaggctgaatgctttgggtaagtctgagttccaaatctacaaaaagagtggcattcaggaagtggaccgcaccctggccaaagaggggatcaagcggggagagactgatcatcacgcagtttcgagaggcagcgctaaactccgttggttcgtggaaaggaacctggtaacacctgaggggaaggtggtcgacttaggatgcggccggggtgggtggtcctattactgtggaggccttaagaatgttaaagaagtgaagggtctgaccaaaggcgggcccggacatgaggaacctattccaatgtctacttatggctggaacctcgtccgcctacagtcaggggtggatgtatttttcacaccccctgagaagtgcgacaccctgttgtgtgatatcggagagagctccccaaatcccacggtggaagccggccgaaccctgagagttctcaaccttgtggagaattggctgaacaataacacacaattttgcataaaagtcttgaatccgtacatgcctagtgtgatcgaaaagatggaggccctgcagaggaagtacggtggggcgctcgtccggaacccattatctcgcaatagcactcacgaaatgtattgggtgtcaaacgcttccggaaacattgttagtagcgtaaatatgatctctagaatgctgattaacaggttcaccatgcgacacaaaaaggcaacatacgagcccgacgtggatcttggctccggcactcggaatatcgggatagagtcagaaacccctaacctggacattatcggaaaacgtatcgagaagattaaacaggaacatgagacaagctggcactatgatcaggaccatccatacaagacctgggcctatcacggttcgtacgaaactaagcaaacgggctctgctagttccatggtcaatggggtggttagactactcacaaaaccctgggacgtgataccgatggtcacccagatggccatgactgataccacaccttttggacagcagcgcgtgttcaaggagaaagtagacacgaggacccaagagcccaaggaaggcactaaaaagctgatgaagatcacagcagagtggttgtggaaagaactgggtaagaaaaagaccccacggatgtgtactagagaggagtttacacgcaaagtgaggagcaacgccgctctcggggcgattttcaccgatgaaaataagtggaaatcagcccgagaggcagttgaagactccggattttgggagcttgtcgataaggaacggaacctgcacttagagggcaagtgcgagacatgtgtgtataatatgatgggcaaaagagaaaagaaactgggggagttcggaaaggctaaaggttctagggccatctggtacatgtggttgggcgcacgctttctcgagttcgaggccctggggtttctaaacgaagaccattggttcagccgtgagaatagtctttccggagtggagggcgaaggtctgcacaagctcgggtacattctgcgggatgtcagcaagaaagagggaggcgctatgtatgccgacgatactgcgggctgggacaccagaatcacgttggaagatctgaagaacgaggaaatggttaccaatcatatggagggggagcacaaaaagctcgcagaagccatattcaaacttacataccagaacaaggtggtaagggtgcagcgccctactccccgaggaaccgtcatggacatcatttctcggagagaccagaggggttcaggccaagtggttacatatgggctgaatacttttaccaacatggaggctcagttaatccgccagatggaaggagagggcgtgttcaagagtattcaacagctgacggtcacagaggaaatcgccgtgaaaaactggttggtaaccgttggtagagagcggctctccaggatggcaattagcggggatgactgcgtggtcaagccactggatgaccgttttgcttctgccctaactgctcttaatgatatgggaaaagtgcgaaaggacatacagcagtgggaaccctcgcgcggctggaacgattggacacaagtgcctttctgctcacatcactttcacgagctgatcatgaaagacggcagagtcctcgttgtgccatgtcggaatcaggatgaactgattgggagggcccgcatcagccagggagcaggttggtccttgagagagaccgcgtgcttaggcaagagttacgcccagatgtggtctctgatgtatttccatcggagggacctccgacttgctgccaacgcaatctgtagcgctgtaccgtcccactgggtgcccacttcacgtaccacatggagtattcatgccacgcacgagtggatgaccactgaagatatgctgacagtctggaatagagtgtggatacaagagaacccttggatggaagacaagaccccagttgagtcttgggaagagatcccctacctagggaaacgcgaggatcagtggtgcggaagcctgattggcctcacttcccgggcaacatgggccaagaatatccagaccgcgattaaccaggtgaggtcattgatcggtaatgaagagtatacggactacatgcctagcatgaaaagatttcgccgggaagaggaagaggctggggtcctgtggtga

SEQ ID NO: 14949 - RNA, 9876 nt, synthetic construct
  misc_feature 1..9876: note = derived and/or modified CDS sequence (opt3) from DENV-2__KC762675__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgcactttcagcgcgttttgatcttcattctcctgactgcagtggccccatctatgacaatgagatgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaacatcctgcgacgctgcggaagtattgcattgaagcaaaacttaccaacacaactaccgcctcccgctgtccaacacagggggagccctctttgaatgaggaacaagataagcgatttgtctgcaaacacagcatggtggacagaggatggggcaacggttgtgggctgttcggaaagggcggcatcgtgacttgcgctatgtttacctgcaagaaaaatatggaggggaagatcgtccagcctgaaaacctagagtacacaattgttataaccccacattccggagaagagaatgccgtgggtaacgatactggcaaacacgggaaggagatcaaagtaacgccgcagtcaagtattacagaagcagagctcaccggatatggcactgtgaccatggaatgtagccccaggacaggtctggacttcaatgagatggtccttctgcagatggaaaacaaggcttggttggtgcaccggcaatggtttctcgatctgcctttaccatggctgcccggggccgacacccagggctctaactggatccagaaagagactctcgttacattcaagaatcctcatgcgaagaaacaggatgtggtcgtgcttggatcccaagagggcgccatgcacacggcactgaccggggctactgaaatacagatgtcaagcggaaacttgctatttacaggtcatctgaagtgccgtctccgcatggacaaactgcagcttaagggcatgagttactctatgtgtaccgggaaattcaaggtagttaaggagattgccgaaacacaacacggaactatcgtgatcagagtccagtatgagggcgacggttccccatgcaaaattcccttcgagatcatggatctggaaaagaggcatgtgttggggcggctcattaccgtcaatccgatagtgacggagaaagacagccctgttaacatcgaagctgagcccccatttggcgattcgtacattatcatcggagtggaacctggccagctgaagttatcttggttcaaaaaggggtcctcaattggacagatgtttgagaccacaatgcgaggtgccaagcgcatggcaatactgggcgacactgcctgggatttcgggagtctaggaggcgtatttaccagcatcggtaaagctctccaccaagtcttcggggcgatttacggcgcagccttttccggagtgtcttggacaatgaagatcctgattggcgttgtgatcacttggatagggatgaatagcagatcaaccagtctttccgtcagcttggtgctggtaggagtggttacgctctatctgggcgtcatggtgcaggctgactctggttgtgtggtctcatggaaaaacaaggagcttaaatgcgggagtggaatcttcattacagataatgttcacacctggactgaacagtacaagtttcagcccgagagcccatccaagctggcctctgcaatccaaaaagcccatgaagagggcatttgtggtatcaggtcggtgacacggttggaaaacctcatgtggaagcagataacccccgagctgaatcacattttaagcgagaacgaagtgaaactgactatcatgaccggcgacattaaggggatcatgcaggctggaaaacgctccctaagacctcagccaacagagctcaagtattcatggaaaacgtggggcaaggccaagatgctgagtaccgaacttcataatcacactttcttgatagatgggccggagacagcagaatgccccaacaccaatagggcgtggaactctctggaggtagaggactacggatttggcgtcttcacaactaatatctggctcaaactgaaggaacgtcaagatgtgtattgtgacagcaaattaatgtccgctgccattaaggacaaccgggcagttcacgccgatatgggttactggatcgagtcagctctgaacgacacctggaaaattgaaaaggccagctttatcgaggtgaagtcttgctattggcctaaatcccatacgctttggagtaatggggtcttggagagcgaaatgataattccaaagaacttcgcaggacccgtgtctcagcacaattaccgacctggctaccatacacagaccgctggtccatggcacctcggcagactggagatggatttcgacttttgtgaagggactaccgttgtggtaacagaggattgcggaaacaggggcccctccctacgcactaccacagcctcagggaaactgatcacggaatggtgctgtcggagttgcaccctcccgcctctgagatataggggagaggacggctgttggtacggtatggagatccgcccacttaaggaaaaagaggaaaatttggtcaacagcctggtgactgcggggcatggacagattgataatttctcgttaggcgtgctcggtatggccctgtttcttgaggaaatgctgcgaacacgggtcggcaccaagcacgctatcttgctcgttgcagtgtccttcgtaactctgattacagggaacatgtcttttcgtgacctaggaagagtgatggtcatggtgggcgccaccatgacggatgacatagggatgggagttacttatctggctctcctggccgcattcaaggtgaggcccacctttgcggccggccttttgctgcgcaaattaacaagcaaggagctcatgatgaccactatcggtattgtcctgctttcacaaagtacaatccctgagaccattctggaactaacagatgctctcgccctggggatgatggcattgaaaatcgtgcggaatatggagaagtaccagctggctgttactataatggccatcttatgcgtgcccaacgcagtcattctccagaatgcctggaaagtatcctgtaccacgctggctgtggtttctgtgagcccacttctgttgacatcctcacaacagaaggcggactggatccctctcgccctgaccattaagggactaaaccccactgcaatcttcctgaccacacttagcagaactagtaaaaagaggtcttggccactcaatgaagctataatggccgtcggcatggtgtccattctggccagctcgttgctgaaaaacgatatcccgatgaccggccctttagtagctgggggactcctgacggtgtgctatgtccttacaggtcgatcagcagacctggagttggaacgcgccgcggacgttcggtgggaggagcaggctgaaatctctggcagttcccccattctcagcataaccatctctgaggatgggagcatgtccattaagaatgaagaggaggaacagactctgacaatcctaattagaaccggactgcttgtgatctcaggcctctttccagtgagtatacccatcactgccgcagcctggtacctgtgggaggtcaaaaagcaaagggctggtgtgttgtgggacgttcctagcccaccccctgtagggaaagcagaattagaggatggagcctatcgtattaagcagaagggcatcctgggctactctcagattggggcgggagtgtacaaagaaggtacattccacaccatgtggcatgtcacgcgcggcgctgtgctcatgcacaaggggaaacggatcgagccgtcctgggccgacgttaagaaagatctgatatcatatggaggcggttggaagcttgagggggaatggaaggagggagaagaggtgcaggtcctggcattggaaccaggcaaaaaccccagagccgtgcaaactaagcctggcctatttaaaaccaacacagggaccattggagctgtaagtctggacttcagcccaggtacatccggctctcccatcgtcgataagaaagggaaggtggttggactctacggcaatggtgtggtcactaggtcggggacctatgtgagcgccatcgcacagacggagaagtcaattgaggacaaccctgaaatcgaggatgacatatttcgaaaaaagcggctgacaattatggatcttcatccgggagctggcaaaactaagcgctacttacccgccatcgttagagaagcgattaaaaggggcctgcggaccctcatcttggccccaacacgagtggtcgcagctgagatggaagaggccctgagagggctccctatacgctatcagacccccgctattagggcagagcacactggacgtgaaatcgtggacctgatgtgtcatgccaccttcacaatgcggcttctgtccccaatcagagtacctaattacaacttgattatcatggatgaggcccacttcacggaccccgctagtattgcggcaaggggttatatatctactcgcgtggaaatgggcgaggccgctgggatctttatgaccgccacaccaccgggaagccgagaccctttcccccagtccaatgcaccaattatggatgaggaaagagagatccccgaacggtcatggaactctggccacgagtgggttaccgactttaagggtaagactgtctggttcgtgcctagcatcaaagccgggaatgatattgctgcgtgcctaaggaagaacggaaaaaaggtgatacaactgagtcgcaaaacatttgacttcgaatacatcaagacccgtacgaatgattgggactttgtcgtaactacagatatttccgagatgggcgccaacttcaaggcagagagagtgatcgacccacggaggtgtatgaaacccgttattctcaccgatggcgaagagcgcgtgatcttagctgggcctatgccggtcacccatagctctgccgcacagcgaagaggacgggtgggtaggaatccaaagaacgaaaatgaccagtacatatatatgggcgagcccctggaaaacgatgaggactgcgcccactggaaagaggctaagatgcttctggacaatatcaacactcctgaagggattatcccctcaatgtttgagccagaacgcgagaaagttgatgccattgacggagaatacagactcaggggcgaggcgcggaagacattcgtggatttgatgcgtcgcggtgacctgcctgtctggctcgcatatcgagtggccgctgaggggatcaactacgccgatagaaggtggtgttttgacggcgtaaaaaataaccaaatactggaagagaatgtggaagttgagatttggaccaaggagggagaacggaagaaacttaagccccgctggctagatgctagaatctattccgacccactggcattgaaagagttcaaggaattcgccgctggcaggaaaagtttaacactgaacctcattactgagatggggcggctgcctacgtttatgacccagaaggcccgaaatgcacttgataacctggcggtcctccatacagccgaagctggaggtagagcctacaatcacgcattgagcgagctgccggagactctagaaaccctgctccttctgacattattggctaccgtgactggcgggatcttcctgtttctcatgtcgggaaagggcataggtaaaatgacgctggggatgtgctgcatcattaccgcctctatccttctgtggtatgcacagattcagccccactggatcgccgcttccataattctcgagttctttttgatcgtgctgttaatcccagaacctgagaagcaacgcacaccccaggacaaccagctaacttacgtcgttattgcgatcctgaccgtggtagccgcaacaatggctaatgaaatgggcttcctcgagaaaaccaagaaagattttggacttggcagcataactacacagcaaccagagtcaaacattctggacatcgatttgaggcctgccagtgcctggacgctgtacgcagtggctaccactttcattacacccatgctccggcattctatcgaaaattccagcgtcaacgtgtcactgaccgccatagcgaatcaggctaccgttcttatggggctcggaaagggttggccgctgagtaagatggacatcggcgtgccattgctggccattgggtgttatagccaggtcaaccctatcacattaactgcagccctactgctccttgtagctcactacgcaattatcggacccggcctgcaggccaaagcgacgcgtgaggctcaaaagagagccgcagccggtattatgaaaaatccaaccgtggacgggatcacagttatagatttggaccccattccttatgatccgaagtttgaaaaacagctgggccaggtgatgctcctggtcctttgcgtgactcaggtcttaatgatgaggaccacatgggctctgtgtgaggccctcaccttggcaactggacccatctccacgctgtgggaaggcaacccagggcgcttctggaatacaaccatcgctgtgtctatggccaacatttttcggggaagctacctagcgggcgccggtctgctcttctccataatgaagaacactgcaaatacccgaagagggacaggaaacactggcgagacccttggtgagaagtggaaaaataggctgaacgctttgggcaagtcagaatttcaaatctataaaaagtctgggattcaggaggttgaccgcacactggccaaagaaggaatcaagcggggcgagacggatcatcacgcagtgagtagagggtcggctaaactccgttggttcgtagagaggaatctggtgacccctgaaggaaaggtcgttgacttaggctgcggtcgggggggatggagctactattgtggcggtcttaagaacgtgaaagaggtcaagggcctgactaaagggggacccggccatgaagagcctattccaatgtccacatacgggtggaatctcgtgcgcctacagtctggagtagatgtgttctttaccccccctgaaaagtgcgacactctgttgtgtgatatcggcgagtcaagcccaaaccccacagttgaggccggtcgaaccctgagagtgctcaatcttgtcgaaaactggctgaataacaatacgcaattctgcataaaagtgttgaacccgtacatgccttccgtcatcgagaagatggaagccctgcagaggaagtatgggggagcgctcgtgcggaatccattaagtcgcaactctacccacgagatgtactgggttagcaacgcttcaggcaatattgtatccagtgtgaacatgatcagcagaatgctgattaataggtttacaatgcgacacaaaaaggcaacttatgaacccgacgtcgatcttggctctgggacccggaacatcggaatagagtccgagattcctaatctggacatcatcggtaaacgtattgaaaagatacagcaggagcatgaaacatcatggcactacgatcaagaccatccatatagaacttgggcctaccacggcagctatgagaccaaacagacagggtcggcttctagtatggtgaacggagttgtgcgcctactcaccaagccctgggacgtcatcccgatggtgactcagatggccatgacggatacaacccctttcggccagcaaagggtatttaaggaaaaagtggacactcggacccaggagcccaaggagggtacaaaaaagctgatgaaaattacggcagaatggttgtggaaggagctggggaagaaaaagaccccaagaatgtgtactcgcgaagagttcacaaggaaagttcgatccaatgccgctctcggagcgatctttaccgatgagaacaagtggaaaagcgcccgggaagcagtcgaggactcaggcttctgggaacttgtggataaggagagaaatctgcacttagaaggcaaatgcgagacttgtgtgtacaacatgatggggaagagggagaagaaactgggagaatttggtaaggctaaaggctcccgcgccatttggtacatgtggttgggggcacgtttcctcgagtttgaagccctgggattcctaaatgaggaccattggttttctcgggaaaacagccttagtggcgtcgagggtgaggggctgcacaagctcggatatatcctgagagatgtttccaaaaaggaaggcggcgctatgtacgccgacgatacagcggggtgggacaccaggataacattggaggatctgaagaaagaagagatggtgactaatcatatggaaggagagcacaagaaactcgcagaggccatcttcaagcttacctatcagaacaaagtagtgcgcgtccagcgacctacgccccggggtaccgtgatggacattatcagcagaagggaccaacgcggctctgggcaggttgtgacatacggactgaatactttcaccaacatggaagctcagttaattagacaaatggagggcgaaggtgtctttaagtcaatccagcagctgacagtgactgaggagattgccgtaaagaactggttggttcgggtggggagggaacgtctcagtcgaatggcaatatccggagatgactgcgtcgtgaaaccactggatgaccgcttcgctagcgccctaaccgctcttaatgatatgggcaaggtgagaaaagacatccagcaatgggagccctctcggggctggaacgattggacgcaggtccctttttgctcgcatcacttccacgaactgattatgaaggacgggagggttctcgtggtaccatgtcgcaatcaggatgagctgatcggaagagcccggatctcacagggtgcaggctggagcttgagggaaacagcgtgcttagggaaatcctatgcccaaatgtggagtctgatgtactttcatcgacgtgacctcagacttgctgccaacgcaatttgttctgctgtgccgagccactgggtccccacctcccgcactacatggtcaatacatgccacccacgagtggatgactaccgaggatatgctgacagtgtggaatcgggtttggatccaggaaaacccttggatggaggacaagacgccagtggaaagttgggaggaaattccctatctaggaaagagggaggatcagtggtgcggctctctgatcggtctcaccagcagagcaacttgggccaaaaatattcagacagcgatcaaccaagtccgctccttgatagggaatgaggaatacaccgactacatgccttcaatgaagcggttcaggcgagaggaagaggaagctggagtgctgtggtga

SEQ ID NO: 14950 - RNA, 9876 nt, synthetic construct
  misc_feature 1..9876: note = derived and/or modified CDS sequence (opt3) from DENV-2__KC762671__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtggccccatctatgacaatgagatgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaacaccctgcgacgctgcggaagtactgcattgaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaagatcgtccagcctgaaaacctagagtatacaattgttataaccccacactccggagaagagaatgccgtgggtaacgatactggcaaacatgggaaggagatcaaagtaacgccgcagtcaagtattacagaagcagagctcaccggatacggcactgtgaccatggaatgtagccccaggacaggtctggacttcaatgagatggtccttctgcagatggaaaacaaggcttggttggtgcaccggcaatggtttctcgatctgcctttaccatggctgcccggggccgacacccagggctctaactggatccagaaagagactctcgttacattcaagaatcctcacgcgaagaaacaggatgtggtcgtgcttggatcccaagagggcgccatgcatacggcactgaccggggctactgaaatacagatgtcaagcggaaacttgctatttacaggtcacctgaagtgccgtctccgcatggacaaactgcagcttaagggcatgagttattctatgtgtaccgggaaattcaaggtagttaaggagattgccgaaacacaacatggaactatcgtgatcagagtccagtacgagggcgacggttccccatgcaaaattcccttcgagatcatggatctggaaaagaggcacgtgttggggcggctcattaccgtcaatccgatagtgacggagaaagacagccctgttaacatcgaagctgagcccccatttggcgattcgtacattatcatcggagtggaacctggccagctgaagttatcttggttcaaaaaggggtcctcaattggacagatgtttgagaccacaatgcgaggtgccaagcgcatggcaatactgggcgacactgcctgggatttcgggagtctaggaggcgtatttaccagcatcggtaaagctctccatcaagtcttcggggcgatttatggcgcagccttttccggagtgtcttggacaatgaagatcctgattggcgttgtgatcacttggatagggatgaatagcagatcaaccagtctttccgtcagcttggtgctggtaggagtggttacgctctacctgggcgtcatggtgcaggctgactctggttgtgtggtctcatggaaaaacaaggagcttaaatgcgggagtggaatcttcattacagataatgttcacacctggactgaacagtataagtttcagcccgagagcccatccaagctggcctctgcaatccaaaaagcccacgaagagggcatttgtggtatcaggtcggtgacacggttggaaaacctcatgtggaagcagataacccccgagctgaatcatattttaagcgagaacgaagtgaaactgactatcatgaccggcgacattaaggggatcatgcaggctggaaaacgctccctaagacctcagccaacagagctcaagtactcatggaaagcctggggcaaggcaaagatgctgagtacggaacttcacaatcataccttcttgatagatgggccggagactgcggaatgccccaacacaaatagggcttggaactctctggaggtagaggactatggatttggcgtcttcaccacaaatatctggctcaaactgaaggaacgtcaagatgtgttttgtgacagcaaattaatgtccgccgcaattaaggactcacgggccgttcacgctgatatgggttactggatcgagagcgccctgaacgacacttggaaaattgaaaaggcatctttcatcgaggtgaagtcctgccactggcctaaaagtcataccctttggagcaacggggtcttggagtctgaaatgataattccaaagaatttcgctggacccgtgtcccagcacaactatcgacctggctaccatacgcagacagccggtccatggcacctcggcagactggagatggattttgacttctgtgaagggaccactgttgtggtaaccgaggattgcggaaataggggcccctcactacgcacaactaccgcgagtgggaaactgatcacagaatggtgctgtcggagctgcacgctcccgcctctgagatacaggggagaggacggctgttggtatggtatggagatccgcccacttaaggaaaaagaggaaaacttggtcaattcgctggtgaccgccgggcatggacagattgataacttttccttaggcgtgctcggtatggctctgttccttgaggaaatgctgcgaactcgggtcggcacaaagcacgcaatcttgctcgttgccgtgtcttttgtaaccctgattactgggaatatgagcttccgtgacctaggaagagtgatggtcatggtgggcgctacaatgaccgatgacatagggatgggagttacgtacctggccctcctggcagcgtttaaggtgaggcccactttcgccgctggccttttgctgcgcaaattaacctcaaaggagctcatgatgacaaccatcggtattgtcctgcttagtcaagccactatccctgagacaattctggaactaaccgatgcactcgctctggggatgatggtgttgaaaatcgttcggaacatggagaagtatcagctggccgtgacaataatggcaatcttatgcgtccccaatgccgtaattctccagaacgcttggaaagtgtcctgtactaccctggcggttgtgtctgtcagcccacttctgttgacgtcctcacaacagaaggccgactggatccctctcgcactgacaattaagggactaaatcccaccgctatctttctgactacccttagcagaacaagtaaaaagaggtcttggccactcaacgaagccataatggccgtgggcatggtatccattctggctagctcgttgctgaaaaatgatatcccgatgactggccctttagtggcagggggactcctgaccgtctgctacgttcttacgggtcgatcagccgacctggagttggaacgcgcggctgacgtgcggtgggaggagcaggccgaaatctctggcagttcccccattctcagcataacaatctctgaggatgggagcatgtccattaagaacgaagaggaggaacagaccctgactatcctaattagaacaggactgcttgtgatctcaggcctcttcccagtcagtatacccatcaccgcagccgcttggtatctgtgggaggtgaaaaagcaaagggcaggtgttttgtgggacgtacctagcccaccccctgtggggaaagccgaattagaggatggagcgtaccgtattaagcagaagggcatcctgggctattctcagattggggctggagtctacaaagaaggtacttttcacacaatgtggcatgtgacccgcggcgccgttctcatgcacaaggggaaacggatcgagccgtcctgggcagacgtgaagaaagatctgatatcatacggaggcggttggaagcttgagggggaatggaaggagggagaagaggtccaggtgctggccttggaaccaggcaaaaatcccagagctgtacaaacgaagcctggcctattcaaaactaacaccgggacaattggagccgtcagtctggactttagcccaggtacctccggctctcccatcgtggataagaaagggaaggttgtgggactctatggcaacggtgtcgtgacaaggtcggggacttacgttagcgcaatcgctcagaccgagaagtcaattgaggacaatcctgaaatcgaggatgacatattccgaaaaaagcggctgacgattatggatcttcatccgggagccggcaaaacaaagcgctatttacccgcgatcgtgagagaagccattaaaaggggcctgcggactctcatcttggcaccaacccgagtcgtggctgccgagatggaagaggctctgagagggctccctatacgctaccagacacccgcaattagggccgagcacaccggacgtgaaatcgtagacctgatgtgtcatgccactttcaccatgcggcttctgtccccaatcagagtgcctaactataatttgattatcatggatgaggctcactttacagaccccgcgagtattgcagccaggggttacatatctacgcgcgttgaaatgggcgaggctgccgggatcttcatgactgcaaccccaccgggaagccgagacccttttccccagtccaacgccccaattatggatgaggaaagagagatccccgaacggtcatggaattctggccacgagtgggtcacagacttcaagggtaagaccgtgtggtttgtgcctagcatcaaagctgggaacgatattgcggcctgcctaaggaagaatggaaaaaaggtcatacaactgagtcgcaaaactttcgactttgaatatatcaagacacgtaccaacgattgggacttcgtagtgacgactgatatttccgagatgggcgcaaattttaaggctgagagagttatcgacccacggaggtgtatgaaacccgtgattctcacagatggcgaagagcgcgtcatcttagccgggcctatgccggtgacccatagctctgcagcccagcgaagaggacgggttggtaggaacccaaagaatgaaaacgaccagtacatatacatgggcgagcccctggaaaatgatgaggactgcgctcactggaaagaggccaagatgcttctggacaacatcaatacccctgaagggattatcccctcaatgttcgagccagaacgcgagaaagtggatgcgattgacggagaatatagactcaggggcgaggcacggaagacttttgtcgatttgatgcgtcgcggtgacctgcctgtgtggctcgcctaccgagtagctgccgaggggatcaactatgctgatagaaggtggtgtttcgacggcgtgaaaaacaatcaaatactggaagagaacgttgaagtcgagatttggacaaaggagggagaacggaagaaacttaagccccgctggctagatgcaagaatctactccgacccactggccttgaaagagttcaaggaatttgctgccggcaggaaaagtttaaccctgaatctcattacagagatggggcggctgcctactttcatgacgcagaaggcacgaaacgcgcttgataatctggccgtgctccataccgctgaagccggaggtagagcatataaccacgctttgagcgagctgccggagacactagaaactctgctccttctgaccttattggccacagtgaccggcgggatctttctgttcctcatgtcgggaaagggcataggtaaaatgactctggggatgtgctgcatcattacggcatctatccttctgtggtacgcccagattcagccccactggatcgctgcgtccataattctcgagtttttcttgatcgtcctgttaatcccagaacctgagaagcaacgcaccccccaggacaatcagctaacatatgttgtgattgccatcctgactgtagtggcagctaccatggccaacgaaatgggctttctcgagaaaacaaagaaagatttcggacttggcagcataaccactcagcaaccagagtcaaatattctggacatcgatttgaggcctgccagtgcatggacactgtacgctgtcgccacgacctttattactcccatgctccggcattctatcgaaaactccagcgtgaatgtttcactgacagcgatagctaaccaggccaccgtgcttatggggctcggaaagggttggccgctgagtaagatggacatcggcgtcccattgctggcaattgggtgttacagccaggtaaatcctatcaccttaacagccgctctactgctccttgtggcacactatgccattatcggacccggcctgcaggcgaaagctactcgtgaggcccaaaagagagcagccgctggtattatgaaaaacccaacggttgacgggatcaccgtgatagatttggaccccattccttacgatccgaagttcgaaaaacagctgggccaggtcatgctcctggtgctttgcgtcacacaggtgttaatgatgaggactacctgggccctgtgtgaggcactcacattggctaccggacccatctccactctgtgggaaggcaatccagggcgcttttggaacacgacaatcgccgtttctatggcgaatattttccggggaagctatctagccggcgcaggtctgctcttttccataatgaagaacaccgctaacactcgaagagggaccggaaatacaggcgagactcttggtgagaagtggaaaaacaggctgaatgccttgggcaagtcagaattccaaatctacaaaaagtctgggattcaggaggtggaccgcaccctggcaaaagaaggaatcaagcggggcgagacagatcatcacgctgtaagtagagggtcggccaaactccgttggttcgtggagaggaacctggtcacgcctgaaggaaaggttgtggacttaggctgcggtcgggggggatggagctattactgtggcggtcttaagaatgtcaaagaggtgaagggcctgaccaaagggggacccggccatgaagagcctattccaatgtccacttatgggtggaacctcgtacgcctacagtctggagtggatgtttttttcacaccccctgaaaagtgcgacaccctgttgtgtgatatcggcgagtcaagcccaaatcccactgtggaggccggtcgaacactgagagtcctcaaccttgtggaaaattggctgaacaataacacccaattttgcataaaagtcttgaatccgtacatgccttccgtgatcgagaagatggaagcgctgcagaggaagtacgggggagctctcgttcggaacccattaagtcgcaattctacgcacgagatgtattgggtaagcaacgcatcaggcaacattgtgtccagtgtcaatatgatcagcagaatgctgattaacaggttcaccatgcgacacaaaaaggccacatacgaacccgacgtggatcttggctctgggactcggaatatcggaatagagtccgagacccctaacctggacattatcggtaaacgtatcgaaaagattaaacaggagcatgaaacatcatggcactatgatcaggaccatccatacaagacttgggcttatcacggcagctacgagaccaagcaaacagggtcggcctctagtatggttaatggagtggtcagactactcaccaaaccctgggacgtgataccgatggtaactcagatggcaatgacggatacaaccccttttggccagcagcgcgtgttcaaggaaaaagttgacactaggacccaagagcccaaggagggtacaaaaaagctgatgaagatcacggccgaatggttgtggaaagagctggggaagaaaaagaccccacggatgtgtactagagaagagtttgctcgcaaagtcaggtccaacgcggccctcggagcaattttcacagatgagaataagtggaaaagcgctcgagaagccgtggaggactcaggcttttgggaacttgtggataaggagcggaacctgcacttagaaggcaagtgcgagacctgtgtctataatatgatggggaaaagagagaagaaactgggagaattcggtaaggcaaaaggctccagggccatctggtacatgtggttgggggctcgctttctcgagttcgaagccctgggatttctaaacgaggaccattggttctctcgtgaaaatagccttagtggcgttgagggtgaggggctgcacaagctcggatacattctgcgggatgtgtccatgaaggaaggcggcgcgatgtatgcagacgatactgccgggtgggacacaagaatcaccttggaggatctgaaaaacgaagagatggtaacaaatcatatggaaggagagcacaagaaactcgctgaggccatattcaagcttacttaccagaacaaagtggtcagggtgcagcgccctaccccccgaggtacggttatggacatcattagccggagagaccagaggggctctgggcaagtggtcacctatggactgaatacatttactaacatggaagcacagttaatccgccagatggagggcgaaggtgtgttcaagtcaattcaacagctgaccgtaacagaggagatcgctgttaagaactggttggtgagagtcgggcgggaaaggctcagtcgtatggccatttccggagatgactgcgtggtgaaaccactggatgaccgatttgctagcgccctaactgcacttaatgatatgggcaaggtccgcaaagacatacagcagtgggagccctctagaggctggaacgattggacccaagttcctttctgctcgcatcactttcacgaactgatcatgaaggacgggcgggtgctcgtagtgccatgtaggaatcaggatgagctgattggacgcgcgagaatctcacagggtgccggctggagcttgcgggaaacggcttgcttagggaaatcctacgcccagatgtggagtctgatgtatttccataggcgagacctccgtcttgcagctaacgccatctgttctgcagtcccgagccactgggtgcccacatccagaaccacttggtcaattcatgccacacacgagtggatgaccactgaggatatgctgaccgtttggaatcgcgtgtggatacaagaaaacccttggatggaggacaagacaccagtcgaaagttgggaggaaatcccctacctaggaaagcgggaggatcagtggtgcggctctctgattggtctcacgagcagggcgacctgggctaaaaatatccagactgccattaaccaggtgagatccttgatcgggaatgaggaatatacagactacatgccttcaatgaagcgctttcggagggaggaagaggaagcaggagtactgtggtga

SEQ ID NO: 14951 - RNA, 9876 nt, synthetic construct
  misc_feature 1..9876: note = derived and/or modified CDS sequence (opt3) from DENV-2__KC762664__SS-prME
  source 1..9876: mol_type = other RNA
accgcaggcatcattataatgatgatccccacagtgatggctttccacctgactacgaggaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactcggaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtgacaccatctatgaccatgagatgcatcggcatatcgaacagggactttgtcgaaggggtgtcaggaggtagctgggtagatattgttctggagcacggcagttgtgtgactacaatggccaaaaataagcccaccctcgacttcgaattaatcaagacggaggctaaacaccctgccaccctgcggaagtactgcattgaagcgaaacttacaaacactaccacagcatcccgctgtccaactcagggggagccctctttgaatgaggaacaagataagcgatttgtctgcaaacatagcatggtggacagaggatggggcaacggttgtgggctgttcggaaagggcggcatcgtgacctgcgccatgtttacatgcaagaaaaatatggaggggaagatcgtccagcctgaaaacctagagtataccattgttataactccacactccggagaagagaatgctgtgggtaacgatacgggcaaacatgggaaggagatcaaagtaacaccgcagtcaagtattaccgaagccgagctcactggatacggcaccgtgacaatggaatgtagccccaggaccggtctggacttcaatgagatggtccttctgcagatggaaaacaaggcatggttggtgcaccggcaatggtttctcgatctgcctttaccatggctgcccggggctgacactcagggctctaactggatccagaaagagacactcgttacgttcaagaatcctcacgccaagaaacaggatgtggtcgtgcttggatcccaagagggcgcgatgcataccgccctgactggggcaacagaaatacagatgtcaagcggaaacttgctatttaccggtcacctgaagtgccgtctccgcatggacaaactgcagcttaagggcatgagttattctatgtgtacagggaaattcaaggtagttaaggagattgctgaaactcaacatggaaccatcgtgatcagagtccagtacgagggcgacggttccccatgcaaaattcccttcgagatcacggatctggaaaagaggcacgggttgggccggctcattaccgtgaatccgatagtcacagagaaagacagccctgtgaacatcgaagccgagcccccatttggagattcgtacattatcatcggcgttgaacctgggcagctgaagttatcttggttcaaaaagggatcctcaattggtcagatgtttgagactaccatgcgaggcgctaagcgcatggccatactgggggacacagcatgggatttcggaagtctaggcggtgtgtttactagcatcgggaaagccctccatcaagtattcggcgctatttatggagcggcattttccggcgtctcttggaccatgaagatcctgattggggtggttatcacgtggataggaatgaatagcagatcaacaagtctttccgtgagcttggtcctggtgggcgtagtgaccctctacctgggtgttatggtccaggccgactctgggtgtgtggtgtcatggaaaaacaaggagcttaaatgcggaagtggcatcttcattactgataatgtccacacatggaccgaacagtataagtttcagcccgagagcccatccaagctggcttctgccatccaaaaagcacacgaagagggtatttgtggcatcaggtcggttactcggttggaaaacctcatgtggaagcagataacccccgagctgaatcatattttaagcgagaacgaagtgaaactgacaatcatgacgggggacattaagggaatcatgcaggccggcaaacgctccctaagacctcagccaaccgagctcaagtactcatggaaaacttgggggaaggctaagatgctgagtacagaacttcacaatcataccttcttgatagatggaccggagacagccgaatgccccaacgcaaatagggcgtggaactctctggaggtggaggactatggctttggtgtattcactaccaatatctggctcaaactgaaggaacgtcaagatgctttttgtgacagcaaattaatgtccgccgcaattaaggacaaccgggccgtccacgctgatatggggtactggatcgagtcagccctgaacgacacgtggaaaattgaaaaggccagcttcatcgaggtgaagtcttgccactggcctaaatcccatacactttggagtaatggagttttggagagcgaaatgataattccaaagaacttcgctggccccgtgtctcagcacaattatcgacctggttaccatacccagactgccggcccatggcacctcgggagactggagatggattttgacttctgtgaaggaaccacagtcgtggttactgaggattgcggcaacagggggccctccctacgcaccacaacggcgtcaggaaaactgatcaccgaatggtgctgtcggagttgcactctcccgcctctgagatacaggggcgaggacggttgttggtatgggatggagatccgcccacttaaggaaaaagaggaaaatttggtgaacagcctggtaacagccggacatggccagattgataatttttcgttaggtgtcctcggcatggctctgttccttgaggaaatgctgcgaacccgggtggggactaagcacgcaatcttgctcgtggccgtctcctttgttacactgattaccggaaacatgtctttccgtgacctaggcagagtgatggtaatggtgggggctacgatgactgatgacataggaatgggcgtcacctacctggccctcctggcagcgtttaaggtgaggcccacattcgccgctggtcttttgctgcgcaaattaaccagcaaggagctcatgatgactacaatcgggattaccctgctttcacaaagtacaatccctgagactattctggaactaaccgatgccctcgcactgggaatgatggttttgaaaatcgtgcggaatatggagaagtatcagctggctgtcacgataatggccatcttatgcgtgcccaacgcagttattctccagaatgcctggaaagtgtcctgtacaaccctggctgtcgtatctgtgagcccacttctgttgacttcctcacaacagaaggcggactggatccctctcgccctgaccattaagggcctaaaccccacagcaatctttctgactacccttagcagaacgagtaaaaagaggtcttggccactcaatgaagctataatggccgttggcatggtgtccattctggccagctcgttgctgaaaaacgatatcccgatgacagggcctttagtcgctggaggtctcctgaccgtgtgctacgtacttactggccgatcagcagacctggagttggaacgcgccgcggacgtgcggtgggaggagcaggctgaaatctctgggagttcccccattctcagcataacaatctctgaggatggaagcatgtccattaagaatgaagaggaggaacagaccctgactatcctaattagaacaggcctgcttgtcatctcaggtctcttcccagttagtatacccatcaccgccgcagcctggtatctgtgggaggtgaaaaagcaaagggctggggtgttgtgggacgtccctagcccaccccctgtggaaaaagcagagttagaagatggagcctaccgtattaagcagaagggcatcctgggctattctcagattggggcgggagtttacaaagagggtacgtttcacactatgtggcatgtaacccgcggcgctgtgctcatgcacaaggggaaacggatcgagccgtcctgggccgacgtcaagaaagatctgatatcatacggaggcggttggaaacttgaaggggagtggaaggaaggagaggaagtgcaggttctggcattggagccaggcaaaaaccccagagccgtgcaaacaaagcctggcctattcaaaaccagtacagggactattggagctgtcagcctggacttttccccaggtacctctggctcgcccatcgtggataagaaagggaaggtagtcggactctatggcaacggtgtggttacgaggagcgggacatacgtgtcagccatcgcacagactgagaagtccattgaagacaatcctgagatcgaagatgacatattcagaaagaagcggctgaccattatggatcttcatccgggagctggcaaaacaaagcgctatttacccgccatcgtcagagaggcgattaaaaggggcctgcggaccctcatcttggccccaactcgagtggttgcagctgaaatggaggaggccctgagagggctccctatacgctaccagacccccgctattagggcagaacacacaggacgtgagatcgtggacctgatgtgtcatgccacgttcactatgcggcttctgagtccaatcagagtccctaactataatttgattatcatggatgaagcccactttaccgaccccgcttctattgcggcaaggggttacataagcacacgcgtggagatgggcaaggccgctgggatcttcatgaccgccactccaccgggatcccgagacccttttccccagtcaaacgcaccaattatggatgaggaaagagagatccccgaacggtcttggaatagcggccacgagtgggtaacagacttcaagggtaaaaccgtgtggtttgttcctagtatcaaggccgggaacgatattgctgcgtgcctaaggaaaaatggaaagaaagtcatacaactgtcccgcaagacgttcgactttgaatatatcaagactcgtacaaacgattgggacttcgtggtgaccaccgatattagcgagatgggcgccaattttaaagcagagagagtcatcgacccacggaggtgtatgaagcccgtaattctcactgatggcgaagaacgcgtgatcttagctgggcctatgccggttacacattcttcagccgcacagcgaagaggacgggtgggtaggaaccccaagaatgaaaacgaccagtacatatacatgggcgagcccctggaaaatgatgaggactgcgcccactggaaggaggctaaaatgcttctggacaacatcaatacccctgaagggattatcccctccatgttcgagccagaacgcgagaaggtcgatgccattgacggagaatatagactcaggggcgaggcgcggaaaacatttgtggatttgatgcgtcgcggtgacctgcctgtttggctcgcataccgagtggccgctgaggggatcaactatgccgatagaaggtggtgtttcgacggcgtcaagaacaatcaaatactggaagagaacgtggaagtagagatttggactaaggagggagaacggaagaaacttaaaccccgctggctagatgctagaatctacagtgacccactggcattgaaagagttcaaagaatttgccgctggcagaaagagcttaacgctgaatctcattaccgagatggggcggctgcctacattcatgactcagaaggcccgaaacgcacttgataatctggcggtgctccataccgccgaagctggaggtagagcctataaccacgcattgtcggagctgccggagacactagaaaccctgctccttctgactttattggctacggttaccggcgggatctttctgttcctcatgtctggaaaaggcataggtaagatgacactggggatgtgctgcatcattactgcctccatccttctgtggtacgcacagattcagccccactggatcgccgctagcataattctcgagtttttcttgatcgtcctgttaatcccagaacctgagaaacaacgcacaccacaggacaatcagctaacatatgtggtgattgcgatcctgaccgtcgttgccgcaactatggctaacgaaatgggctttctcgagaagaccaagaaggatttcggacttggctcaataacgacccagcaaccagagagtaatattctggacatcgatttgaggcctgcctctgcctggactctgtacgcagtggctacaacctttattacccccatgctccggcattccatcgaaaacagctcagtaaatgtgagtctgacagccatagcgaaccaggctactgtccttatggggctcggaaagggttggccgctgagcaaaatggacatcggcgtgccattgctggccattgggtgttactcccaggttaatcctatcacgttaaccgcagccctactgctccttgtggctcactatgcaattatcggacccggcctgcaggccaaggcgacacgtgaggctcaaaagcgagccgcagccggtattatgaagaacccaactgtcgacgggatcaccgtaatagatttggaccccattccttacgatccgaaattcgaaaagcagctgggccaggtgatgctcctggttctttgcgtgacacaggtcttaatgatgaggaccacttgggctctgtgtgaggccctcacgttggcaacaggacccatctctaccctgtgggaaggcaatccagggcgcttttggaacactaccatcgctgtgagcatggccaatattttccggggatcctatctagcgggcgccggtctgctcttttcaataatgaagaacacagcaaacactcgaagagggaccggaaatacaggcgagacgcttggtgagaaatggaagaacaggctgaatgctttgggcaaatctgagttccaaatctacaagaaaagtgggattcaggaggtcgaccgcaccctggccaaggaaggaatcaaacggggcgagactgatcatcacgcagtgtcgagagggagcgctaagctccgttggttcgttgagaggaacctggtgacacctgaaggaaaggtagtggacttaggctgcggtagagggggatggtcctattactgtggcggtcttaaaaatgtcaaggaggttaaaggcctgaccaaagggggacccggccatgaagaacctattccaatgtctacttatgggtggaacctcgtgcgcctacagtcaggagtcgatgtgtttttcacaccccctgaaaaatgcgacaccctgttgtgtgatatcggcgagagctccccaaatcccacggtagaggccggtcgaaccctgagagtgctcaaccttgttgaaaattggctgaacaataacacacaattttgcataaaggtgttgaatccgtacatgcctagtgtcatcgagaagatggaagccctgcagaggaaatacgggggagcgctcgtgcggaacccattatctcgcaatagcactcacgagatgtattgggtctcaaacgcttccggcaacattgtgagtagcgttaatatgatctctagaatgctgattaacaggttcaccatgcgacacaagaaagcaacatacgaacccgacgtagatcttggctccgggactcggaatatcggaatagagtcagagacccctaacctggacattatcggtaagcgtatcgagaaaattaagcaggaacatgaaacaagctggcactatgatcaggaccatccatacaagacctgggcctatcacggctcgtacgagactaaacaaacggggtctgctagttccatggtgaatggagtcgtgagactactcacaaagccctgggacgttataccgatggtgacccagatggccatgactgataccacaccttttggccagcagcgcgtcttcaaagaaaaggtggacacgaggacccaagagcccaaagagggtactaagaagctgatgaaaatcacagcagaatggttgtggaaggagctggggaaaaagaaaaccccacggatgtgtactagagaagagtttacacgcaaggtaaggagcaacgccgctctcggagcgattttcaccgatgagaataaatggaagtcagcccgagaagcagtggaggactccggcttttgggaacttgttgataaggagcggaacctgcacttagaaggcaaatgcgagacatgtgtctataatatgatggggaagagagagaaaaagctgggagagttcggtaaagctaagggctctagggccatctggtacatgtggttgggggcacgctttctcgagttcgaagccctgggatttctaaacgaggaccattggttcagccgtgaaaatagtctttccggcgtggagggtgaggggctgcacaagctcggatacattctgcgggatgtgagcaaaaaggaaggcggcgctatgtatgccgacgatactgcggggtgggacaccagaatcacgttggaggatctgaaaaacgaagagatggtcaccaatcatatggaaggagagcacaagaaactcgcagaggccatattcaaacttacataccagaacaaggttgtgagggtacagcgccctactccccgaggtaccgtgatggacatcatttctcggagagaccagaggggctcagggcaagtcgtgacatatggactgaatacttttaccaacatggaagctcagttaatccgccagatggagggcgaaggtgttttcaaaagtattcaacagctgacggtgacagaggagatcgccgtcaagaactggttggtgaccgtagggagagaacggctctccaggatggcaattagcggagatgactgcgttgtgaaaccactggatgaccgttttgcttctgccctaactgctcttaatgatatgggcaaggtccgaaaagacatacagcagtgggagccctcgcgcggctggaacgattggacacaagtgcctttctgctcacatcactttcacgaactgatcatgaaggacgggagagtgctcgtcgttccatgtcggaatcaggatgagctgattggaagggcccgcatcagccagggtgcaggctggtccttgagagaaaccgcgtgcttagggaagagttacgcccagatgtggtctctgatgtatttccatcggagggacctccgacttgctgccaacgcaatctgtagcgctgtgccgtcccactgggtacccacttcacgtaccacatggagtattcatgccacgcacgagtggatgaccactgaggatatgctgacagtgtggaatagagtctggatacaagaaaacccttggatggaggacaaaaccccagtgggatcttgggaagagatcccctacctaggcaagcgcgaagatcagtggtgcggtagcctgattgggctcacttcccgggcaacatgggccaaaaatatccagaccgcgattaaccaggttaggtcattgatcggaaatgaggagtatacggactacatgcctagcatgaagagatttcgccgggaagaggaagaggctggcgtgctgtggtga

SEQ ID NO: 14952 - RNA, 9876 nt, synthetic construct
  misc_feature 1..9876: note = derived and/or modified CDS sequence (opt3) from DENV-2__KC762674__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgcactttcagcgcgttttgatcttcattctcctgactgcagtggccccatctatgacaatgagatgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaacatcctgcgacgctgcggaagtattgcattgaagcaaaacttaccaacacaactaccgcctcccgctgtccaacacagggggagccctctttgaatgaggaacaagataagcgatttgtctgcaaacacagcatggtggacagaggatggggcaacggttgtgggctgttcggaaagggcggcatcgtgacttgcgctatgtttacctgcaagaaaaatatggaggggaagatcgtccagcctgaaaacctagagtacacaattgttataaccccacattccggagaagagaatgccgtgggtaacgatactggcaaacacgggaaggagatcaaagtaacgccgcagtcaagtattacagaagcagagctcaccggatatggcactgtgaccatggaatgtagccccaggacaggtctggacttcaatgagatggtccttctgcagatggaaaacaaggcttggttggtgcaccggcaatggtttctcgatctgcctttaccatggctgcccggggccgacacccagggctctaactggatccagaaagagactctcgttacattcaagaatcctcatgcgaagaaacaggatgtggtcgtgcttggatcccaagagggcgccatgcacacggcactgaccggggctactgaaatacagatgtcaagcggaaacttgctatttacaggtcatctgaagtgccgtctccgcatggacaaactgcagcttaagggcatgagttactctatgtgtaccgggaaattcaaggtagttaaggagattgccgaaacacaacacggaactatcgtgatcagagtccagtatgagggcgacggttccccatgcaaaattcccttcgagatcatggatctggaaaagaggcatgtgttggggcggctcattaccgtcaatccgatagtgacggagaaagacagccctgttaacatcgaagctgagcccccatttggcgattcgtacattatcatcggagtggaacctggccagctgaagttatcttggttcaaaaaggggtcctcaattggacagatgtttgagaccacaatgcgaggtgccaagcgcatggcaatactgggcgacactgcctgggatttcgggagtctaggaggcgtatttaccagcatcggtaaagctctccaccaagtcttcggggcgatttacggcgcagccttttccggagtgtcttggacaatgaagatcctgattggcgttgtgatcacttggatagggatgaatagcagatcaaccagtctttccgtcagcttggtgctggtaggagtggttacgctctatctgggcgtcatggtgcaggctgactctggttgtgtggtctcatggaaaaacaaggagcttaaatgcgggagtggaatcttcattacagataatgttcacacctggactgaacagtacaagtttcagcccgagagcccatccaagctggcctctgcaatccaaaaagcccatgaagagggcatttgtggtatcaggtcggtgacacggttggaaaacctcatgtggaagcagataacccccgagctgaatcacattttaagcgagaacgaagtgaaactgactatcatgaccggcgacattaaggggatcatgcaggctggaaaacgctccctaagacctcagccaacagagctcaagtattcatggaaaacgtggggcaaggccaagatgctgagtaccgaacttcataatcacactttcttgatagatgggccggagacagcagaatgccccaacaccaatagggcgtggaactctctggaggtagaggactacggatttggcgtcttcacaactaatatctggctcaaactgaaggaacgtcaagatgtgtattgtgacagcaaattaatgtccgctgccattaaggacaaccgggcagttcacgccgatatgggttactggatcgagtcagctctgaacgacacctggaaaattgaaaaggccagctttatcgaggtgaagtcttgctattggcctaaatcccatacgctttggagtaatggggtcttggagagcgaaatgataattccaaagaacttcgcaggacccgtgtctcagcacaattaccgacctggctaccatacacagaccgctggtccatggcacctcggcagactggagatggatttcgacttttgtgaagggactaccgttgtggtaacagaggattgcggaaacaggggcccctccctacgcactaccacagcctcagggaaactgatcacggaatggtgctgtcggagttgcaccctcccgcctctgagatataggggagaggacggctgttggtacggtatggagatccgcccacttaaggaaaaagaggaaaatttggtcaacagcctggtgactgcggggcatggacagattgataatttctcgttaggcgtgctcggtatggccctgtttcttgaggaaatgctgcgaacacgggtcggcaccaagcacgctatcttgctcgttgcagtgtccttcgtaactctgattacagggaacatgtcttttcgtgacctaggaagagtgatggtcatggtgggcgccaccatgacggatgacatagggatgggagttacttatctggctctcctggccgcattcaaggtgaggcccacctttgcggccggccttttgctgcgcaaattaacaagcaaggagctcatgatgaccactatcggtattgtcctgctttcacaaagtacaatccctgagaccattctggaactaacagatgctctcgccctggggatgatggcattgaaaatcgtgcggaatatggagaagtaccagctggctgttactataatggccatcttatgcgtgcccaacgcagtcattctccagaatgcctggaaagtatcctgtaccacgctggctgtggtttctgtgagcccacttctgttgacatcctcacaacagaaggcggactggatccctctcgccctgaccattaagggactaaaccccactgcaatcttcctgaccacacttagcagaactagtaaaaagaggtcttggccactcaatgaagctataatggccgtcggcatggtgtccattctggccagctcgttgctgaaaaacgatatcccgatgaccggccctttagtagctgggggactcctgacggtgtgctatgtccttacaggtcgatcagcagacctggagttggaacgcgccgcggacgttcggtgggaggagcaggctgaaatctctggcagttcccccattctcagcataaccatctctgaggatgggagcatgtccattaagaatgaagaggaggaacagactctgacaatcctaattagaaccggactgcttgtgatctcaggcctctttccagtgagtatacccatcactgccgcagcctggtacctgtgggaggtcaaaaagcaaagggctggtgtgttgtgggacgttcctagcccaccccctgtagggaaagcagaattagaggatggagcctatcgtattaagcagaagggcatcctgggctactctcagattggggcgggagtgtacaaagaaggtacattccacaccatgtggcatgtcacgcgcggcgctgtgctcatgcacaaggggaaacggatcgagccgtcctgggccgacgttaagaaagatctgatatcatatggaggcggttggaagcttgagggggaatggaaggagggagaagaggtgcaggtcctggcattggaaccaggcaaaaaccccagagccgtgcaaactaagcctggcctatttaaaaccaacacagggaccattggagctgtaagtctggacttcagcccaggtacatccggctctcccatcgtcgataagaaagggaaggtggttggactctacggcaatggtgtggtcactaggtcggggacctatgtgagcgccatcgcacagacggagaagtcaattgaggacaaccctgaaatcgaggatgacatatttcgaaaaaagcggctgacaattatggatcttcatccgggagctggcaaaactaagcgctacttacccgccatcgttagagaagcgattaaaaggggcctgcggaccctcatcttggccccaacacgagtggtcgcagctgagatggaagaggccctgagagggctccctatacgctatcagacccccgctattagggcagagcacactggacgtgaaatcgtggacctgatgtgtcatgccaccttcacaatgcggcttctgtccccaatcagagtacctaattacaacttgattatcatggatgaggcccacttcacggaccccgctagtattgcggcaaggggttatatatctactcgcgtggaaatgggcgaggccgctgggatctttatgaccgccacaccaccgggaagccgagaccctttcccccagtccaatgcaccaattatggatgaggaaagagagatccccgaacggtcatggaactctggccacgagtgggttaccgactttaagggtaagactgtctggttcgtgcctagcatcaaagccgggaatgatattgctgcgtgcctaaggaagaacggaaaaaaggtgatacaactgagtcgcaaaacatttgacttcgaatacatcaagacccgtacgaatgattgggactttgtcgtaactacagatatttccgagatgggcgccaacttcaaggcagagagagtgatcgacccacggaggtgtatgaaacccgttattctcaccgatggcgaagagcgcgtgatcttagctgggcctatgccggtcacccatagctctgccgcacagcgaagaggacgggtgggtaggaatccaaagaacgaaaatgaccagtacatatatatgggcgagcccctggaaaacgatgaggactgcgcccactggaaagaggctaagatgcttctggacaatatcaacactcctgaagggattatcccctcaatgtttgagccagaacgcgagaaagttgatgccattgacggagaatacagactcaggggcgaggcgcggaagacattcgtggatttgatgcgtcgcggtgacctgcctgtctggctcgcatatcgagtggccgctgaggggatcaactacgccgatagaaggtggtgttttgacggcgtaaaaaataaccaaatactggaagagaatgtggaagttgagatttggaccaaggagggagaacggaagaaacttaagccccgctggctagatgctagaatctattccgacccactggcattgaaagagttcaaggaattcgccgctggcaggaaaagtttaacactgaacctcattactgagatggggcggctgcctacgtttatgacccagaaggcccgaaatgcacttgataacctggcggtcctccatacagccgaagctggaggtagagcctacaatcacgcattgagcgagctgccggagactctagaaaccctgctccttctgacattattggctaccgtgactggcgggatcttcctgtttctcatgtcgggaaagggcataggtaaaatgacgctggggatgtgctgcatcattaccgcctctatccttctgtggtatgcacagattcagccccactggatcgccgcttccataattctcgagttctttttgatcgtgctgttaatcccagaacctgagaagcaacgcacaccccaggacaaccagctaacttacgtcgttattgcgatcctgaccgtggtagccgcaacaatggctaatgaaatgggcttcctcgagaaaaccaagaaagattttggacttggcagcataactacacagcaaccagagtcaaacattctggacatcgatttgaggcctgccagtgcctggacgctgtacgcagtggctaccactttcattacacccatgctccggcattctatcgaaaattccagcgtcaacgtgtcactgaccgccatagcgaatcaggctaccgttcttatggggctcggaaagggttggccgctgagtaagatggacatcggcgtgccattgctggccattgggtgttatagccaggtcaaccctatcacattaactgcagccctactgctccttgtagctcactacgcaattatcggacccggcctgcaggccaaagcgacgcgtgaggctcaaaagagagccgcagccggtattatgaaaaatccaaccgtggacgggatcacagttatagatttggaccccattccttatgatccgaagtttgaaaaacagctgggccaggtgatgctcctggtcctttgcgtgactcaggtcttaatgatgaggaccacatgggctctgtgtgaggccctcaccttggcaactggacccatctccacgctgtgggaaggcaacccagggcgcttctggaatacaaccatcgctgtgtctatggccaacatttttcggggaagctacctagcgggcgccggtctgctcttctccataatgaagaacactgcaaatacccgaagagggacaggaaacactggcgagacccttggtgagaagtggaaaaataggctgaacgctttgggcaagtcagaatttcaaatctataaaaagtctgggattcaggaggttgaccgcacactggccaaagaaggaatcaagcggggcgagacggatcatcacgcagtgagtagagggtcggctaaactccgttggttcgtagagaggaatctggtgacccctgaaggaaaggtcgttgacttaggctgcggtcgggggggatggagctactattgtggcggtcttaagaacgtgaaagaggtcaagggcctgactaaagggggacccggccatgaagagcctattccaatgtccacatacgggtggaatctcgtgcgcctacagtctggagtagatgtgttctttaccccccctgaaaagtgcgacactctgttgtgtgatatcggcgagtcaagcccaaaccccacagttgaggccggtcgaaccctgagagtgctcaatcttgtcgaaaactggctgaataacaatacgcaattctgcataaaagtgttgaacccgtacatgccttccgtcatcgagaagatggaagccctgcagaggaagtatgggggagcgctcgtgcggaatccattaagtcgcaactctacccacgagatgtactgggttagcaacgcttcaggcaatattgtatccagtgtgaacatgatcagcagaatgctgattaataggtttacaatgcgacacaaaaaggcaacttatgaacccgacgtcgatcttggctctgggacccggaacatcggaatagagtccgagattcctaatctggacatcatcggtaaacgtattgaaaagataaaacaggagcatgaaacatcatggcactacgatcaggaccatccatataagacttgggcctaccacggcagctatgagaccaagcaaacagggtcggcttctagtatggtgaacggagttgtgagactactcaccaaaccctgggacgtcatcccgatggtgactcagatggccatgacggatacaacccctttcggccagcagcgcgtatttaaggaaaaagtggacactaggacccaagagcccaaggagggtacaaaaaagctgatgaagattacggcagaatggttgtggaaagagctggggaagaaaaagaccccacggatgtgtactagagaagagttcacacgcaaagttaggtccaatgccgctctcggagcgatctttaccgatgagaacaagtggaaaagcgcccgagaagcagtcgaggactcaggcttctgggaacttgtggataaggagcggaatctgcacttagaaggcaagtgcgagacttgtgtgtacaacatgatggggaaaagagagaagaaactgggagaatttggtaaggctaaaggctccagggccatttggtacatgtggttgggggcacgcttcctcgagtttgaagccctgggattcctaaatgaggaccattggttttctcgtgaaaacagccttagtggcgtcgagggtgaggggctgcacaagctcggatatatcctgcgggatgtttccaagaaagaaggcggcgctatgtacgccgacgatacagcggggtgggacaccagaataacattggaggatctgaagaatgaagagatggtgactaaccatatggaaggagagcacaaaaagctcgcagaggccatcttcaaacttacctatcagaataaggtagtgagggtccagcgccctacgccccgaggtaccgtgatggacattatcagccggagagaccagaggggctctgggcaagttgtgacatacggactgaacactttcaccaacatggaagctcagttaattcgccagatggagggcgaaggtgtctttaagtcaatccaacagctgacagtgactgaggagattgccgtaaaaaattggttggttagagtggggcgggaaaggctcagtcgtatggcaatatccggagatgactgcgtcgtgaagccactggatgaccgattcgctagcgccctaaccgctcttaacgatatgggcaaagtgcgcaaggacatccagcagtgggagccctctagaggctggaatgattggacgcaagtccctttttgctcgcatcacttccacgaactgattatgaaagacgggcgggttctcgtggtaccatgtaggaaccaggatgagctgatcggacgcgccagaatctcacagggtgcaggctggagcttgcgggaaacagcgtgcttagggaagtcctatgcccagatgtggagtctgatgtactttcataggcgagacctccgtcttgctgccaatgcaatttgttctgctgtgccgagccactgggtccccacctccagaactacatggtcaatacatgccacccacgagtggatgactaccgaggatatgctgacagtgtggaaccgcgtttggatccaagaaaatccttggatggaggacaagacgccagtggaaagttgggaggaaattccctatctaggaaaacgggaggatcagtggtgcggctctctgatcggtctcaccagcagggcaacttgggccaagaacattcagacagcgatcaatcaggtcagatccttgatagggaacgaggaatacaccgactacatgccttcaatgaaacgcttccggagggaggaagaggaagctggagtgctgtggtga

SEQ ID NO: 14953 - RNA, 9876 nt, synthetic construct
  misc_feature 1..9876: note = derived and/or modified CDS sequence (opt3) from DENV-2__KC762672__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtggccccatctatgacaatgagatgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaacaccctgcgacgctgcggaagtactgcattgaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaagatcgtccagcctgaaaacctagagtatacaattgttataaccccacactccggagaagagaatgccgtgggtaacgatactggcaaacatgggaaggagatcaaagtaacgccgcagtcaagtattacagaagcagagctcaccggatacggcactgtgaccatggaatgtagccccaggacaggtctggacttcaatgagatggtccttctgcagatggaaaacaaggcttggttggtgcaccggcaatggtttctcgatctgcctttaccatggctgcccggggccgacacccagggctctaactggatccagaaagagactctcgttacattcaagaatcctcacgcgaagaaacaggatgtggtcgtgcttggatcccaagagggcgccatgcatacggcactgaccggggctactgaaatacagatgtcaagcggaaacttgctatttacaggtcacctgaagtgccgtctccgcatggacaaactgcagcttaagggcatgagttattctatgtgtaccgggaaattcaaggtagttaaggagattgccgaaacacaacatggaactatcgtgatcagagtccagtacgagggcgacggttccccatgcaaaattcccttcgagatcatggatctggaaaagaggcacgtgttggggcggctcattaccgtcaatccgatagtgacggagaaagacagccctgttaacatcgaagctgagcccccatttggcgattcgtacattatcatcggagtggaacctggccagctgaagttatcttggttcaaaaaggggtcctcaattggacagatgtttgagaccacaatgcgaggtgccaagcgcatggcaatactgggcgacactgcctgggatttcgggagtctaggaggcgtatttaccagcatcggtaaagctctccatcaagtcttcggggcgatttatggcgcagccttttccggagtgtcttggacaatgaagatcctgattggcgttgtgatcacttggatagggatgaatagcagatcaaccagtctttccgtcagcttggtgctggtaggagtggttacgctctacctgggcgtcatggtgcaggctgactctggttgtgtggtctcatgggagaacaaagaacttaagtgcgggagtggaatcttcattacagataatgttcacacctggactgagcagtataaatttcagcccgaaagcccatccaagctggcctctgcaatccaaaaggcccacgaggaaggcatttgtggtatcaggtcggtgacacggttggagaacctcatgtggaaacagataacccccgagctgaatcatattttaagcgaaaacgaggtgaagctgactatcatgaccggcgacattaaagggatcatgcaggctggaaagcgctccctaagacctcagccaacagaactcaaatactcatggaaggcctggggcaaagcaaagatgctgagtacggagcttcacaatcataccttcttgatagatgggccggaaactgcggagtgccccaacacaaatagggcttggaactctctggaggtagaagactatggatttggcgtcttcaccacaaatatctggctcaagctgaaagagcgtcaagatgtgttttgtgacagcaagttaatgtccgccgcaattaaagactcacgggccgttcacgctgatatgggttactggatcgaaagcgccctgaacgacacttggaagattgagaaagcatctttcatcgaggtgaagtcctgccactggcctaagagtcataccctttggagcaacggggtcttggaatctgagatgataattccaaaaaatttcgctggacccgtgtcccagcacaactatcgacctggctaccatacgcagacagccggtccatggcacctcggcagactggaaatggattttgacttctgtgaggggaccactgttgtggtaaccgaagattgcggaaataggggcccctcactacgcacaactaccgcgagtgggaagctgatcacagagtggtgctgtcggagctgcacgctcccgcctctgagatacaggggagaggacggctgttggtatggtatggaaatccgcccacttaaagagaaggaagagaacttggtcaattcgctggtgaccgccgggcatggacagattgataacttttccttaggcgtgctcggtatggctctgttccttgaagagatgctgcgaactcgggtcggcacaaaacacgcaatcttgctcgttgccgtgtcttttgtaaccctgattactgggaatatgagcttccgtgacctaggaagagtgatggtcatggtgggcgctacaatgaccgatgacatagggatgggagttacgtacctggccctcctggcagcgtttaaggtgaggcccactttcgccgctggccttttgctgcgcaagttaacctcaaaagagctcatgatgacaaccatcggtattgtcctgcttagtcaagccactatccctgaaacaattctggagctaaccgatgcactcgctctggggatgatggtgttgaagatcgttcggaacatggaaaaatatcagctggccgtgacaataatggcaatcttatgcgtccccaatgccgtaattctccagaacgcttggaaggtgtcctgtactaccctggcggttgtgtctgtcagcccacttctgttgacgtcctcacaacagaaagccgactggatccctctcgcactgacaattaagggactaaatcccaccgctatctttctgactacccttagcagaacaagtaagaaaaggtcttggccactcaacgaggccataatggccgtgggcatggtatccattctggctagctcgttgctgaagaatgatatcccgatgactggccctttagtggcagggggactcctgaccgtctgctacgttcttacgggtcgatcagccgacctggaattggagcgcgcggctgacgtgcggtgggaggaacaggccgagatctctggcagttcccccattctcagcataacaatctctgaagatgggagcatgtccattaaaaacgaggaggaagagcagaccctgactatcctaattagaacaggactgcttgtgatctcaggcctcttcccagtcagtatacccatcaccgcagccgcttggtatctgtgggaagtgaagaaacaaagggcaggtgttttgtgggacgtacctagcccaccccctgtggggaaggccgagttagaagatggagcgtaccgtattaaacagaagggcatcctgggctattctcagattggggctggagtctacaaggagggtacttttcacacaatgtggcatgtgacccgcggcgccgttctcatgcacaaagggaagcggatcgagccgtcctgggcagacgtgaaaaaggatctgatatcatacggaggcggttggaaacttgaaggggagtggaaggaaggagaggaagtccaggtgctggccttggagccaggcaagaatcccagagctgtacaaacgaaacctggcctattcaagactaacaccgggacaattggagccgtcagtctggactttagcccaggtacctccggctctcccatcgtggataaaaaggggaaagttgtgggactctatggcaacggtgtcgtgacaaggtcggggacttacgttagcgcaatcgctcagaccgagaagtcaattgaagacaatcctgagatcgaagatgacatattccgaaagaaacggctgacgattatggatcttcatccgggagccggcaagacaaaacgctatttacccgcgatcgtgagagaggccattaagaggggcctgcggactctcatcttggcaccaacccgagtcgtggctgccgaaatggaggaggctctgagagggctccctatacgctaccagacacccgcaattagggccgaacacaccggacgtgagatcgtagacctgatgtgtcatgccactttcaccatgcggcttctgtccccaatcagagtgcctaactataatttgattatcatggatgaagctcactttacagaccccgcgagtattgcagccaggggttacatatctacgcgcgttgagatgggcgaggctgccgggatcttcatgactgcaaccccaccgggaagccgagacccttttccccagtccaacgccccaattatggatgaagagagagaaatccccgagcggtcatggaattctggccacgaatgggtcacagacttcaaaggtaagaccgtgtggtttgtgcctagcatcaaggctgggaacgatattgcggcctgcctaaggaaaaatggaaagaaagtcatacaactgagtcgcaagactttcgactttgagtatatcaaaacacgtaccaacgattgggacttcgtagtgacgactgatatttccgagatgggcgcaaattttaaggctgaaagagttatcgacccacggaggtgtatgaagcccgtgattctcacagatggcgaggaacgcgtcatcttagccgggcctatgccggtgacccatagctctgcagcccagcgaagaggacgggttggtaggaacccaaaaaatgagaacgaccagtacatatacatgggcgaacccctggagaatgatgaggactgcgctcactggaaggaagccaaaatgcttctggacaacatcaatacccctgaggggattatcccctcaatgttcgaaccagagcgcgaaaaggtggatgcgattgacggagagtatagactcaggggcgaggcacggaaaacttttgtcgatttgatgcgtcgcggtgacctgcctgtgtggctcgcctaccgagtagctgccgaagggatcaactatgctgatagaaggtggtgtttcgacggcgtgaagaacaatcaaatactggaggaaaacgttgaggtcgagatttggacaaaagaaggagagcggaagaagcttaaaccccgctggctagatgcaagaatctactccgacccactggccttgaaggaattcaaagagtttgctgccggcaggaagagtttaaccctgaatctcattacagaaatggggcggctgcctactttcatgacgcagaaagcacgaaacgcgcttgataatctggccgtgctccataccgctgaggccggaggtagagcatataaccacgctttgagcgagctgccggaaacactagagactctgctccttctgaccttattggccacagtgaccggcgggatctttctgttcctcatgtcgggaaagggcataggtaagatgactctggggatgtgctgcatcattacggcatctatccttctgtggtacgcccagattcagccccactggatcgctgcgtccataattctcgaatttttcttgatcgtcctgttaatcccagagcctgaaaaacaacgcaccccccaggacaatcagctaacatatgttgtgattgccatcctgactgtagtggcagctaccatggccaacgagatgggctttctcgagaagacaaaaaaggatttcggacttggcagcataaccactcagcaaccagaatcaaatattctggacatcgatttgaggcctgccagtgcatggacactgtacgctgtcgccacgacctttattactcccatgctccggcattctatcgagaactccagcgtgaatgtttcactgacagcgatagctaaccaggccaccgtgcttatggggctcggaaaaggttggccgctgagtaagatggacatcggcgtcccattgctggcaattgggtgttacagccaggtaaatcctatcaccttaacagccgctctactgctccttgtggcacactatgccattatcggacccggcctgcaggcgaaggctactcgtgaagcccaaaaaagagcagccgctggtattatgaagaacccaacggttgacgggatcaccgtgatagatttggaccccattccttacgatccgaaattcgagaagcagctgggccaggtcatgctcctggtgctttgcgtcacacaggtgttaatgatgaggactacctgggccctgtgtgaagcactcacattggctaccggacccatctccactctgtgggagggcaatccagggcgcttttggaacacgacaatcgccgtttctatggcgaatattttccggggaagctatctagccggcgcaggtctgctcttttccataatgaaaaacaccgctaacactcgaagagggaccggaaatgccggcgagacacttggtgaaaagtggaagaacaggctgaatgcattgggcaaatcagagttccaaatctacaagaaatctgggattcaggaagtggaccgcactctggctaaggagggaatcaaacggggcgagaccgatcatcacgccgtaagtagagggtcggccaagctccgttggttcgtggaaaggaacctggtcacacctgagggaaaagttgtggacttaggctgcggtcgggggggatggagctattactgtggcggtcttaagaatgtcaaggaagtgaaaggcctgacgaaggggggacccggccatgaggaacctattccaatgtccacctatgggtggaacctcgtacgcctacagtctggagtggatgtttttttcactccccctgagaaatgcgacacactgttgtgtgatatcggcgagtcaagcccaaatcccaccgtggaagcgggtcgaactctgagagtcctcaaccttgtggagaattggctgaacaataacacacaattttgcataaaggtcttgaatccgtacatgccttccgtgatcgaaaaaatggaggctctgcagaggaagtacgggggagcactcgttcggaacccattaagtcgcaattctacccacgaaatgtattgggtaagcaacgcctcaggcaacattgtgtccagtgtcaatatgatcagcagaatgctgattaacaggttcacgatgcgacacaagaaagctacctacgagcccgacgtggatcttggctctgggacacggaatatcggaatagagtccgaaactcctaacctggacattatcggtaagcgtatcgagaaaattaagcaggaacatgagacctcatggcactatgatcaggaccatccatacaaaacatgggcctatcacggcagctacgaaactaagcaaaccgggtcggcatctagtatggttaatggagtggtcagactactcacaaagccctgggacgtgataccgatggtaacccagatggccatgactgatacgacaccttttggccagcagcgcgtgttcaaagagaaggttgacaccaggactcaagagcccaaagaaggtaccaagaaactgatgaagatcacagctgagtggttgtggaaggaactggggaaaaagaaaacgccacggatgtgtaccagagaggagtttgcgcgcaaggtcaggtccaacgccgcactcggagctattttcactgatgaaaataaatggaagagcgcccgagaggcagtggaagactcaggcttttgggagcttgtggataaagaacggaacctgcacttagagggcaagtgcgagacatgtgtctataatatgatggggaagagagaaaaaaagctgggagagttcggtaaagccaagggctccagggctatctggtacatgtggttgggggcccgctttctcgaattcgaggcgctgggatttctaaacgaagaccattggttctctcgtgagaatagccttagtggcgttgagggtgaagggctgcacaaactcggatacattctgcgggatgtgtccatgaaggagggcggcgcaatgtatgccgacgataccgctgggtgggacactagaatcacattggaagatctgaagaacgaggaaatggtaaccaatcatatggagggagagcacaaaaagctcgccgaagcaatattcaaacttacataccagaacaaggtggtcagggtgcagcgccctactccccgaggtaccgttatggacatcattagccggagagaccagaggggctctgggcaagtggtcacgtatggactgaatacctttacaaacatggaggctcagttaatccgccagatggaaggcgagggtgtgttcaaatcaattcaacagctgactgtaaccgaggaaatcgccgttaagaactggttggtgagagtcgggcgggagaggctcagtcgtatggctatttccggagatgactgcgtggtgaagccactggatgaccgatttgccagcgcactaacagcgcttaatgatatgggcaaagtccgcaaggacatacagcagtgggaaccctctagaggctggaacgattggactcaagttcctttctgctcgcatcactttcacgagctgatcatgaaagacgggcgggtgctcgtagtgccatgtaggaatcaggatgaactgattggacgcgccagaatctcacagggtgctggctggagcttgcgggagaccgcctgcttagggaagtcctacgcacagatgtggagtctgatgtatttccataggcgagacctccgtcttgctgccaacgcaatctgttctgccgtcccgagccactgggtgcccacgtccagaacaacctggtcaattcatgcgactcacgagtggatgacaaccgaagatatgctgactgtttggaatcgcgtgtggatacaagagaacccttggatggaagacaaaaccccagtcgagagttgggaagagatcccctacctaggaaagcgggaggatcagtggtgcggctctctgattggtctcacaagcagggctacgtgggccaagaatatccagaccgcaattaaccaggtgagatccttgatcgggaatgaagagtatactgactacatgccttcaatgaaacgctttcggagggaagaggaagaggccggagtactgtggtga

SEQ ID NO: 14954 - RNA, 9876 nt, synthetic construct
  misc_feature 1..9876: note = derived and/or modified CDS sequence (opt3) from DENV-2__KC762667__SS-prME
  source 1..9876: mol_type = other RNA
accgccggaatcattataatgatgatccccacagtgatggctttccacctgactacgagaaacggggagcctcatatgattgtaagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtaggcatgggtctggagactcggaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtgacaccatctatgaccatgagatgcatcggcatatcgaacagggactttgtcgaaggggtgtcaggaggtagctgggtagatattgttctggagcacggcagttgtgtgactacaatggccaaaaataagcccaccctcgacttcgaattaatcaagacggaggctaaacaccctgccaccctgcggaagtactgcattgaagcgaaacttacaaacactaccacagcatcccgctgtccaactcagggggagccctctttgaatgaggaacaagataagcgatttgtctgcaaacatagcatggtggacagaggatggggcaacggttgtgggctgttcggaaagggcggcatcgtgacctgcgccatgtttacatgcaagaaaaatatggaggggaagatcgtccagcctgaaaacctagagtataccattgttataactccacactccggagaagagaatgctgtgggtaacgatacgggcaaacatgggaaggagatcaaagtaacaccgcagtcaagtattaccgaagccgagctcactggatacggcaccgtgacaatggaatgtagccccaggaccggtctggacttcaatgagatggtccttctgcagatggaaaacaaggcatggttggtgcaccggcaatggtttctcgatctgcctttaccatggctgcccggggctgacactcagggctctaactggatccagaaagagacactcgttacgttcaagaatcctcacgccaagaaacaggatgtggtcgtgcttggatcccaagagggcgcgatgcataccgccctgactggggcaacagaaatacagatgtcaagcggaaacttgctatttaccggtcacctgaagtgccgtctccgcatggacaaactgcagcttaagggcatgagttattctatgtgtacagggaaattcaaggtagttaaggagattgctgaaactcaacatggaaccatcgtgatcagagtccagtacgagggcgacggttccccatgcaaaattcccttcgagatcatggatctggaaaagaggcacgtgttggggcggctcattacggtcaatccgatagtgaccgagaaagacagccctgttaacatcgaagccgagcccccatttggcgattcgtacattatcatcggagtggaacctggccagctgaagttatcttggttcaaaaaggggtcctcaattggacagatgtttgagacaactatgcgaggtgctaagcgcatggccatactgggcgacaccgcatgggatttcgggagtctaggaggcgtatttacaagcatcggtaaagccctccatcaagtcttcggggctatttatggcgcggcattttccggagtgtcttggactatgaagatcctgattggcgttgtgatcacctggatagggatgaatagcagatcaacgagtctttccgtcagcttggtgctggtaggagtggttacactctacctgggcgtcatggtgcaggccgactctggttgtgtggtctcatggaaaaacaaggagcttaaatgcgggagtggaatcttcattaccgataatgttcacacttggacagaacagtataagtttcagcccgagagcccatccaagctggcttctgccatccaaaaagcacacgaagagggcatttgtggtatcaggtcggtgacccggttggaaaacctcatgtggaagcagataactcccgagctgaatcatattttaagcgagaacgaagtgaaactgaccatcatgacaggcgacattaaggggatcatgcaggccggaaaacgctccctaagacctcagccaacggagctcaagtactcatggaaaacctggggcaaggctaagatgctgagtactgaacttcacaatcatacattcttgatagatgggccggagaccgccgaatgccccaacgcaaatagggcgtggaactctctggaggtagaggactatggatttggcgtcttcacaactaatatctggctcaaactgaaggaacgtcaagatgctttttgtgacagcaaattaatgtccgccgcaattaaggacaaccgggccgtgcacgctgatatgggttactggatcgagtcagccctgaacgacacctggaaaattgaaaaggccagcttcatcgaggttaagtcttgccactggcctaaatcccatacgctttggagtaatggggtgttggagagcgaaatgataattccaaagaacttcgctggacccgtctctcagcacaattatcgacctggctaccatacacagaccgccggtccatggcacctcggcagactggagatggattttgacttctgtgaagggactaccgtggttgtgacagaggattgcggaaacaggggcccctccctacgcactaccacagcgtcagggaaactgatcacggaatggtgctgtcggagttgcaccctcccgcctctgagatacaggggagaggacggctgttggtatggtatggagatccgcccacttaaggaaaaagaggaaaatttggtaaacagcctggtcactgccgggcatggacagattgataatttttcgttaggcgtgctcggtatggctctgttccttgaggaaatgctgcgaacacgggtgggcaccaagcacgcaatcttgctcgtcgccgtttcctttgtgactctgattacagggaacatgtctttccgtgacctaggaagagtaatggtgatggtcggcgctaccatgacggatgacatagggatgggagtgacttacctggccctcctggcagcgtttaaggttaggcccaccttcgccgctggccttttgctgcgcaaattaacaagcaaggagctcatgatgaccactatcggtgtgacactgctttcacaaagtaccattcctgagacaatcctggaactaactgatgccctcgcactggggatgatggtcttgaaaattgtgcggaatatggagaagtatcagctggctgttaccatcatggccatattatgcgtgcccaacgcagtcatcctccagaatgcctggaaagtatcctgtacgacactggctgtggtttctgtgagcccacttctgttgacctcctcacaacagaaggcggactggattcctctcgccctgactatcaagggactaaaccccaccgcaatttttctgacaactcttagcagaaccagtaaaaagaggtcttggccactcaatgaagctatcatggccgtcggcatggtgtccatactggccagctcgttgctgaaaaacgatattccgatgacgggccctttagtagctgggggactcctgacagtgtgctacgtccttaccggtcgatcagcagacctggagttggaacgcgccgcggacgttcggtgggaggagcaggctgaaatctctggcagttcccccatcctcagcattactatatctgaggatgggagcatgtccatcaagaatgaagaggaggaacagacactgaccattctaatcagaactggactgcttgtgatttcaggcctcttcccagtgagtatccccataacagccgcagcctggtatctgtgggaggtcaaaaagcaaagggctggtgtgttgtgggacgttcctagcccaccccctgtagggaaagcagaattagaggatggagcctaccgtatcaagcagaagggcattctgggctattctcagatcggggcgggagtgtacaaagaaggtacctttcacacgatgtggcatgtcactcgcggcgctgtgctcatgcacaaggggaaacggattgagccgtcctgggccgacgttaagaaagatctgatctcatacggaggcggttggaaacttgagggggaatggaaggagggagaagaggtgcaggtcctggcattggaaccaggcaaaaaccccagagccgtgcaaaccaagcctggcctattcaaaacaagtaccgggacaataggagctgtaagcctggacttttccccaggtacttctggctcgcccattgtcgataagaaagggaaggtggttggactctatggcaacggtgtggtcaccaggagcgggacgtacgtgtcagccatcgcacagacagagaagtccatcgaggacaatcctgaaattgaggatgacatcttcagaaagaaacggctgactataatggatcttcatccgggagctggcaaaaccaagcgctatttacccgccattgttagagaagcgatcaaaaggggcctgcggacactcattttggccccaacccgagtggtcgcagctgagatggaagaggccctgagagggctccctatccgctaccagactcccgctataagggcagagcacaccggacgtgaaattgtggacctgatgtgtcatgccacattcacgatgcggcttctgagtccaatcagagtacctaactataatttgatcattatggatgaggcccactttactgaccccgcttctatcgcggcaaggggttacattagcacccgcgtggaaatgggcgaggccgctgggatattcatgacagccaccccaccgggatcccgagacccttttccccagtcaaacgcaccaatcatggatgaggaaagagagattcccgaacggtcttggaatagcggccacgagtgggttactgacttcaagggtaagacagtctggtttgtgcctagtatcaaagccgggaacgatatcgctgcgtgcctaaggaagaatggcaaaaaggtgattcaactgtcccgcaaaaccttcgactttgaatatataaagacgcgtactaacgattgggacttcgtcgtaacaaccgatatcagcgagatgggcgccaattttaaggcagagagagtgattgacccacggaggtgtatgaaacccgttatcctcaccgatggcgaagaacgcgtgattttagctgggcctatgccggtcactcattcttcagccgcacagcgaagaggacgggtgggtaggaacccaaagaatgaaaacgaccagtacatctacatgggcgagcccctggaaaatgatgaggactgcgcccactggaaagaggctaagatgcttctggacaacataaatacacctgaagggatcattccctccatgttcgagccagaacgcgagaaagttgatgccatcgacggagaatatagactcaggggcgaggcgcggaagacctttgtggatttgatgcgtcgcggtgacctgcctgtctggctcgcataccgagtggccgctgaggggattaactatgccgatagaaggtggtgtttcgacggcgtcaaaaacaatcaaatcctggaagagaacgtggaagttgagatatggacaaaggagggagaacggaagaaacttaagccccgctggctagatgctagaatttacagtgacccactggcattgaaagagttcaaggaatttgccgctggcaggaagtcgttaactctgaatctcatcacggagatggggcggctgcctaccttcatgacacagaaggcccgaaacgcacttgataatctggcggtcctccatactgccgaagctggaggtagagcctataaccacgcattgagcgagctgccggagaccctagaaacactgctccttctgaccttattggctactgtgacgggcgggatttttctgttcctcatgtctggaaagggcatcggtaaaatgaccctggggatgtgctgcataatcacagcctccattcttctgtggtacgcacagatccagccccactggattgccgctagcatcatactcgagtttttcttgattgtgctgttaatcccagaacctgagaagcaacgcactccccaggacaatcagctaacctatgtcgttatcgcgattctgacagtggtagccgcaaccatggctaacgaaatgggctttctcgagaaaactaagaaagatttcggacttggctcaatcacaacgcagcaaccagagagtaatatactggacattgatttgaggcctgcctctgcctggaccctgtacgcagtggctactacatttatcacccccatgctccggcattccattgaaaacagctcagtcaatgtgagtctgaccgccatcgcgaaccaggctacagttcttatggggctcggaaagggttggccgctgagcaagatggacataggcgtgccattgctggccatcgggtgttactcccaggtcaatcctattactttaacggcagccctactgctccttgtagctcactatgcaatcattggacccggcctgcaggccaaagcgacccgtgaggctcaaaagagagccgcagccggtatcatgaaaaacccaacagtggacgggattactgttatcgatttggaccccataccttacgatccgaagttcgaaaaacagctgggccaggtgatgctcctggtcctttgcgtgacccaggtcttaatgatgaggacaacctgggctctgtgtgaggccctcactttggcaacgggacccatttctacactgtgggaaggcaatccagggcgcttttggaacaccactatcgctgtgagcatggccaatatcttccggggatcctatctagcgggcgccggtctgctcttttcaattatgaagaacaccgcaaacacacgaagagggactggaaataccggcgagacacttggtgagaagtggaaaaacaggctgaatgctttgggcaagtctgagttccaaatatacaaaaagagtgggatccaggaggttgaccgcacgctggccaaagaaggaattaagcggggcgagaccgatcatcacgcagtgtcgagagggagcgctaaactccgttggttcgtagagaggaacctggtgactcctgaaggaaaggtcgttgacttaggctgcggtagagggggatggtcctattactgtggcggtcttaagaatgtgaaagaggtcaagggcctgacaaaagggggacccggccatgaagaacctatcccaatgtctacctatgggtggaacctcgtgcgcctacagtcaggagtagatgtgtttttcactccccctgaaaagtgcgacacactgttgtgtgatattggcgagagctccccaaatcccaccgttgaggccggtcgaacgctgagagtgctcaaccttgtcgaaaattggctgaacaataacacccaattttgcatcaaagtgttgaatccgtacatgcctagtgtcatagagaagatggaagccctgcagaggaagtacgggggagcgctcgtgcggaacccattatctcgcaatagcacacacgagatgtattgggtttcaaacgcttccggcaacatcgtaagtagcgtgaatatgatttctagaatgctgatcaacaggttcactatgcgacacaaaaaggcaacctacgaacccgacgtcgatcttggctccgggacacggaatattggaatcgagtcagagactcctaacctggacataattggtaaacgtatcgaaaagatcaaaagagagcatgaaaccagctggcactatgatcaggaccatccatacaagacatgggcctatcacggctcgtacgagaccaagcagactgggtctgctagttccatggtgaatggagttgtgcgcctactcacgaaaccctgggacgtcattccgatggtgacacaaatggccatgaccgatactaccccttttggccagcagagggtattcaaggaaaaagtggacacacggacgcaggagcccaaggagggtaccaaaaagctgatgaagataactgcagaatggttgtggaaagagctggggaagaaaaagacaccaagaatgtgtacccgcgaagagtttactaggaaagttcgaagcaacgccgctctcggagcgatcttcacagatgagaataagtggaaatcagcccgggaagcagtcgaggactccggcttttgggaacttgtggataaggagagaaacctgcacttagaaggcaagtgcgagacctgtgtgtataatatgatggggaaaagggagaagaaactgggagagttcggtaaggctaaaggctctcgcgccatttggtacatgtggttgggggcacgttttctcgagttcgaagccctgggatttctaaacgaggaccattggttcagccgggaaaatagtctttccggcgtcgagggtgaggggctgcacaagctcggatacatcctgagagatgttagcaagaaagaaggcggcgctatgtatgccgacgatacagcggggtgggacactaggattaccttggaggatctgaagaacgaagagatggtgacgaatcatatggaaggagagcacaaaaagctcgcagaggccatcttcaaacttacctaccaaaacaaggtagtgcgcgtccagcgacctacaccccggggtactgtgatggacataatctctagaagggaccagcgcggctcagggcaggttgtgacctatggactgaatacatttactaacatggaagctcaattaattagacagatggagggcgaaggtgtcttcaagagtatccagcatctgaccgtgacggaggagattgccgtcaaaaactggttggttcgggtggggagggaacgtctctcccgaatggcaatcagcggagatgactgcgtcgtgaagccactggatgaccgctttgcttctgccctaacagctcttaatgatatgggcaaagtgagaaaggacattcaacagtgggagccctcgcggggctggaacgattggacccaggtccctttctgctcacaccactttcatgaactgataatgaaagacgggagggttctcgtggtaccatgtcgcaatcaggatgagctgatcggacgagcacggattagccaaggtgcaggctggtccttgagggaaactgcgtgcttagggaagagttacgcccagatgtggtctctgatgtatttccaccgacgtgacctcagacttgctgccaacgcaatctgtagcgctgtgccgtcccattgggtccccacatcacgcaccacttggagtatccacgccacccacgagtggatgacaacggaggatatgctgaccgtgtggaatcgggtttggattcaggaaaacccttggatggaggacaagactccagtggaatcttgggaggaaataccctacctaggaaaaagggaggatcagtggtgcggcagcctgatcggtctcacatccagagcaacctgggccaagaatattcaaactgcgatcaaccaggtccgctcattgattgggaatgaggaatatacagactacatgcctagcatgaaacggtttaggcgagaggaagaggaagctggagtgctgtggtga

SEQ ID NO: 14955 - RNA, 9876 nt, synthetic construct
  misc_feature 1..9876: note = derived and/or modified CDS sequence (opt3) from DENV-2__KC762659__SS-prME
  source 1..9876: mol_type = other RNA
accgccggaatcattataatgatgatccccacagtgatggctttccacctgactacgagaaatggggagcctcatatgattgtcagcaggcaggaaaagggaaaatccctcctttttaagaccgagaatggtgttaacatgtgcacactgatggcaatggacttgggagaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtgacaccatctatgaccatgagatgcatcggcatatcgaacagggactttgtcgaaggggtgtcaggaggtagctgggtagatattgttctggagcacggcagttgtgtgactacaatggccaaaaataagcccaccctcgacttcgaattaatcaagacggaggctaaacaccctgccaccctgcggaagtactgcattgaagcgaaacttacaaacactaccacagcatcccgctgtccaactcagggggagccctctttgaatgaggaacaagataagcgatttgtctgcaaacatagcatggtggacagaggatggggcaacggttgtgggctgttcggaaagggcggcatcgtgacctgcgccatgtttacatgcaagaaaaatatggaggggaaggtcgttcagcctgaaaacctagagtataccatcgtgattactccacactccggagaagagaatgctgtaggtaacgatacgggcaaacatgggaaggagataaaagtgacaccgcagtcaagtatcaccgaagccgagctcactggatacggcaccgtcacaatggaatgtagccccaggaccggtctggacttcaatgagatggtgcttctgcagatggaaaacaaggcatggttggttcaccggcaatggtttctcgatctgcctttaccatggctgcccggggctgacactcagggctctaactggattcagaaagagacactcgtgacgttcaagaatcctcacgccaagaaacaggatgtcgtggtacttggatcccaagagggcgcgatgcataccgccctgactggggcaacagaaatccagatgtcaagcggaaacttgctatttaccggtcacctgaagtgccgtctccgcatggacaaactgcagcttaagggcatgagttattctatgtgtacagggaaattcaaggttgtgaaggagatagctgaaactcaacatggaaccattgtcatcagagtgcagtacgagggcgacggttccccatgcaaaatccccttcgagattatggatctggaaaagaggcacgtcttggggcggctcatcacggtgaatccgattgttaccgagaaagacagccctgtgaacatagaagccgagcccccatttggcgattcgtacatcattatcggagtagaacctggccagctgaagttatcttggttcaaaaaggggtcctcaatcggacagatgtttgagacaactatgcgaggtgctaagcgcatggccattctgggcgacaccgcatgggatttcgggagtctaggaggcgtctttacaagcataggtaaagccctccatcaagtgttcggggctatctatggcgcggcattttccggagtttcttggactatgaagattctgatcggcgtggtcattacctggatcgggatgaatagcagatcaacgagtctttccgtgagcttggtactggtgggagttgtcacactctacctgggcgtgatggtgcaggccgactctggttgtgtcgtttcatggaaaaacaaggagcttaaatgcgggagtggaatattcatcaccgataatgtgcacacttggacagaacagtataagtttcagcccgagagcccatccaagctggcttctgccattcaaaaagcacacgaagagggcatctgtggtattaggtcggtgacccggttggaaaacctcatgtggaagcagatcactcccgagctgaatcatatattaagcgagaacgaagtaaaactgaccattatgacaggcgacatcaaggggattatgcaggccggaaaacgctccctaagacctcagccaacggagctcaagtactcatggaaaacctggggcaaggctaagatgctgagtactgaacttcacaatcatacattcttgatcgatgggccggagaccgccgaatgccccaacacaaatagggcatggaactctctggaggtcgaggactatggatttggcgtgttcactaccaatatatggctcaaactgaaggaacgtcaagatgtattttgtgacagcaaattaatgtccgcggctatcaaggacaaccgggccgtgcacgcagatatgggttactggatggagtcagccctgaacgacacgtggaaaattgaaaaggctagcttcatcgaggtcaagtcttgccactggcctaaatcccatacactttggagtaatggggtgttggagagcgaaatgattatcccaaagaacttcgccggacccgtttctcagcacaattatcgacctggctaccatacccagactgcaggtccatggcacctcggcagactggagatggattttgacttctgtgaagggaccacagtggtagtcactgaggattgcggaaacaggggcccctccctacgcaccacaacggcttcagggaaactgataaccgaatggtgctgtcggagttgcactctcccgcctctgagatacaggggagaggacggctgttggtatggtatggagattcgcccacttaaggaaaaagaggaaaatttggtgaacagcctggtgacagccgggcatggacagatcgataatttttcgttaggcgtcctcggtatggcgctgttccttgaggaaatgctgcgaacccgggttggcactaagcacgccatcttgctcgtggctgtatcctttgtgacactgattaccgggaacatgtctttccgtgacctaggaagagtcatggtgatggttggcgcaacgatgactgatgacatcgggatgggagtgacctacctggccctcctggctgcctttaaggtcaggcccacattcgcagcgggccttttgctgcgccggttaaccagcaaagagctcatgatgactacaattggtatagtgctgctttcacaaagtaccatccctgagacaattctggaactaactgatgccctcgctctggggatgatggttttgaagatcgtgagaaaaatggagaagtatcagctggccgtcaccattatggcaatcttatgcgtacccaatgctgtgatactccagaacgcctggaaagtttcctgtacgacactggcagtggtctctgtgagcccacttctgttgacctcctcacaacagaaggccgactggatccctctcgctctgactattaagggactaaatcccaccgcgatctttctgacaactcttagcaggaccagtaaaaagcgatcttggccactcaacgaagccattatggcagtaggcatggtgtccatcctggctagctcgttgctgaaaaatgatataccgatgacgggccctttagtcgccgggggactcctgacagtttgctacgtgcttaccggtcgctcagccgacctggagttggaacgggctgcagacgtgagatgggaggagcaggccgaaatttctggcagttcccccatcctcagcatcactatttctgaggatgggagcatgtccataaagaacgaagaggaggaacagacactgaccatcctaattaggactggactgcttgtcatctcaggcctcttcccagtgagtattcccatcacagcggctgcctggtatctgtgggaggttaaaaagcaacgtgccggtgttttgtgggacgtgcctagcccaccccctgtcgggaaagcagaattagaggatggagcttaccgcataaagcagaagggcatcctgggctattctcagattggggcaggagtgtacaaagaaggtacctttcacacgatgtggcatgttactcggggcgccgtgctcatgcacaaggggaaaagaatcgagccgtcctgggcggacgtcaagaaagatctgatttcatacggaggcggttggaaacttgagggggaatggaaggagggagaagaggtgcaggtactggctttggaaccaggcaaaaatcccagggccgtccaaaccaagcctggcctattcaaaacaaacaccgggacaatcggagcagtgagtctggactttagcccaggtacttccggctctcccatagttgataagaaagggaaggtggtcggactctatggcaacggtgtggttacccgatcggggacgtacgtgagcgccattgctcagacagagaagtcaatcgaggacaatcctgaaatcgaggatgacattttccggaaaaagcgcctgactatcatggatcttcatccgggagccggcaaaaccaagagatatttacccgcaatagtcagggaagctattaaacggggcctgcgaacactcatcttggccccaaccagagtggtagcggccgagatggaagaggcactgcgcgggctccctattaggtaccagactcccgctatccgtgccgagcacaccggacgggaaatagtggacctgatgtgtcatgctacattcacgatgagacttctgtccccaattagggttcctaactataatttgatcatcatggatgaggcacactttactgaccccgccagtattgccgctcgcggttacatctctacccgagtcgaaatgggcgaggcggcagggattttcatgacagccaccccaccgggaagcagagacccttttccccagtccaacgctccaataatggatgaggaacgggagatccccgaaaggtcatggaactctggccacgagtgggtgactgacttcaagggtaagacagtgtggtttgtccctagcattaaagccgggaacgatatcgcagcctgcctacgcaagaatggcaagaaggtaatccaactgagtcgtaaaaccttcgactttgaatatattaagacgagaactaacgattgggacttcgtggttacaaccgatatatccgagatgggcgctaattttaaggcggagcgggtgatcgacccaaggcgctgtatgaaacccgtcattctcaccgatggcgaagaacgagtgatcttagccgggcctatgccggttactcatagctctgcagctcagagacggggaagggtgggtcgcaacccaaagaatgaaaacgaccagtacatttacatgggcgagcccctggaaaatgatgaggactgcgcccactggaaagaggcaaagatgcttctggacaacatcaatacacctgaagggataatcccctcaatgttcgagccagaaagagagaaagtcgatgccattgacggagaatataggctccggggcgaggctcgtaagacctttgtggatttgatgcgccgaggtgacctgcctgtatggctcgcctacagagtggcggcagaggggatcaactatgccgataggcggtggtgtttcgacggcgttaaaaacaatcaaattctggaagagaacgtcgaagtggagatctggacaaaggagggagaacgcaagaaacttaagcccagatggctagatgctaggatatactccgacccactggccttgaaagagttcaaggaatttgctgcaggccggaaaagtttaactctgaatctcattacggagatggggcgactgcctaccttcatgacacagaaggccagaaacgctcttgataatctggccgtgctccatactgcagaagcgggaggtcgcgcctataaccacgctttgagcgagctgccggagaccctagaaacactgctccttctgaccttattggccactgtcacgggcgggatctttctgttcctcatgtcgggaaagggcattggtaaaatgaccctggggatgtgctgcatcataacagcatctatccttctgtggtacgctcagattcagccccactggatcgccgcatccattatcctcgagtttttcttgatagttctgttaattccagaacctgagaagcaaaggactccccaggacaatcagctaacctatgtggtaatcgccatcctgacagtggtcgctgcgaccatggccaacgaaatgggctttctcgagaaaactaagaaagatttcggacttggcagcattacaacgcagcaatcagagagtaatatcctggacatagatttgcggccagcatctgcttggaccctgtacgccgtggccactacatttattacccctatgctccgtcattccatcgaaaacagctcagttaatgtgagtctgaccgcaattgctaaccaggccacagtccttatggggctcggaaagggttggcccctgagcaagatggacatcggcgtaccgttgctggcgatagggtgttactcccaggtgaatccaatcactttaacggctgccctactgctccttgttgcacactatgccattatcggacctggcctgcaggctaaagcaaccagagaggcccaaaagagggcggctgccggtattatgaaaaaccccacagtggacgggatcactgtcattgatttggacccaatcccctacgatcctaagttcgaaaaacagctgggccaggtgatgctcctggtcctttgcgtgacccaggttttaatgatgcgcacaacctgggcactgtgtgaggccctcactttggctacgggaccgatatctacactgtgggaaggcaatcccgggcggttttggaacaccactattgccgtgagcatggcaaatatcttccgaggatcctatctagctggcgccggtctgctcttttcaatcatgaagaacaccgcgaacacaagaagggggactggaaataccggcgagacacttggtgagaagtggaaaaaccgcctgaatgccttgggcaagtctgagttccaaatttacaaaaagagtgggatacaggaggtagaccggacgctggcaaaagaaggaatcaagagaggcgagaccgatcatcacgctgtgtcgcgtgggagcgccaaactcaggtggttcgtcgagcggaacctggttactccagaaggaaaggtggtcgacttaggctgcggtcgcgggggatggtcctattactgtggcggtcttaagaatgtgaaagaggtaaagggcctgacaaaagggggacctggccatgaagaacccattcctatgtctacctatgggtggaacctcgtgcgactacagtcaggagttgatgtgtttttcactccacccgaaaagtgcgacacactgttgtgtgatatcggcgagagctcccctaatccaaccgtcgaggcaggtagaacgctgagggtgctcaaccttgtcgaaaattggctgaacaataacacccaattttgcattaaagtgttgaatccctacatgccgagtgttatcgagaagatggaagctctgcagcggaagtacgggggagccctcgtacgcaaccctttatctagaaatagcacacacgagatgtattgggtgtcaaacgcctccggcaacatagtcagtagcgtgaatatgatctctaggatgctgattaaccgattcactatgcggcacaaaaaggcgacctacgaaccagacgttgatcttggctccgggacacgtaatatcggaattgagtcagagactcccaacctggacatcataggtaaaagaattgaaaagatcaaacaggagcatgaaaccagctggcactatgatcaggaccatccttacaagacatgggcttatcacggctcgtacgagaccaagcaaactgggtctgcaagttccatggtgaatggagtcgtgcgcctactcacgaaaccatgggacgtaatccccatggtgacacagatggccatgaccgatactaccccgtttggccagcagagggttttcaaggaaaaagtcgacacacggacgcaagagcctaaggagggtaccaaaaagctgatgaagattactgctgaatggttgtggaaagagctggggaagaaaaagacacccagaatgtgtacccgcgaagagtttactaggaaagtgcgaagcaacgccgcactcggagccatattcacagatgagaataagtggaaatcagctcgggaagcggtggaggactccggcttttgggaacttgtcgataaggagagaaacctgcacttagaaggcaagtgcgagacctgtgtttataatatgatggggaaaagggagaagaaactgggagagttcggtaaggccaaaggctctcgcgcaatctggtacatgtggttgggggctcgttttctcgagttcgaagccctgggatttctaaacgaggaccattggttcagccgggaaaatagtctttccggcgtggagggtgaggggctgcacaagctcggatacattctgagagatgtaagcaagaaagaaggcggcgcaatgtatgccgacgatacagctgggtgggacactaggatcaccttggaggatctgaagaacgaagagatggtgacgaatcatatggaaggagagcacaaaaagctcgccgaggcgattttcaaacttacctaccagaacaaggtcgtgcgcgttcagcgaccaacacctcggggtactgtgatggacatcatatctagaagggaccagcgcggctcagggcaagtcgtgacctatggactgaatacatttactaacatggaagcacagttaatcagacagatggagggcgaaggtgtattcaagagtattcaacagctgaccgccacggaggagatcgctgttaaaaactggttggtgcgggtcgggagggaacgtctctcccgaatggccattagcggagatgactgcgtggtgaagcccctggatgaccgctttgcatctgctctaacagcccttaatgatatgggcaaagtcagaaaggacatccagcagtgggagccatcgcggggctggaacgattggacccaagttcccttctgctcacatcactttcacgaactgattatgaaagacgggagggtgctcgtagtgccttgtcgcaatcaggatgagctgataggcagagctcggatcagccagggtgccggctggtccttgagggaaactgcatgcttagggaagagttacgcgcagatgtggtctctgatgtatttccatcgacgtgacctcagacttgccgctaacgccatttgtagcgcagtcccatcccactgggtgccgacatcacgcaccacttggagtatccatgctacccacgagtggatgacaacggaggatatgctgaccgtttggaatcgggtgtggatccaagaaaacccctggattgaggacaagactcctgtcgaatcttgggaggaaataccatacctaggaaaaagggaggatcagtggtgcggcagcctgatcggtctcacatccagagccacctgggcaaagaatattcagactgccatcaaccaggtgcgctcattgattgggaatgaggaatatacagactacatgcccagcatgaaacggtttaggcgagaggaagaggaagcgggagtactgtggtga

SEQ ID NO: 14956 - RNA, 9876 nt, synthetic construct
  misc_feature 1..9876: note = derived and/or modified CDS sequence (opt3) from DENV-2__KC762657__SS-prME
  source 1..9876: mol_type = other RNA
accgccggaatcattataatgatgatccccacagtgatggtattccacctgactacgagaaatggggagcctcatatgattgttagcaggcaggaaaagggaaaatccctcctttttaagaccgagaatggtgtgaacatgtgcacactgatggctatggacttgggcgaattatgtgaggatactatcacctacaattgcccactgctacggcaaaacgaaccggaggacattgattgttggtgcaattctacatcaacctgggtaacttatgggacatgtaccgcaacgggagagcaccgccgagaaaaacgtagtgtggccctcgtcccccatgtgggcatgggtctggagactagaaccgaaacatggatgagctccgagggggcgtggaagcacgctcagaggatcgagacttgggttcttcggcatcctggattcaccataatggccgcaatcctggcctacacaattggcaccacgtattttcagcgcgtgttgatcttcattctcctgactgctgtcacaccatctatgaccatgagatgcatcggcatatcgaacagggactttgtggaaggggtatcaggaggtagctgggttgatattgtgctggagcacggcagttgtgtcactacaatggccaagaataagcccaccctcgacttcgaattaatcaagacggaggccaaacaccctgctaccctgcggaagtactgcattgaagccaaacttacaaacactaccacagcgtcccgctgtccaactcagggggagccctctttgaatgaggaacaagataagcgatttgtgtgcaaacatagcatggtggacagaggatggggcaacggttgtgggctgttcggaaagggcggcatcgtaacctgcgcaatgtttacatgcaagaaaaatatggaggggaaggttgtgcagcctgaaaacctagagtataccatcgtaattactccacactccggagaagagaatgccgtgggtaacgatacgggcaaacatgggaaggagataaaagtcacaccgcagtcaagtatcaccgaagctgagctcactggatacggcaccgtgacaatggaatgtagccccaggaccggtctggacttcaatgagatggttcttctgcagatggaaaacaaggcctggttggtgcaccggcaatggtttctcgatctgcctttaccatggctgcccggggcagacactcagggctctaactggattcagaaagagacactcgtcacgttcaagaatcctcacgctaagaaacaggatgtggtagttcttggatcccaagagggcgccatgcataccgcgctgactggggccacagaaatccagatgtcaagcggaaacttgctatttaccggtcacctgaagtgccgtctccgcatggacaaactgcagcttaagggcatgagttattctatgtgtacagggaaattcaaggtggtcaaggagatagcagaaactcaacatggaaccattgtgatcagagtccagtacgagggcgacggttccccatgcaaaatccccttcgagattatggatctggaaaagaggcacgtgttggggcggctcatcacggttaatccgattgtgaccgagaaagacagccctgtaaacatagaagctgagcccccatttggcgattcgtacatcattatcggagtcgaacctggccagctgaagttatcttggttcaaaaaggggtcctcaatcggacagatgtttgagacaactatgcgaggtgccaagcgcatggctattctgggcgacaccgcctgggatttcgggagtctaggaggcgtgtttacaagcataggtaaagcactccatcaagttttcggggccatctatggcgctgcgttttccggagtgtcttggactatgaagattctgatcggcgtcgtgattacctggatcgggatgaatagcagatcaacgagtctttccgtcagcttggtgctggttggagtcgtgacactctacctgggcgtgatggtccaggcagactctggttgtgttgtgtcatggaaaaacaaggagcttaaatgcgggagtggaatattcatcaccgataatgtgcacacttggacagaacagtataagtttcagcccgagagcccatccaagctggcctctgctattcaaaaagcccacgaagagggcatctgtggtattaggtcggtaacccggttggaaaacctcatgtggaagcagatcactcccgagctgaatcatatattaagcgagaacgaagtcaaactgaccattatgacaggcgacatcaaggggattatgcaggcaggaaaacgctccctaagacctcagccaacggagctcaagtactcatggaaaacctggggcaaggccaagatgctgagtactgaacttcacaatcatacattcttgatcgatgggccggagaccgctgaatgccccaacacaaatagggcctggaactctctggaggtggaggactatggatttggcgttttcactaccaatatatggctcaaactgaaggaacgtcaagatgtgttttgtgacagcaaattaatgtccgcagcgatcaaggacaaccgggctgtccacgccgatatgggttactggatggagtcagcactgaacgacacgtggaaaattgaaaaggccagcttcatcgaggtgaagtcttgccactggcctaaatcccatacactttggagtaatggggttttggagagcgaaatgattatcccaaagaacttcgctggacccgtgtctcagcacaattatcgacctggctaccatacccagactgccggtccatggcacctcggcagactggagatggattttgacttctgtgaagggaccacagtagtcgtgactgaggattgcggaaacaggggcccctccctacgcaccacaacggcatcagggaaactgataaccgaatggtgctgtcggagttgcactctcccgcctctgagatacaggggagaggacggctgttggtatggtatggagattcgcccacttaaggaaaaagaggaaaatttggtgaacagcctggtcacagctgggcatggacagatcgataatttttcgttaggcgttctcggtatggccctgttccttgaggaaatgctgcgaacccgggtgggcactaagcacgcgatcttgctcgtagccgtgtcctttgtcacactgattaccgggaacatgtctttccgtgacctaggaagagtgatggttatggtgggcgctacgatgactgatgacatcgggatgggagtcacctacctggcactcctggccgcttttaaggtgaggcccacattcgccgcaggccttttgctgcgccggttaaccagcaaagagctcatgatgactacaattggtatagttctgctttcacaaagtaccatccctgagacaattctggaactaactgatgcgctcgccctggggatgatggtgttgaagatcgtcagaaaaatggagaagtatcagctggctgtaaccattatggccatcttatgcgtgcccaatgcagttatactccagaacgcttggaaagtgtcctgtacgacactggccgtcgtgtctgtaagcccacttctgttgacctcctcacaacagaaggcagactggatccctctcgccctgactattaagggactaaatcccaccgctatctttctgacaactcttagcaggaccagtaaaaagcgatcttggccactcaacgaagcgattatggccgtgggcatggtctccatcctggcaagctcgttgctgaaaaatgatataccgatgacgggccctttagttgctgggggactcctgacagtgtgctacgtgcttaccggtcgctcagccgacctggagttggaacgggccgctgacgtcagatgggaggagcaggcagaaatttctggcagttcccccatcctcagcatcactatttctgaggatgggagcatgtccataaagaacgaagaggaggaacagacactgaccatcctaattaggactggactgcttgtgatctcaggcctcttcccagttagtattcccatcacagccgcggcttggtatctgtgggaggtcaaaaagcaacgtgccggtgtgttgtgggacgtccctagcccaccccctgtggggaaagcagaattagaggatggagcctaccgcataaagcagaagggcatcctgggctattctcagattggggctggagtttacaaagaaggtacctttcacacgatgtggcatgtgactcggggcgcagtcctcatgcacaaggggaaaagaatcgagccgtcctgggccgacgtgaagaaagatctgatttcatacggaggcggttggaaacttgagggggaatggaaggagggagaagaggtacaggtcctggcgttggaaccaggcaaaaatcccagggctgtgcaaaccaagcctggcctattcaaaacaaacaccgggacaatcggagccgttagtctggactttagcccaggtacttccggctctcccatagtggataagaaagggaaggtcgtgggactctatggcaacggtgttgtgacccgatcggggacgtacgtcagcgcaattgcccagacagagaagtcaatcgaggacaatcctgaaatcgaggatgacattttccggaaaaagcgcctgactatcatggatcttcatccgggagctggcaaaaccaagagatatttacccgccatagtgagggaagcaattaaacggggcctgcgaacactcatcttggctccaaccagagtagtggccgcggagatggaagaggccctgcgcgggctccctattaggtaccagactcccgcaatccgtgctgagcacaccggacgggaaatagttgacctgatgtgtcatgccacattcacgatgagacttctgtccccaattagggtccctaactataatttgatcatcatggatgaggctcactttactgaccccgcaagtattgccgcccgcggttacatctctacccgagtggaaatgggcgaggctgcggggattttcatgacagcaaccccaccgggaagcagagacccttttccccagtccaacgccccaataatggatgaggaacgggagatccccgaaaggtcatggaactctggccacgagtgggtgactgacttcaagggtaagacagtctggtttgtacctagcattaaagctgggaacgatatcgccgcatgcctacgcaagaatggcaaaaaggtgatccaactgagtcgtaaaaccttcgactttgaatatattaagacgagaactaacgattgggacttcgttgtgacaaccgatatatccgagatgggcgccaattttaaggctgagcgggtcatcgacccaaggcgctgtatgaaacccgtgattctcaccgatggcgaagaacgagttatcttagcggggcctatgccggtgactcatagctctgccgcacagagacggggaagggtcggtcgcaacccaaagaatgaaaacgaccagtacatttacatgggcgagcccctggaaaatgatgaggactgcgctcactggaaagaggccaagatgcttctggacaacatcaatacacctgaagggataatcccctcaatgttcgagccagaaagagagaaagtggatgcaattgacggagaatataggctccggggcgaggcccgtaagacctttgtagatttgatgcgccgaggtgacctgcctgtgtggctcgcttacagagttgccgcggaggggatcaactatgcagataggcggtggtgtttcgacggcgtcaaaaacaatcaaattctggaagagaacgtggaagtggagatctggacaaaggagggagaacgcaagaaacttaagcccagatggctagatgccaggatatactccgacccactggctttgaaagagttcaaggaatttgccgctggccggaaaagtttaactctgaatctcattacggagatggggcgactgcctaccttcatgacacagaaggcaagaaacgcccttgataatctggctgtcctccatactgccgaagcaggaggtcgcgcgtataaccacgccttgagcgagctgccggagaccctagaaacactgctccttctgaccttattggctactgttacgggcgggatctttctgttcctcatgtcgggaaagggcattggtaaaatgaccctggggatgtgctgcatcataacagcctctatccttctgtggtacgcacagattcagccccactggatcgctgcctccattatcctcgagtttttcttgatagtgctgttaattccagaacctgagaagcaaaggactccccaggacaatcagctaacctatgtagtgatcgcaatcctgacagtcgtggccgctaccatggcgaacgaaatgggctttctcgagaaaactaagaaagatttcggacttggcagcattacaacgcagcaatcagagagtaatatcctggacatagatttgcggccagcctctgcatggaccctgtacgctgttgccactacatttattacccctatgctccgtcattccatcgaaaacagctcagtgaatgtcagtctgaccgccattgcaaaccaggctacagtacttatggggctcggaaagggttggcccctgagcaagatggacatcggcgtgccgttgctggccatagggtgttactcccaggttaatccaatcactttaacggcggctctactgctccttgtggcccactatgcaattatcggacctggcctgcaggccaaagctaccagagaggcacaaaagagggccgcggctggtattatgaaaaaccccacagtcgacgggatcactgtgattgatttggacccaatcccctacgatcctaagttcgaaaaacagctgggccaggtcatgctcctggtgctttgcgttacccaggtgttaatgatgcgcacaacctgggccctgtgtgaggcactcactttggccacgggaccgatatctacactgtgggaaggcaatcccgggcggttttggaacaccactattgctgtaagcatggccaatatcttccgaggatcctatctagcaggcgctggtctgctcttttcaatcatgaagaacaccgccaacacaagaagggggactggaaataccggcgagacacttggtgagaagtggaaaaaccgcctgaatgcgttgggcaagtctgagttccaaatttacaaaaagagtgggatacaggaggtggaccggacgctggccaaagaaggaatcaagagaggcgagaccgatcatcacgcagtctcgcgtgggagcgctaaactcaggtggttcgttgagcggaacctggtgactccagaaggaaaggtcgtggacttaggctgcggtcgcgggggatggtcctattactgtggcggtcttaagaatgtaaaagaggtgaagggcctgacaaaagggggacctggccatgaagaacccattcctatgtctacctatgggtggaacctcgttcgactacagtcaggagtggatgtctttttcactccacccgaaaagtgcgacacactgttgtgtgatatcggcgagagctcccctaatccaaccgtggaggccggtagaacgctgagggtcctcaaccttgtggaaaattggctgaacaataacacccaattttgcattaaagttttgaatccctacatgccgagtgtaatcgagaagatggaagcactgcagcggaagtacgggggagctctcgtgcgcaaccctttatctagaaatagcacacacgagatgtattgggtctcaaacgcctccggcaacatagtgagtagcgttaatatgatctctaggatgctgattaaccgattcactatgcggcacaaaaaggccacctacgaaccagacgtggatcttggctccgggacacgtaatatcggaattgagtcagagactcccaacctggacatcataggtaaaagaattgaaaagatcaaacaggagcatgaaaccagctggcactatgatcaggaccatccttacaagacatgggcgtatcacggctcgtacgagaccaagcaaactgggtctgctagttccatggtcaatggagtggtacgcctactcacgaaaccatgggacgtgatccccatggttacacagatggcaatgaccgatactaccccgtttggccagcagagggtcttcaaggaaaaagtggacacacggacgcaagagcctaaggagggtaccaaaaagctgatgaagattactgccgaatggttgtggaaagagctggggaagaaaaagacacccagaatgtgtacccgcgaagagtttactaggaaagtgcgaagcaacgctgccctcggagcaatattcacagatgagaataagtggaaatcagcccgggaagctgtcgaggactccggcttttgggaacttgttgataaggagagaaacctgcacttagaaggcaagtgcgagacctgtgtgtataatatgatggggaaaagggagaagaaactgggagagttcggtaaggcgaaaggctctcgcgccatctggtacatgtggttgggggcacgttttctcgagttcgaagctctgggatttctaaacgaggaccattggttcagccgggaaaatagtctttccggcgtagagggtgaggggctgcacaagctcggatacattctgagagatgtgagcaagaaagaaggcggcgccatgtatgcagacgatacagccgggtgggacactaggatcaccttggaggatctgaagaacgaagagatggtcacgaatcatatggaaggagagcacaaaaagctcgctgaggccattttcaaacttacctaccagaacaaggtggttcgcgtgcagcgaccaacacctcggggtactgtcatggacatcatatctagaagggaccagcgcggctcagggcaagtggtaacctatggactgaatacatttactaacatggaagcgcagttaatcagacagatggagggcgaaggtgttttcaagagtattcaacatctgaccgcaacggaggagatcgccgtgaaaaactggttggtccgggtggggagggaacgtctctcccgaatggctattagcggagatgactgcgtggtcaagcccctggatgaccgctttgcctctgcactaacagctcttaatgatatgggcaaagttagaaaggacatccagcagtgggagccatcgcggggctggaacgattggacccaggtgcccttctgctcacaccactttcatgaactgattatgaaagacgggagggtactcgtggtcccttgtcgcaatcaagatgagctgataggtagagcacggatcagccagggagctggctggtccttgagggaaactgcctgcttagggaagagttacgcacagatgtggtctctgatgtatttccaccgacgtgacctcagacttgcggccaacgctatttgtagcgccgtgccatcccattgggttccgacatcacgcaccacttggagtatccacgcaacccacgagtggatgacaacggaggatatgctgaccgtgtggaatcgggtctggatccaggaaaacccctggattgaggacaagactcctgtggaatcttgggaggaaataccatacctaggaaaaagggaggatcaatggtgcggcagcctgatcggtctcacatccagagctacctgggccaagaatattcagactgcaatcaaccaggtacgctcattgattgggaatgaggaatatacagactacatgcccagcatgaaacggtttaggcgagaggaagaggaagccggagttctgtggtga

SEQ ID NO: 14957 - RNA, 9876 nt, synthetic construct
  misc_feature 1..9876: note = derived and/or modified CDS sequence (opt3) from DENV-2__KC762666__SS-prME
  source 1..9876: mol_type = other RNA
accgccggaatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactcggaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtgacaccatctatgaccatgagatgcatcggcatatcgaacagggactttgtcgaaggggtgtcaggaggtagctgggtagatattgttctggagcacggcagttgtgtgactacaatggccaaaaataagcccaccctcgacttcgaattaatcaagacggaggctaaacaccctgccaccctgcggaagtactgcattgaagcgaaacttacaaacactaccacagcatcccgctgtccaactcagggggagccctctttgaatgaggaacaagataagcgatttgtctgcaaacatagcatggtggacagaggatggggcaacggttgtgggctgttcggaaagggcggcatcgtgacctgcgccatgtttacatgcaagaaaaatatggaggggaagatcgtccagcctgaaaacctagagtataccattgttataactccacactccggagaagagaatgctgtgggtaacgatacgggcaaacatgggaaggagatcaaagtaacaccgcagtcaagtattaccgaagccgagctcactggatacggcaccgtgacaatggaatgtagccccaggaccggtctggacttcaatgagatggtccttctgcagatggaaaacaaggcatggttggtgcaccggcaatggtttctcgatctgcctttaccatggctgcccggggctgacactcagggctctaactggatccagaaagagacactcgttacgttcaagaatcctcacgccaagaaacaggatgtggtcgtgcttggatcccaagagggcgcgatgcataccgccctgactggggcaacagaaatacagatgtcaagcggaaacttgctatttaccggtcacctgaagtgccgtctccgcatggacaaactgcagcttaagggcatgagttattctatgtgtacagggaaattcaaggtagttaaggagattgctgaaactcaacatggaaccatcgtgatcagagtccagtacgagggcgacggttccccatgcaaaattcccttcgagatcatggatctggaaaagaggcacgtgttggggcggctcattacggtcaatccgatagtgaccgagaaagacagccctgttaacatcgaagccgagcccccatttggcgattcgtacattatcatcggagtggaacctggccagctgaagttatcttggttcaaaaaggggtcctcaattggacagatgtttgagacaactatgcgaggtgctaagcgcatggccatactgggcgacaccgcatgggatttcgggagtctaggaggcgtatttacaagcatcggtaaagccctccatcaagtcttcggggctatttatggcgcggcattttccggagtgtcttggactatgaagatcctgattggcgttgtgatcacctggatagggatgaatagcagatcaacgagtctttccgtcagcttggtgctggtaggagtggttacactctacctgggcgtcatggtgcaggccgactctggttgtgtggtctcatggaaaaacaaggagcttaaatgcgggagtggaatcttcattaccgataatgttcacacttggacagaacagtataagtttcagcccgagagcccatccaagctggcttctgccatccaaaaagcacacgaagagggcatttgtggtatcaggtcggtgacccggttggaaaacctcatgtggaagcagataactcccgagctgaatcatattttaagcgagaacgaagtgaaactgaccatcatgacaggcgacattaaggggatcatgcaggccggaaaacgctccctaagacctcagccaacggagctcaagtactcatggaaaacctggggcaaggctaagatgctgagtactgaacttcacaatcatacattcttgatagatgggccggagaccgccgaatgccccaacgcaaatagggcgtggaactctctggaggtagaggactatggatttggcgtcttcacaactaatatctggctcaaactgaaggaacgtcaagatgctttttgtgacagcaaattaatgtccgccgcaattaaggacaaccgggccgtgcacgctgatatgggttactggatcgagtcagccctgaacgacacctggaaaattgaaaaggccagcttcatcgaggttaagtcttgccactggcctaaatcccatacgctttggagtaatggggtgttggagagcgaaatgataattccaaagaacttcgctggacccgtctctcagcacaattatcgacctggctaccatacacagaccgccggtccatggcacctcggcagactggagatggattttgacttctgtgaagggactaccgtggttgtgacagaggattgcggaaacaggggcccctccctacgcactaccacagcgtcagggaaactgatcacggaatggtgctgtcggagttgcaccctcccgcctctgagatacaggggagaggacggctgttggtatggtatggagatccgcccacttaaggaaaaagaggaaaatttggtaaacagcctggtcactgccgggcatggacagattgataatttttcgttaggcgtgctcggtatggctctgttccttgaggaaatgctgcgaacacgggtgggcaccaagcacgcaatcttgctcgtcgccgtttcctttgtgactctgattacagggaacatgtctttccgtgacctaggaagagtaatggtgatggtcggcgctaccatgacggatgacatagggatgggagtgacttacctggccctcctggcagcgtttaaggttaggcccaccttcgccgctggccttttgctgcgcaaattaacaagcaaggagctcatgatgaccactatcggtattacactgctttcacaaagtaccatccctgagacaattctggaactaactgatgccctcgcactggggatgatggtgttgaaaatcgtccggaatatggagaagtatcagctggctgtgaccataatggccatcttatgcgttcccaacgcagtgattctccagaatgcctggaaagtctcctgtacgacactggctgtagtgtctgttagcccacttctgttgacctcctcacaacagaaggcggactggatccctctcgccctgactattaagggactaaaccccaccgcaatctttctgacaactcttagcagaaccagtaaaaagaggtcttggccactcaatgaagctataatggccgtgggcatggtctccattctggccagctcgttgctgaaaaacgatatcccgatgacgggccctttagtggctgggggactcctgacagtatgctacgtgcttaccggtcgatcagcagacctggagttggaacgcgccgcggacgtccggtgggaggagcaggctgaaatctctggcagttcccccattctcagcataactatctctgaggatgggagcatgtccattaagaatgaagaggaggaacagacactgaccatcctaattagaactggactgcttgttatctcaggcctcttcccagtgagtatacccatcacagccgcagcctggtatctgtgggaggtgaaaaagcaaagggctggtgtcttgtgggacgtgcctagcccaccccctgttgggaaagcagaattagaggatggagcctaccgtattaagcagaagggcatcctgggctattctcagattggggcgggagtatacaaagaaggtacctttcacacgatgtggcatgtgactcgcggcgctgtcctcatgcacaaggggaaacggatcgagccgtcctgggccgacgtgaagaaagatctgatatcatacggaggcggttggaaacttgagggggaatggaaggagggagaagaggttcaggtgctggcattggaaccaggcaaaaaccccagagccgtccaaaccaagcctggcctattcaaaacaagtaccgggacaattggagctgtgagcctggacttttccccaggtacttctggctcgcccatcgtagataagaaagggaaggtcgtgggactctatggcaacggtgttgtgaccaggagcgggacgtacgtctcagccatcgcacagacagagaagtccattgaggacaatcctgaaatcgaggatgacatattcagaaagaaacggctgactattatggatcttcatccgggagctggcaaaaccaagcgctatttacccgccatcgtgagagaagcgattaaaaggggcctgcggacactcatcttggccccaacccgagttgtggcagctgagatggaagaggccctgagagggctccctatacgctaccagactcccgctattagggcagagcacaccggacgtgaaatcgtcgacctgatgtgtcatgccacattcacgatgcggcttctgagtccaatcagagtgcctaactataatttgattatcatggatgaggcccactttactgaccccgcttctattgcggcaaggggttacataagcacccgcgtagaaatgggcgaggccgctgggatcttcatgacagccaccccaccgggatcccgagacccttttccccagtcaaacgcaccaattatggatgaggaaagagagatccccgaacggtcttggaatagcggccacgagtgggtgactgacttcaagggtaagacagtttggtttgtccctagtatcaaagccgggaacgatattgctgcgtgcctaaggaagaatggcaaaaaggtgatacaactgtcccgcaaaaccttcgactttgaatatatcaagacgcgtactaacgattgggacttcgtggtcacaaccgatattagcgagatgggcgccaattttaaggcagagagagtaatcgacccacggaggtgtatgaaacccgtgattctcaccgatggcgaagaacgcgttatcttagctgggcctatgccggtgactcattcttcagccgcacagcgaagaggacgggtcggtaggaacccaaagaatgaaaacgaccagtacatatacatgggcgagcccctggaaaatgatgaggactgcgcccactggaaagaggctaagatgcttctggacaacatcaatacacctgaagggattatcccctccatgttcgagccagaacgcgagaaagtggatgccattgacggagaatatagactcaggggcgaggcgcggaagacctttgttgatttgatgcgtcgcggtgacctgcctgtgtggctcgcataccgagtcgccgctgaggggatcaactatgccgatagaaggtggtgtttcgacggcgtgaaaaacaatcaaatactggaagagaacgtagaagtggagatttggacaaaggagggagaacggaagaaacttaagccccgctggctagatgctagaatctacagtgacccactggcattgaaagagttcaaggaatttgccgctggcaggaagtcgttaactctgaatctcattacggagatggggcggctgcctaccttcatgacacagaaggcccgaaacgcacttgataatctggcggttctccatactgccgaagctggaggtagagcctataaccacgcattgagcgagctgccggagaccctagaaacactgctccttctgaccttattggctactgtcacgggcgggatctttctgttcctcatgtctggaaagggcataggtaaaatgaccctggggatgtgctgcatcattacagcctccatccttctgtggtacgcacagattcagccccactggatcgccgctagcataattctcgagtttttcttgatcgtgctgttaatcccagaacctgagaagcaacgcactccccaggacaatcagctaacctatgtggtcattgcgatcctgacagttgtggccgcaaccatggctaacgaaatgggctttctcgagaaaactaagaaagatttcggacttggctcaataacaacgcagcaaccagagagtaatattctggacatcgatttgaggcctgcctctgcctggaccctgtacgcagtagctactacatttattacccccatgctccggcattccatcgaaaacagctcagtgaatgtcagtctgaccgccatagcgaaccaggctacagtgcttatggggctcggaaagggttggccgctgagcaagatggacatcggcgttccattgctggccattgggtgttactcccaggtgaatcctatcactttaacggcagccctactgctccttgtcgctcactatgcaattatcggacccggcctgcaggccaaagcgacccgtgaggctcaaaagagagccgcagccggtattatgaaaaacccaacagtagacgggatcactgtgatagatttggaccccattccttacgatccgaagttcgaaaaacagctgggccaggttatgctcctggtgctttgcgtcacccaggtgttaatgatgaggacaacctgggctctgtgtgaggccctcactttggcaacgggacccatctctacactgtgggaaggcaatccagggcgcttttggaacaccactatcgctgtcagcatggccaatattttccggggatcctatctagcgggcgccggtctgctcttttcaataatgaagaacaccgcaaacacacgaagagggactggaaataccggcgagacacttggtgagaagtggaaaaacaggctgaatgctttgggcaagtctgagttccaaatctacaaaaagagtgggattcaggaggtggaccgcacgctggccaaagaaggaatcaagcggggcgagaccgatcatcacgcagtttcgagagggagcgctaaactccgttggttcgtggagaggaacctggtaactcctgaaggaaaggtggtcgacttaggctgcggtagaggcgggtggtcctattactgtgggggtcttaagaatgttaaagaggtgaagggcctgacaaaagggggacccggccatgaagaacctattccaatgtctacctatgggtggaacctcgtccgcctacagtcaggagtggatgtatttttcactccccctgaaaagtgcgacacactgttgtgtgatatcggcgagagctccccaaatcccaccgtggaggccggtcgaacgctgagagttctcaaccttgtggaaaattggctgaacaataacacccaattttgcataaaagtcttgaatccgtacatgcctagtgtgatcgagaagatggaagccctgcagaggaagtacgggggagcgctcgtccggaacccattatctcgcaatagcacacacgagatgtattgggtgtcaaacgcttccggcaacattgttagtagcgtaaatatgatctctagaatgctgattaacaggttcactatgcgacacaaaaaggcaacctacgaacccgacgtggatcttggctccgggacacggaatatcggaatagagtcagagactcctaacctggacattatcggtaaacgtatcgaaaagattaaaagagagcatgaaaccagctggcactatgatcaggaccatccatacaagacatgggcctatcacggctcgtacgagaccaagcagactgggtctgctagttccatggtcaatggagtggttcgcctactcacgaaaccctgggacgtgataccgatggtcacacaaatggccatgaccgatactaccccttttggccagcagagggtgttcaaggaaaaagtagacacacggacgcaggagcccaaggagggtaccaaaaagctgatgaagatcactgcagaatggttgtggaaagagctggggaagaaaaagacaccaagaatgtgtacccgcgaagagtttactaggaaagtgcgaagcaacgccgctctcggagcgattttcacagatgagaataagtggaaatcagcccgggaagcagttgaggactccggcttttgggaacttgtcgataaggagagaaacctgcacttagaaggcaagtgcgagacctgtgtgtataatatgatggggaaaagggagaagaaactgggagagttcggtaaggctaaaggctctcgcgccatctggtacatgtggttgggggcacgttttctcgagttcgaagccctgggatttctaaacgaggaccattggttcagccgggaaaatagtctttccggcgtggagggtgaggggctgcacaagctcggatacattctgagagatgtcagcaagaaagaaggcggcgctatgtatgccgacgatacagcggggtgggacactaggatcaccttggaggatctgaagaacgaagagatggttacgaatcatatggaaggagagcacaaaaagctcgcagaggccatattcaaacttacctaccaaaacaaggtggtacgcgtgcagcgacctacaccccggggtactgtcatggacatcatttctagaagggaccagcgcggctcaggacaggtggttacctatggactgaatacatttactaacatggaagctcaattaatcagacagatggagggcgaaggtgtgttcaagagtattcagcaactgaccgtcacggaggagatcgccgtgaaaaactggttggtacgggttgggagggaacgtctctcccgaatggcaattagcggagatgactgcgtggtcaagccactggatgaccgctttgcttctgccctaacagctcttaatgatatgggcaaagtgagaaaggacatacagcagtgggagccctcgcggggctggaacgattggacccaggtgcctttctgctcacatcactttcacgaactgatcatgaaagacgggagggtcctcgttgtgccatgtcgcaatcaagatgagctgattggacgagcacggatcagccagggtgcaggctggtccttgagggaaactgcgtgcttagggaagagttacgcccagatgtggtctctgatgtatttccatcgacgtgacctcagacttgctgccaacgcaatctgtagcgctgtaccgtcccactgggtgcccacatcacgcaccacttggagtattcatgccacccacgagtggatgacaacggaggatatgctgaccgtctggaatcgggtgtggatacaggaaaacccttggatggaggacaagactccagttgaatcttgggaggaaatcccctacctaggaaaaagggaggatcaatggtgcggcagcctgattggtctcacatccagagcaacctgggccaagaatatccagactgcgattaaccaggtgcgctcattgatcgggaatgaggaatatacagactacatgcctagcatgaaacggtttaggcgagaggaagaggaagctggagtcctgtggtga

SEQ ID NO: 14958 - RNA, 9876 nt, synthetic construct
  misc_feature 1..9876: note = derived and/or modified CDS sequence (opt3) from DENV-2__KC762677__SS-prME
  source 1..9876: mol_type = other RNA
accgccggaatcattataatgatgatccccactgtgatggctttccacctgactacgagaaacggggagcctcatatgattgtaagcaggcaggaaaagggaaaatccctcctttttaagaccgagaatggtgttaacatgtgcaccctgatggcaatggacttgggcgaattatgtgaggatactatcacctacaattgcccactgctacggcaaaacgaaccggaggacattgattgttggtgcaattctacctcaacctgggtgacttatgggacatgtaccgccacgggagagcaccgccgagaaaaacgtagtgtagcgctcgtgccccatgtaggcatgggtctggagactcggaccgaaacatggatgagctccgagggggcttggaagcacgcccagaggatcgagacttgggtgcttcggcatcctggattcaccataatggcagccatcctggcttacacaattggcaccacgcactttcagcgcgttttgatcttcattctcctgactgcagtggccccatctatgacaatgagatgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaacatcctgcgacgctgcggaagtattgcattgaagcaaaacttaccaacacaactaccgcctcccgctgtccaacacagggggagccctctttgaatgaggaacaagataagcgatttgtctgcaaacacagcatggtggacagaggatggggcaacggttgtgggctgttcggaaagggcggcatcgtgacttgcgctatgtttacctgcaagaaaaatatggaggggaagatcgtccagcctgaaaacctagagtacacaattgttataaccccacattccggagaagagaatgccgtgggtaacgatactggcaaacacgggaaggagatcaaagtaacgccgcagtcaagtattacagaagcagagctcaccggatatggcactgtgaccatggaatgtagccccaggacaggtctggacttcaatgagatggtccttctgcagatggaaaacaaggcttggttggtgcaccggcaatggtttctcgatctgcctttaccatggctgcccggggccgacacccagggctctaactggatccagaaagagactctcgttacattcaagaatcctcatgcgaagaaacaggatgtggtcgtgcttggatcccaagagggcgccatgcacacggcactgaccggggctactgaaatacagatgtcaagcggaaacttgctatttacaggtcatctgaagtgccgtctccgcatggacaaactgcagcttaagggcatgagttactctatgtgtaccgggaaattcaaggtagttaaggagattgccgaaacacaacacggaactatcgtgatcagagtccagtatgagggcgacggttccccatgcaaaattcccttcgagatcatggatctggaaaagaggcatgtgttggggcggctcattaccgtcaatccgatagtgacggagaaagacagccctgttaacatcgaagctgagcccccatttggcgattcgtacattatcatcggagtggaacctggccagctgaagttatcttggttcaaaaaggggtcctcaattggacagatgtttgagaccacaatgcgaggtgccaagcgcatggcaatactgggcgacactgcctgggatttcgggagtctaggaggcgtatttaccagcatcggtaaagctctccaccaagtcttcggggcgatttacggcgcagccttttccggagtgtcttggacaatgaagatcctgattggcgttgtgatcacttggatagggatgaatagcagatcaaccagtctttccgtcagcttggtgctggtaggagtggttacgctctatctgggcgtcatggtgcaggctgactctggttgtgtggtctcatggaaaaacaaggagcttaaatgcgggagtggaatcttcattacagataatgttcacacctggactgaacagtacaagtttcagcccgagagcccatccaagctggcctctgcaatccaaaaagcccatgaagagggcatttgtggtatcaggtcggtgacacggttggaaaacctcatgtggaagcagataacccccgagctgaatcacattttaagcgagaacgaagtgaaactgactatcatgaccggcgacattaaggggatcatgcaggctggaaaacgctccctaagacctcagccaacagagctcaagtattcatggaaaacgtggggcaaggccaagatgctgagtaccgaacttcataatcacactttcttgatagatgggccggagacagcagaatgccccaacaccaatagggcgtggaactctctggaggtagaggactacggatttggcgtcttcacaactaatatctggctcaaactgaaggaacgtcaagatgtgtattgtgacagcaaattaatgtccgctgccattaaggacaaccgggcagttcacgccgatatgggttactggatcgagtcagctctgaacgacacctggaaaattgaaaaggccagctttatcgaggtgaagtcttgctattggcctaaatcccatacgctttggagtaatggggtcttggagagcgaaatgataattccaaagaacttcgcaggacccgtgtctcagcacaattaccgacctggctaccatacacagaccgctggtccatggcacctcggcagactggagatggatttcgacttttgtgaagggactaccgttgtggtaacagaggattgcggaaacaggggcccctccctacgcactaccacagcctcagggaaactgatcacggaatggtgctgtcggagttgcaccctcccgcctctgagatataggggagaggacggctgttggtacggtatggagatccgcccaatgaaggaaaaagaggaaaatcttgtcaacagcttggtgactgcggggcatggacagattgataatttctcgctgggcgtgttaggtatggccctctttctggaggaaatgcttcgaacacgggtcggcaccaagcacgctatcctgttggttgcagtgtccttcgtaactctcattacagggaacatgtcttttcgtgacctgggaagagtgatggtcatggtgggcgccaccatgacggatgacatagggatgggagttacttatctagctctgctcgccgcattcaaggtgaggcccacctttgcggccggcctgcttttgcgcaaactgacaagcaaggagttaatgatgaccactatcggtattgtcctcctgtcacaaagtacaatccctgagaccattcttgaactgacagatgctctagccctcgggatgatggcactgaaaatcgtgcggaatatggagaagtaccagttggctgttactataatggccatcctgtgcgtgcccaacgcagtcattttacagaatgcctggaaagtatcctgtaccacgctcgctgtggtttctgtgagcccactgcttctgacatcctcacaacagaaggcggactggatccctttggccctcaccattaagggactgaaccccactgcaatcttcctaaccacactgagcagaacaagtaaaaagaggtcttggccacttaatgaagctataatggccgtcggcatggtgtccattctcgccagctcgctgttgaaaaacgatatcccgatgaccggccctctggtagctgggggattactcacggtgtgctatgtcctgacaggtcgatcagcagaccttgagctggaacgcgccgcggacgttcggtgggaggagcaggctgaaatctctggcagttcccccattttgagcataaccatctctgaggatgggagcatgtccattaagaatgaagaggaggaacagactctcacaatcctgattagaaccggactactggtgatctcaggcctttttccagtgagtatacccatcactgccgcagcctggtacctctgggaggtcaaaaagcaaagggctggtgtgctgtgggacgttcctagcccaccccctgtagggaaagcagaattggaggatggagcctatcgtattaagcagaagggcatcttaggctactctcagattggggcgggagtgtacaaagaaggtacattccacaccatgtggcatgtcacgcgcggcgctgtgctgatgcacaaggggaaacggatcgagccgtcctgggccgacgttaagaaagatctcatatcatatggaggcggttggaagctggagggggaatggaaggagggagaagaggtgcaggtccttgcactggaaccaggcaaaaaccccagagccgtgcaaactaagcctggcttgtttaaaaccaacacagggaccattggagctgtaagtctagacttcagcccaggtacatccggctctcccatcgtcgataagaaagggaaggtggttggactgtacggcaatggtgtggtcactaggtcggggacctatgtgagcgccatcgcacagacggagaagtcaattgaggacaaccctgaaatcgaggatgacatatttcggaaaaagagactcacaattatggatctgcatccgggagctggcaaaactaagcgctaccttcccgccatcgttagagaagcgattaaaaggggcttacggaccctgatcctcgccccaacacgagtggtcgcagctgagatggaagaggccttgagagggctgcctatacgctatcagacccccgctattagggcagagcacactggacgtgaaatcgtggacctcatgtgtcatgccaccttcacaatgcggctgctttccccaatcagagtacctaattacaacctgattatcatggatgaggcccacttcacggaccccgctagtattgcggcaaggggttatatatctactcgcgtggaaatgggcgaggccgctgggatctttatgaccgccacaccaccgggaagccgagaccctttcccccagtccaatgcaccaattatggatgaggaaagagagatccccgaacggtcatggaactctggccacgagtgggttaccgactttaagggtaagactgtctggttcgtgcctagcatcaaagccgggaatgatattgctgcgtgcttgaggaagaacggcaaaaaggtgatacaactaagtcgcaaaacatttgacttcgaatacatcaagacccgtacgaatgattgggactttgtcgtaactacagatatttccgagatgggcgccaacttcaaggcagagagagtgatcgacccacggaggtgtatgaaacccgttattctgaccgatggcgaagaacgcgtgatcctcgctgggcctatgccggtcacccatagctctgccgcacagcgaagaggacgggtgggtaggaatccaaagaacgaaaatgaccagtacatatatatgggcgagcccttagaaaacgatgaggactgcgcccactggaaagaggctaagatgctgcttgacaatatcaacactcctgaagggattatcccctcaatgtttgagccagaacgcgagaaagttgatgccattgacggagaatacagactgaggggcgaggcgcggaagacattcgtggatctcatgcgtcgcggtgacttgcctgtctggctggcatatcgagtggccgctgaggggatcaactacgccgatagaaggtggtgttttgacggcgtcaaaaataaccaaatactcgaagagaatgtggaagttgagatttggaccaaggagggagaacggaagaaactgaagccccgctggcttgatgctagaatctattccgacccactagcactgaaagagttcaaggagttcgccgctggcaggaaaagtttgacattaaacctgattactgagatggggcggctccctacgtttatgacccagaaggcccgaaatgcactggataaccttgcggtcctgcatacagccgaagctggaggtagagcctacaatcacgcactcagcgagttgccggagactctggaaaccctactgctccttacactgttagctaccgtgactggcgggatcttcttgtttctgatgtcgggaaagggcataggtaaaatgacgctcgggatgtgctgcatcattaccgcctctatcctgctttggtatgcacagattcagccccactggatcgccgcttccataattctggagttctttctcatcgtgttgctgatcccagaacctgagaagcaacgcacaccccaggacaaccagttaacttacgtcgttattgcgatcctaaccgtggtagccgcaacaatggctaatgaaatgggcttcctggagaaaaccaagaaagattttggactcggcagcataactacacagcaaccagagtcaaacattcttgacatcgatctgaggcctgccagtgcctggacgttgtacgcagtggctaccactttcattacacccatgctgcggcattctatcgaaaattccagcgtcaacgtgtcactcaccgccatagcgaatcaggctaccgttctgatggggcttggaaagggttggccgctcagtaagatggacatcggcgtgccactgttggccattgggtgttatagccaggtcaaccctatcacactgactgcagccttactactgctcgtagctcactacgcaattatcggacccggccttcaggccaaagcgacgcgtgaggctcaaaagagagccgcagccggtattatgaaaaatccaaccgtggacgggatcacagttatagatctggaccccattccttatgatccgaagtttgaaaaacagttgggccaggtgatgctgctcgtcctgtgcgtgactcaggtccttatgatgaggaccacatgggctttatgtgaggccctgaccctcgcaactggacccatctccacgttgtgggaaggcaacccagggcgcttctggaatacaaccatcgctgtgtctatggccaacatttttcggggaagctacctggcgggcgccggtctactgttctccataatgaagaacactgcaaatacccgaagagggacaggaaacactggcgagaccctcggtgagaagtggaaaaataggcttaacgctctgggcaagtcagaatttcaaatctataaaaagtctgggattcaggaggttgaccgcacattggccaaagaaggaatcaagcggggcgagacggatcatcacgcagtgagtagagggtcggctaaactgcgttggttcgtagagaggaatctcgtgacccctgaaggaaaggtcgttgacctgggctgcggtagagggggatggagctactattgtggcggtttaaagaacgtgaaagaggtcaagggccttactaaagggggacccggccatgaagaacctattccaatgtccacatacgggtggaatctggtgcgcctccagtctggagtagatgtgttctttacaccccctgaaaagtgcgacactctactgtgtgatatcggcgagtcaagcccaaaccccacagttgaggccggtcgaaccttgagagtgctgaatctcgtcgaaaactggcttaataacaatacgcaattctgcataaaagtgctgaacccgtacatgccttccgtcatcgagaagatggaagccttgcagaggaagtatgggggagcgctggtgcggaatccactcagtcgcaactctacccacgagatgtactgggttagcaacgcttcaggcaatattgtatccagtgtgaacatgatcagcagaatgttaattaataggtttacaatgcgacacaaaaaggcaacttatgaacccgacgtcgatctgggctctgggacccggaacatcggaatagagtccgagattcctaatcttgacatcatcggtaaacgtattgaaaagataaaacaggagcatgaaacatcatggcactacgatcaggaccatccatatagaacttgggcctaccacggcagctatgagaacaagcaaaccgggtcggcttctagtatggtgaatggagttgtgcgcctgctaacaaagccctgggacgtcatcccgatggtgacccagatggccatgactgatacgacacctttcggccagcagagggtatttaaagaaaaggtggacacccggactcaagagcccaaagagggtaccaagaaactcatgaagattacagcagaatggctgtggaaggagttggggaaaaagaaaacgccaagaatgtgtacccgcaaggagttcactaggaaagttcgatccaacgccgctctgggagcgatctttacagatgagaataagtggaaaagcgcccgggaggcagtcgaagactcaggcttctgggagctcgtggataaggaaagaaaccttcacctggagggcaagtgcgaaacctgtgtgtacaatatgatggggaaaagggagaagaaattaggagagtttggtaaggctaaaggctcccgcgccatttggtacatgtggctgggggcacgtttcttggaatttgaggccctcggattcctgaacgaagaccattggttttctcgggagaatagcctaagtggcgtcgaaggtgaggggcttcacaagctgggatatatcctcagagatgtttccaagaaagagggcggcgctatgtacgccgacgatactgcggggtgggacacaaggataaccctggaagatttgaagaacgaggaaatggtgacaaatcatatggagggagaacacaaaaagctggcagaggccatcttcaaactcacttatcagaacaaggtagtgcgcgtccagcgacctacaccccggggtacggtgatggacattatcagcagaagggaccagcgcggctctgggcaagttgtgacctacggacttaacacattcactaatatggaggctcagctgattagacagatggaaggcgagggtgtctttaagtcaatccaacagttaaccgtgacagaagagattgccgtcaaaaactggctggttcgggtggggagggagcgtttgagtcgaatggcaatatccggagatgactgcgtcgtgaagccactcgatgaccgcttcgctagcgccctgactgctctaaatgatatgggcaaagtgagaaaggacatccagcagtgggaaccctctcggggctggaacgattggacccaagtccctttttgctcgcatcacttccacgagcttattatgaaagacgggagggttctggtggtaccatgtcgcaatcaggatgaactcatcggacgagcccggatctcacagggtgcaggctggagcctgagggagacggcgtgcttggggaagtcctatgcccagatgtggagtttaatgtactttcatcgacgtgacctgagactcgctgccaacgcaatttgttctgctgtgccgagccactgggtccccacatcccgcaccacttggtcaatacatgccacacacgaatggatgaccactgaggatatgcttaccgtgtggaatcgggtttggatccaagagaacccttggatggaagacaagacaccagtggagagttgggaagagattccctatctgggaaaaagggaagatcagtggtgcggctctctaatcggtctgacgagcagagcaacctgggccaagaatattcagactgcgatcaaccaggtccgctccctcatagggaatgaggagtacacagactacatgccttcaatgaaacggttcaggcgagaagaggaagaggctggagtgttgtggtga

SEQ ID NO: 14959 - RNA, 9876 nt, synthetic construct
  misc_feature 1..9876: note = derived and/or modified CDS sequence (opt3) from DENV-2__KC762668__SS-prME
  source 1..9876: mol_type = other RNA
accgccggcatcattataatggtgatccccacagtcatggctttccacctgactacgagaaacggggagcctcatatgattgttagcaggcaggaaaagggaaaatccctcctttttaagaccgagaatggtgtgaacatgtgcacactgatggcaatggacttgggcgaattatgtgaggatactatcacctacaattgcccactgctacggcaaaacgaaccggaggacattgattgttggtgcaattctacatcaacctgggtaacttatgggacatgtaccgccacgggagagcaccgccgagaaaaacgtagtgtggcgctcgtcccccatgtgggcatgggtctggagactagaaccgaaacatggatgagctccgagggggcttggaagcacgcccagaggatcgagacttgggttcttcggcatcctggattcaccataatggcagccatcctggcttacacaattggcaccacgtattttcagcgcgtgttgatcttcattctcctgactgcagtcgccccatctatgacaatgagatgcatcggcatatcgaacagggactttgtggaaggggtatcaggaggtagctgggttgatattgtgctggagcacggcagttgtgtcaccactatggctaaaaataagcccacactcgacttcgaattaatcaagaccgaggccaaacaccctgcgacgctgcggaagtactgcattgaagcaaaacttaccaacacaactaccgcctcccgctgtccaacacagggggagccctctttgaatgaggaacaagataagcgatttgtgtgcaaacatagcatggtggacagaggatggggcaacggttgtgggctgttcggaaagggcggcatcgtcacttgcgctatgtttacctgcaagaaaaatatggaggggaagatcgttcagcctgaaaacctagagtatacaattgtgataaccccacactccggagaagagaatgccgtaggtaacgatactggcaaacatgggaaggagatcaaaattacgccgcagtcaagtatcacagaagcagagctcaccggatacggcactgtgaccatggaatgtagccccaggacaggtctggacttcaatgagatggtccttctgcagatggaaaacaaggcttggttggtgcaccggcaatggtttctcgatctgcctttaccatggctgcccggggccgacacccagggctctaactggatacagaaagagactctcgttacattcaagaatcctcacgcgaagaaacaggatgtggtcgtgcttggatcccaagagggcgccatgcatacggcactgaccggggctactgaaattcagatgtcaagcggaaacttgctatttacaggtcacctgaagtgccgtctccgcatggacaaactgcagcttaagggcatgagttattctatgtgtaccgggaaattcaaggtagttaaggagatcgccgaaacacaacatggaactatcgtgattagagtccagtacgagggcgacggttccccatgcaaaatccccttcgagattatggatctggaaaagaggcacgtgttggggcggctcataaccgtcaatccgatcgtgacggagaaagacagccctgttaacattgaagctgagcccccatttggcgattcgtacatcatcattggagtggaacctggccagctgaagttatcttggttcaaaaaggggtcctcaataggacagatgtttgagaccacaatgcgaggtgccaagcgcatggcaatcctgggcgacactgcctgggatttcgggagtctaggaggcgtatttaccagcattggtaaagctctccatcaagtcttcggggcgatctatggcgcagccttttccggagtgtcttggacaatgaagattctgatcggcgttgtgataacttggatcgggatgaatagcagatcaaccagtctttccgtcagcttggtgctggtaggagtggttacgctctacctgggcgtcatggtgcaggctgactctggttgtgtggtctcatggaaaaacaaggagcttaaatgcgggagtggaattttcatcacagataatgttcacacctggactgaacagtataagtttcagcccgagagcccatccaagctggcctctgcaattcaaaaagcccacgaagagggcatctgtggtataaggtcggtgacacggttggaaaacctcatgtggaagcagattacccccgagctgaatcatatcttaagcgagaacgaagtgaaactgactattatgaccggcgacatcaaggggataatgcaggctggaaaacgctccctaagacctcagccaacagagctcaagtactcatggaaagcctggggcaaggcaaagatgctgagtacggaacttcacaatcataccttcttgatcgatgggccggagactgcggaatgccccaacacaaatagggcttggaactctctggaggtagaggactatggatttggcgtcttcaccacaaatatttggctcaaactgaaggaacgtcaagatgtgttttgtgacagcaaattaatgtccgccgcaatcaaggacaaccgggccgttcacgctgatatgggttactggattgagtcagccctgaacgacacttggaaaatcgaaaaggcaagcttcatagaggtgaagtcttgccactggcctaaatcccataccctttggagtaatggggtcttggagagcgaaatgattatcccaaagaacttcgctggacccgtgtctcagcacaattatcgacctggctaccatacgcagacagccggtccatggcacctcggcagactggagatggattttgacttctgtgaagggaccactgttgtggtaaccgaggattgcggaaacaggggcccctccctacgcacaactaccgcgtcagggaaactgatcacagaatggtgctgtcggagttgcacgctcccgcctctgagatacaggggagaggacggctgttggtatggtatggagattcgcccacttaaggaaaaagaggaaaatttggtcaacagcctggtgaccgccgggcatggacagatcgataatttttcgttaggcgtgctcggtatggctctgttccttgaggaaatgctgcgaactcgggtcggcacaaagcacgcaattttgctcgttgccgtgtcctttgtaaccctgataactgggaacatgtctttccgtgacctaggaagagtgatggtcatggtgggcgctacaatgaccgatgacatcgggatgggagttacgtacctggccctcctggcagcgtttaaggtgaggcccactttcgccgctggccttttgctgcgcaaattaaccagcaaggagctcatgatgacaaccattggtatcgtcctgctttcacaaagtactattcctgagacaatcctggaactaaccgatgccctcgcactggggatgatggtgttgaaaatagttcggaatatggagaagtatcagctggctgtgacaatcatggccattttatgcgtccccaacgcagtaatcctccagaatgcctggaaagtgtcctgtactaccctggctgttgtgtctgtcagcccacttctgttgacgtcctcacaacagaaggcggactggattcctctcgccctgacaatcaagggactaaaccccaccgcaatatttctgactacccttagcagaacaagtaaaaagaggtcttggccactcaatgaagctattatggccgtgggcatggtatccatcctggccagctcgttgctgaaaaacgatatcccgatgactggccctttagtggctgggggactcctgaccgtctgctacgttcttacgggtcgatcagcagacctggagttggaacgcgccgcggacgtgcggtgggaggagcaggctgaaatttctggcagttcccccatactcagcatcacaatttctgaggatgggagcatgtccatcaagaatgaagaggaggaacagaccctgactattctaatcagaacaggactgcttgtgatatcaggcctcttcccagtcagtatccccattaccgccgcagcctggtatctgtgggaggtgaaaaagcaaagggctggtgttttgtgggacgtacctagcccaccccctgtggggaaagcagaattagaggatggagcctaccgtatcaagcagaagggcattctgggctattctcagatcggggcgggagtctacaaagaaggtacttttcacacaatgtggcatgtgacccgcggcgctgttctcatgcacaaggggaaacggatagagccgtcctgggccgacgtgaagaaagatctgatttcatacggaggcggttggaagcttgagggggaatggaaggagggagaagaggtccaggtgctggcattggaaccaggcaaaaaccccagagccgtacaaacgaagcctggcctattcaaaactaacaccgggatcatcggagctgtcagtctggactttagcccaggtacatccggctctcccattgtggataagaaagggaaggttgtgggactctatggcaatggtgtcgtgaccaggtcggggacatacgttagcgccatcgcacagactgagaagtcaatagaggacaaccctgaaattgaggatgacatcttccgaaaaaagcggctgaccattatggatcttcatccgggagctggcaaaacgaagcgctatttacccgccatcgtgagagaagcgataaaaaggggcctgcggacactcattttggccccaactcgagtcgtggcagctgagatggaagaggccctgagagggctccctatccgctaccagacccccgctatcagggcagagcacacaggacgtgaaattgtagacctgatgtgtcatgccaccttcactatgcggcttctgtccccaatcagagtgcctaattataacttgattataatggatgaggcccactttaccgaccccgctagtatcgcggcaaggggttacatttctacacgcgttgaaatgggcgaggccgctgggatcttcatgacggccactccaccgggaagccgagacccttttccccagtccaatgcaccaatcatggatgaggaaagagagattcccgaacggtcatggaactctggccacgagtgggtcaccgacttcaagggtaagacagtgtggtttgtgcctagcataaaagccgggaatgatatcgctgcgtgcctaaggaagaacggaaaaaaggtcattcaactgagtcgcaaaaccttcgactttgaatatatcaagactcgtacaaatgattgggacttcgtagtgaccacggatatttccgagatgggcgccaactttaaggcagagagagttatcgacccacggaggtgtatgaaacccgtgatactcactgatggcgaagagcgcgtcatcttagctgggcctatgccggtgacacatagctctgccgcacagcgaagaggacgggttggtaggaatccaaagaacgaaaatgaccagtacatttacatgggcgagcccctggaaaacgatgaggactgcgcccactggaaagaggctaagatgcttctggacaatatcaacacccctgaagggattatcccctcaatgttcgagccagaacgcgagaaagtggatgccatagacggagaatatagactcaggggcgaggcgcggaagacctttgtcgatttgatgcgtcgcggtgacctgcctgtgtggctcgcataccgagtagccgctgaggggattaactatgccgatagaaggtggtgtttcgacggcgtgaaaaataaccaaatcctggaagagaatgttgaagtcgagatttggactaaggagggagaacggaagaaacttaagccccgctggctagatgctagaatctactccgacccactggcattgaaagagttcaaggaatttgccgctggcaggaaaagtttaacactgaacctcataaccgagatggggcggctgcctacattcatgactcagaaggcccgaaatgcacttgataacctggcggtgctccatacggccgaagctggaggtagagcctataatcacgcattgagcgagctgccggagaccctagaaacactgctccttctgactttattggctaccgtgacaggcgggatctttctgttcctcatgtcgggaaagggcattggtaaaatgaccctggggatgtgctgcatcattactgcctctatccttctgtggtacgcacagatacagccccactggattgccgcttccatcatcctcgagtttttcttgattgtcctgttaatcccagaacctgagaagcaacgcacgccccaggacaaccagctaacctatgttgtgatagcgattctgacagtagtggccgcaactatggctaatgaaatgggctttctcgagaaaaccaagaaagatttcggacttggcagcatcacaacccagcaactggagtcaaacattttggacatcgatctgaggccagccagtgcctggactctctacgcagtcgctacaacgtttataacccctatgctgcggcattctatcgaaaattccagcgtgaacgtttcacttactgccattgcgaatcaggctacagtgctcatggggctgggaaagggttggcccttgagtaagatggacatcggcgtcccgctgttagccattgggtgttacagccaggtaaacccaatcaccctaaccgcagccctgctccttctggtggctcactatgcaattatcggacctggcttgcaggccaaagcgacacgtgaggctcaaaagagagccgcagccggtataatgaaaaatcccactgttgacgggattacggtgatcgatctggacccaatcccctacgatcctaagttcgaaaaacagctcggccaggtcatgctgcttgtgttatgcgtcacccaggtgctgatgatgaggacaacttgggctctctgtgaggccttgaccctggcaacaggaccgatttccaccctatgggaaggcaaccccgggcgcttttggaatactacgatagctgtttctatggccaacatcttccggggaagctatctggcgggcgccggtctccttttttccattatgaagaacacagcaaatacccgaagagggactggaaacaccggcgagacactgggtgagaagtggaaaaataggttgaacgctctgggcaagtcagaattccaaatctacaaaaagtctgggattcaggaggtggaccgcactctcgccaaagaaggaatcaagcggggcgagaccgatcatcacgcagtaagtagagggtcggctaaactgcgttggttcgtggagaggaatttagtcacaccagaaggaaaggttgtggaccttggctgcggtcgggggggatggagctattactgtggcggtctgaagaacgtcaaagaggtgaagggcctcacgaaagggggacctggccatgaagagcccatacctatgtccacctatgggtggaatctagtacgcctgcagtctggagtggatgtttttttcactccacccgaaaagtgcgacacattgctgtgtgatatcggcgagtcaagccctaacccaaccgtggaggccggtcgaactctcagagtccttaatctggtggaaaactggttgaataacaatacacaattttgcattaaagtcctgaacccctacatgccgtccgtgatcgagaagatggaagccctccagaggaagtacgggggagcgttagttcggaatcctctgagtcgcaactctacccacgagatgtattgggtaagcaacgcttcaggcaatattgtgtccagtgtcaacatgatcagcagaatgcttataaataggttcacgatgcgacacaaaaaggcaacctacgaaccagacgtggatctgggctctgggacacggaacattggaatcgagtccgagactcccaatctagacatcattggtaaacgtatagaaaagatcaaacaggagcatgaaacctcatggcactatgatcaggaccatccttacaagacatgggcctatcacggcagctacgagactaagcaaaccgggtcggcttctagtatggttaacggagtggtcagactcctgacaaaaccatgggacgtgattcccatggtaacccagatggccatgactgatacgacaccgtttggccagcagcgcgtgttcaaggaaaaagttgacaccaggactcaagagcctaaggagggtaccaaaaagttgatgaagatcacagcagaatggctgtggaaagagctcgggaagaaaaagacgccccggatgtgtaccagagaagagtttactcgcaaagtcaggtccaatgccgctcttggagcgattttcacagatgagaacaagtggaaaagcgcccgagaagcagtggaggactcaggcttttgggaactggtggataaggagcggaatttacacctggaaggcaagtgcgagacctgtgtctataacatgatggggaaaagagagaagaaattgggagaattcggtaaggctaaaggctccagggccatctggtacatgtggctcggggcacgctttctggagttcgaagccctaggatttcttaatgaggaccattggttctctcgtgaaaacagcctgagtggcgttgagggtgaggggctccacaagctgggatacatattgcgggatgtgtccaagaaagaaggcggcgctatgtatgccgacgatactgcggggtgggacacaagaatcaccctggaggatctcaagaatgaagagatggtaacaaaccatatggaaggagagcacaaaaggcttgcagaggccattttccgcctgacttaccagaataaggtggtccgagtgcagcggccaacccctagaggtacggttatggacatcattagcaggcgcgaccagagaggctctgggcaagtggtcacctatggattaaacacatttactaacatggaagctcagctgatccggcagatggagggcgaaggtgtgttcaaatcaattcaacatttgaccgtaacagaggagatagccgttaagaattggctcgcaagggtggggcgtgaacgactgagtcgcatggctatctccggagatgactgcgtcgtgaagcccctagatgacagatttgccagcgctcttactgccctgaacgatatgggcaaagtgcggaaggacattcagcagtgggagccatctaggggctggaatgattggacccaggtccccttctgctcgcaccactttcatgaactcatcatgaaagacgggcgcgttctggtggtaccttgtagaaaccaagatgagttgatcggacgggcaaggatttcacagggtgcgggctggagcttacgagaaacggcctgcctggggaagtcctacgctcagatgtggagtctcatgtatttccaccgtagagaccttcgcctggccgcaaatgctatatgttctgccgtgccaagccattgggtcccgacatcccggaccacttggtcaatccacgcaacacacgagtggatgaccactgaggatatgctaaccgtgtggaacagggtttggattcaggaaaatccctggatggaggacaaaacacctgtggaaagttgggaggaaatcccatacctgggaaagagagaggatcaatggtgcggctctctcattggtttgacgagccgcgccacctgggcgaagaacatccagactgctataaatcaggtccggtccctgatcgggaacgaggaatatacagactacatgccctcaatgaaaaggtttcgaagagaggaagaggaagccggagtgctttggtga

SEQ ID NO: 14960 - RNA, 9876 nt, synthetic construct
  misc_feature 1..9876: note = derived and/or modified CDS sequence (opt3) from DENV-2__KC762678__SS-prME
  source 1..9876: mol_type = other RNA
accgcaggaatcattataatgatgatccccacagtgatggctttccacctgactacgcgaaacggggagcctcatatgattgtaagcaggcaggaaaagggaaaatccctcctttttaagaccgagaatggtgttaacatgtgcacactgatggcaatggacttgggcgaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgtattttcagcgcatcttgattttcatcctcctgactgcagttacaccatctatgaccatgcggtgcataggcatttcgaacagggactttgtggaaggggtctcaggaggtagctgggtggatatcgtactggagcacggcagttgtgttactacaatggccaaaaataagcccaccctcgacttcgaattaattaagacggaggctaaacaccctgccaccctgcggaagtactgcatcgaagcgaaacttacaaacactaccacagcatcccgctgtccaactcagggggagccctctttgaatgaggaacaagataagcgatttgtgtgcaaacatagcatggtcgacagaggatggggcaacggttgtgggctgttcggaaagggcggcatcgtgacctgcgccatgtttacatgcaagaaaaatatggaggggaagattgtgcagcctgaaaacctagagtataccatagtcatcactccacactccggagaagagaatgctgttggtaacgatacgggcaaacatgggaaggagattaaagtgacaccgcagtcaagtatcaccgaagccgagctcactggatacggcaccgtaacaatggaatgtagccccaggaccggtctggacttcaatgagatggtgcttctgcagatggaaaacaaggcatggttggtccaccggcaatggtttctcgatctgcctttaccatggctgcccggggctgacactcagggctctaactggatacagaaagagacactcgtgacgttcaagaatcctcacgccaagaaacaggatgttgtggtccttggatcccaagagggcgcgatgcataccgccctgactggggcaacagaaattcagatgtcaagcggaaacttgctatttaccggtcacctgaagtgccgtctccgcatggacaaactgcagcttaagggcatgagttattctatgtgtacagggaaattcaaggtggtaaaggagatcgctgaaactcaacatggaaccatcgttattagagtgcagtacgagggcgacggttccccatgcaaaatccccttcgagattatggatctggaaaagaggcacgtcttggggcggctcataacggtgaatccgatcgtcaccgagaaagacagccctgtgaacattgaagccgagcccccatttggcgattcgtacatcatcattggagttgaacctggccagctgaagttatcttggttcaaaaaggggtcctcaataggacagatgtttgagacaactatgcgaggtgctaagcgcatggccatcctgggcgacaccgcatgggatttcgggagtctaggaggcgtgtttacaagcattggtaaagccctccatcaagtattcggggctatctatggcgcggcattttccggagtctcttggactatgaagattctgatcggcgtggttataacctggatcgggatgaatagcagatcaacgagtctttccgtgagcttggtcctggtgggagtagtgacactctacctgggcgttatggtccaggccgactctggttgtgtggtgtcatggaaaaacaaggagcttaaatgcgggagtggaattttcatcaccgataatgtccacacttggacagaacagtataagtttcagcccgagagcccatccaagctggcttctgccattcaaaaagcacacgaagagggcatctgtggtataaggtcggttacccggttggaaaacctcatgtggaagcagattactcccgagctgaatcatatcttaagcgagaacgaagtgaaactgaccattatgacaggcgacatcaaggggataatgcaggccggaaaacgctccctaagacctcagccaacggagctcaagtactcatggaaaacctggggcaaggctaagatgctgagtactgaacttcacaatcatacattcttgatcgatgggccggagaccgccgaatgccccaacgcaaatagggcgtggaactctctggaggtggaggactatggatttggcgtattcacaactaatatttggctcaaactgaaggaacgtcaagatgctttttgtgacagcaaattaatgtccgccgcaatcaaggacaaccgggccgtccacgctgatatgggttactggattgagtcagccctgaacgacacctggaaaatcgaaaaggccagcttcatagaggtgaagtcttgccactggcctaaatcccatacgctttggagtaatggggttttggagagcgaaatgattatcccaaagaacttcgctggacccgtgtctcagcacaattatcgacctggctaccatacacagaccgccggtccatggcacctcggcagactggagatggattttgacttctgtgaagggactaccgtcgtggttacagaggattgcggaaacaggggcccctccctacgcactaccacagcgtcagggaaactgatcacggaatggtgctgtcggagttgcaccctcccgcctctgagatacaggggagaggacggctgttggtatggtatggagattcgcccacttaaggaaaaagaggaaaatttggtgaacagcctggtaactgccgggcatggacagatcgataatttttcgttaggcgtcctcggtatggctctgttccttgaggaaatgctgcgaacacgggtgggcaccaagcacgcaattttgctcgtggccgtctcctttgttactctgataacagggaacatgtctttccgtgacctaggaagagtgatggtaatggtgggcgctaccatgacggatgacatcgggattggagtcacttacctggccctcctggcagcgtttaaggtgaggcccaccttcgccgctggccttttgctgcgcaaattaacaagcaaggagctcatgatgaccactatcggtattacactgctttcacaaagtaccatccctgagacaatactggaactaactgatgccctcgcactggggatgatggttttgaaaatcgtgcggaatatggagaagtatcagctggctgtcaccattatggccatcttatgcgtgcccaacgcagttattctccagaatgcctggaaagtgtcctgtacgacactggctgtcgtatctgtgagcccacttctgttgacctcctcacaacagaaggcggactggatccctctcgccctgactataaagggactaaaccccaccgcaatttttctgacaactcttagcagaaccagtaaaaagaggtcttggccactcaatgaagctatcatggccgttggcatggtgtccatcctggccagctcgttgctgaaaaacgatattccgatgacgggccctttagtcgctgggggactcctgacagtgtgctacgtacttaccggtcgatcagcagacctggagttggaacgcgccgcggacgtgcggtgggaggagcaggctgaaatatctggcagttcccccatcctcagcattactatctctgaggatgggagcatgtccattaagaatgaagaggaggaacagacactgaccatcctaataagaactggactgcttgtcatctcaggcctcttcccagttagtattcccatcacagccgcagcctggtatctgtgggaggtgaaaaagcaaagggctggtgtgttgtgggacgtccctagcccaccccctgtggggaaagcagaattagaggatggagcctaccgtattaagcagaagggcatcctgggctattctcagataggggcgggagtttacaaagaaggtacctttcacacgatgtggcatgtaactcgcggcgctgtgctcatgcacaaggggaaacggattgagccgtcctgggccgacgtcaagaaagatctgatctcatacggaggcggttggaaacttgagggggaatggaaggagggagaagaggtgcaggttctggcattggaaccaggcaaaaaccccagagccgtgcaaaccaagcctggcctattcaaaacaagtaccgggacaatcggagctgtcagcctggacttttccccaggtacttctggctcgcccattgtggataagaaagggaaggtagtcggactctatggcaacggtgtggttaccaggagcgggacgtacgtgtcagccatcgcacagacagagaagtccatagaggacaatcctgaaattgaggatgacatcttcagaaagaagcggctgactattatggatcttcatccgggagctggcaaaaccaagcgctatttacccgccatcgtcagagaagcgataaaaaggggcctgcggacactcattttggccccaacccgagtggttgcagctgagatggaagaggccctgagagggctccctatccgctaccagactcccgctatcagggcagagcacaccggacgtgaaattgtggacctgatgtgtcatgccacattcacgatgcggcttctgagtccaatcagagtccctaactataatttgattataatggatgaggcccactttactgaccccgcttctatcgcggcaaggggttacattagcacccgcgtggaaatgggcgaggccgctgggatcttcatgacagccaccccaccgggatcccgagacccttttccccagtcaaacgcaccaatcatggatgaggaaagagagattcccgaacggtcttggaatagcggccacgagtgggtaactgacttcaagggtaagacagtgtggtttgttcctagtataaaagccgggaacgatatcgctgcgtgcctaaggaagaatggcaaaaaggtcattcaactgtcccgcaaaaccttcgacagcgaatatatcaagacgcgtactaacgattgggactttgtggtgacaaccgatatttctgagatgggcgccaatttcaaggcagagagagtcatcgacccacggaggtgtatgaaacccgtaatactcaccgatggcgaagaacgcgtgatcttagctgggcctatgccggttactcattcatccgccgcacagcgaagaggacgggtgggtaggaacccaaagaatgaaaacgaccagtacatttacatgggcgagcccctggaaaatgatgaggactgcgcccactggaaagaggctaagatgcttctggacaacatcaatacacctgaagggattatccccagtatgtttgagccagaacgcgagaaagtcgatgccatagacggagaatatagactcaggggcgaggcgcggaagaccttcgtggatttgatgcgtcgcggtgacctgcctgtttggctcgcataccgagtggccgctgaggggattaactatgccgatagaaggtggtgttttgacggcgtcaaaaacaatcaaatcctggaagagaacgtggaagtagagatttggacaaaggagggagaacggaagaaacttaagccccgctggctagatgctagaatctacagcgacccactggcattgaaagagttcaaggagttcgccgctggcaggaaatcgttaactctgaatctcataacggagatggggcggctgcctacctttatgacacagaaggtgcgaaacgcccttgataatctggcagttctccatactgcggaagccggaggtagagcttataaccacgccttgtctgagctgccggagaccctagaaacactgctccttctgaccttattggcaactgtcacgggcgggatcttcctgtttctcatgtccggaaagggcgtgggtaaaatgaccctggggatgtgctgcattatcacagctagcattcttctgtggtacgcccagatccagccccactggatagcagcctcaattatcctcgagttctttttgatcgtgctgttaattccagaacctgagaagcaacgcactccccaggacaatcagctaacctatgtcgttatcgctatactgacagtggtagcggccaccatggcaaacgaaatgggcttcctcgagaaaactaagaaagattttggacttggcagtattacaacgcagcaaccagagtctaatatcctggacattgatttgaggcctgcttccgcctggaccctgtacgccgtggcaactacattcatcacccccatgctccggcatagcatagaaaactcaagtgtcaatgtgagcctgaccgctatcgccaaccaggcgacagttcttatggggctcggaaagggttggccgctgtccaagatggacattggcgtgccattgctggctatcgggtgttactctcaggtcaatcctattactttaacggccgcactactgctccttgtagcccactatgctatcattggacccggcctgcaggcaaaagccacccgtgaggcgcaaaagagaacagctgccggtatcatgaaaaacccaactgtggacgggataaccgttattgatttggaccccatcccttacgatccgaagtttgaaaaacagctgggccaggtgatgctcctggtcctttgcgtgacacaggtcttaatgatgaggaccacttgggcactgtgtgaggccctcacgttggctacaggacccatcagcaccctgtgggaaggcaatccagggcgcttctggaacactaccattgccgtgtccatggcaaatatatttcggggatcatatctagctggcgccggtctactcttctctatcatgaagaacacagcgaacactcgaagagggaccggaaatacaggcgagacgcttggtgagaagtggaaaaacaggctgaatgccttgggcaagagtgaatttcaaatttacaaaaagtcggggatccaggaggttgaccgcaccctggcaaaagaaggaattaagcggggcgagactgatcatcacgctgtgagcagagggtccgccaaactccgttggttcgtagagaggaacctggtgacacctgaaggaaaggtcgttgacttaggctgcggtagaggcgggtggtcttattactgtgggggtcttaagaatgtgaaagaggtcaagggcctgaccaaagggggacccggccatgaggaacctatcccaatgtcaacttatgggtggaacctcgtgcgcctacagagcggagtagatgtgttctttacaccccctgaaaagtgcgacaccctgttgtgtgatataggcgagtccagtccaaatcccacggttgaggcaggtcgaaccctgagagtgctcaaccttgtcgaaaattggctgaacaataacacacaattctgcatcaaagtgttgtctccgtacatgcctagcgtcattgagaagatggaagctctgcagaggaagtacgggggagccctcgtgcggaatccattatcacgcaactccactcacgagatgtattgggttagtaatgccagcggcaacatcgtatcttccgtgaacatgatttcaagaatgctgatcaataggtttaccatgcgacacaaaaaggcgacatacgaacccgacgtcgatcttggcagcgggactcggaacataggaattgagtcggagacccctaatctggacatcatcggtaaacgtattgaaaagataaaacaggagcatgaaacatcttggcactatgatcaggaccatccatacaagacctgggcttatcacggcagttacgagactaagcaaacggggtccgcaagctcaatggtgaacggagttgtgagactactcacaaaaccctgggacgtcatcccgatggtgacccagatggccatgactgataccacacctttcggccagcagcgcgtatttaaggaaaaagtggacacgaggacccaagagcccaaggagggtactaaaaagctgatgaagattacagctgaatggttgtggaaagagctggggaagaaaaagaccccacggatgtgtactagagaagagttcacacgcaaagttaggtccaatgccgcactcggagccatctttaccgatgagaacaagtggaaatctgctcgagaagcggtcgaggacagcggcttctgggaacttgtggataaggagcggaatctgcacttagaaggcaagtgcgagacatgtgtgtataacatgatggggaaaagagagaagaaactgggagaatttggtaaggccaaaggcagtagggcaatttggtacatgtggttgggggctcgcttcctcgagtttgaagccctgggattcctaaatgaggaccattggttttcccgtgaaaacagcctttctggcgtcgagggtgaggggctgcacaagctcggatacatcctgcgggatgtttcaaagaaagaaggcggcgcaatgtatgccgacgatactgctgggtgggacaccagaataacgttggaggatctgaagaatgaagagatggtgaccaaccatatggaaggagagcacaaaaagctcgccgaggcgatcttcaaacttacataccagaataaggtagtgagggtccagcgccctactccccgaggtaccgtgatggacattatcagtcggagagaccagaggggctccgggcaagttgtgacatatggactgaacactttcaccaatatggaagcacagttaattcgccagatggagggcgaaggtgtctttaagagcatccaacagctgacggtgacagaggagattgccgtcaaaaactggttggttaccgtggggagagaacggctctctaggatggctatatcgggagatgactgcgtcgtgaagccactggatgaccgtttcgcctcagcactaactgctcttaacgatatgggcaaagtgcgaaaggacatccagcagtgggagcccagccgcggctggaatgattggacacaagtccctttttgctcccatcacttccacgaactgattatgaaagacgggagagttctcgtggtaccatgtcggaaccaggatgagctgatcggaagggcccgcatcagtcagggtgctggctggtctttgagagaaaccgcctgcttaggaaagagctacgcacagatgtggtccctgatgtattttcatcggagggacctccgacttgcggccaatgctatttgttcagccgtgccgagtcactgggtccccacttctcgtaccacatggagcatacatgcaacgcacgagtggatgaccactgaggatatgctgacagtgtggaacagagtttggatccaagaaaatccttggatggaggacaagaccccagtggaatcctgggaggaaattccctacctaggaaaacgcgaggatcagtggtgcggctcactgatcggtctcactagccgggctacatgggccaagaacattcagaccgcaatcaatcaggtcaggtctttgatagggaacgaggaatatacggactacatgccttccatgaaaagattccgccgggaggaagaggaagccggagtgctgtggtga

SEQ ID NO: 14961 - RNA, 9876 nt, synthetic construct
  misc_feature 1..9876: note = derived and/or modified CDS sequence (opt3) from DENV-2__KC762679__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtggccccatctatgacaatgagatgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaacaccctgcgacgctgcggaagtactgcattgaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaagatcgtccagcctgaaaacctagagtatacaattgttataaccccacactccggagaagagaatgccgtgggtaacgatactggcaaacatgggaaggagatcaaagtaacgccgcagtcaagtattacagaagcagagctcaccggatacggcactgtgaccatggaatgtagccccaggacaggtctggacttcaatgagatggtccttctgcagatggaaaacaaggcttggttggtgcaccggcaatggtttctcgatctgcctttaccatggctgcccggggccgacacccagggctctaactggatccagaaagagactctcgttacattcaagaatcctcacgcgaagaaacaggatgtggtcgtgcttggatcccaagagggcgccatgcatacggcactgaccggggctactgaaatacagatgtcaagcggaaacttgctatttacaggtcacctgaagtgccgtctccgcatggacaaactgcagcttaagggcatgagttattctatgtgtaccgggaaattcaaggtagttaaggagattgccgaaacacaacatggaactatcgtgatcagagtccagtacgagggcgacggttccccatgcaaaattcccttcgagatcatggatctggaaaagaggtacgtgttggggcggctcattaccgtcaatccgatagtgacggagaaagacagccctgttaacatcgaagctgagcccccatttggcgattcgtatattatcatcggagtggaacctggccagctgaagttaaattggttcaaaaaggggtcttccattggacagatgtttgagaccacaatgcgaggtgccaagcgcatggcaatactgggcgacactgcctgggatttcgggtcactaggaggcgtatttaccagtatcggtaaagctctccaccaagtcttcggggcgatttacggcgcagcctttagcggagtgtcctggacaatgaagatcctgattggcgttgtgatcacttggatagggatgaactctagaagcacctcacttagtgtctccttggtgctggtaggagtggttacgctctatctgggcgtcatggtgcaggctgacagcggttgtgtggtctcttggaaaaataaggagcttaaatgcgggtcaggaatcttcattacagataacgttcatacctggactgaacagtacaagtttcagcccgagagtccaagcaagctggcctccgcaatccaaaaagcccacgaagagggcatttgtggtatcaggtctgtgacacggttggaaaatctcatgtggaagcagataacccccgagctgaaccacattttatcggagaatgaagtgaaactgactatcatgaccggcgacattaaggggatcatgcaggctggaaaacgcagcctaagacctcagccaacagagctcaagtattcctggaaagcctggggcaaggcaaagatgctgtcaacggaacttcataaccacaccttcttgatagatgggccggagactgcggaatgccccaatacaaacagggcttggaatagtctggaggtagaggactacggatttggcgtcttcaccacaaacatctggctcaaactgaaggaacgtcaagatgtgttttgtgactctaaattaatgagcgccgcaattaaggactcccgggccgttcatgctgatatgggttattggatcgagtcagccctgaacgacacttggaaaattgaaaaggcaagcttcatcgaggtgaagtcttgccactggcctaaatcccacaccctttggagtaatggggtcttggagagcgaaatgataattccaaagaacttcgctggacccgtgtctcagcataattaccgacctggctaccacacgcagacagccggtccatggcatctcggcagactggagatggattttgacttctgtgaagggaccactgttgtggtaaccgaggattgcggaaacaggggcccctccctacgcacaactaccgcgtcagggaaactgatcacagaatggtgctgtcggagttgcacgctcccgcctctgagatataggggagaggacggctgttggtacggtatggagatccgcccacttaaggaaaaagaggaaaatttggtcaacagcctggtgaccgccgggcacggacagattgataatttttcgttaggcgtgctcggtatggctctgttccttgaggaaatgctgcgaactcgggtcggcacaaagcatgcaatcttgctcgttgccgtgtcctttgtaaccctgattactgggaacatgtctttccgtgacctaggaagagtgatggtcatggtgggcgctacaatgaccgatgacatagggatgggagttacgtatctggccctcctggcagcgtttaaggtgaggcccactttcgccgctggccttttgctgcgcaaattaaccagcaaggagctcatgatgacaaccatcggtattgtcctgctttcacaagccactatccctgagacaattctggaactaaccgatgcactcgctctggggatgatggtgttgaaaatcgttcggaatatggagaagtaccagctggccgtgacaataatggcaatcttatgcgtccccaacgccgtaattctccagaatgcttggaaagtgagttgtactaccctggcggttgtgtccgtctctccacttctgttgacgagctcccaacagaaggccgactggatccctctcgcactgacaattaagggactaaaccccaccgctatctttctgactaccctttcaagaacaagcaaaaagaggagttggccactcaatgaagccataatggccgtgggcatggtatctattctggcttccagcttgctgaaaaacgatatcccgatgactggccctttagtggcagggggactcctgaccgtctgctatgttcttacgggtcgatcggccgacctggagttggaacgcgcggctgacgtgcggtgggaggagcaggccgaaatctcaggctctagtcccattctctccataacaatcagcgaggatgggtctatgagcattaagaatgaagaggaggaacagaccctgactatcctaattagaacaggactgcttgtgatctccggcctcttcccagtctcaatacccatcaccgcagccgcttggtacctgtgggaggtgaaaaagcaaagggcaggtgttttgtgggacgtacctagtccaccccctgtggggaaagccgaattagaggatggagcgtatcgtattaagcagaagggcatcctgggctacagccagattggggctggagtctacaaagaaggtacttttcacacaatgtggcacgtgacccgcggcgccgttctcatgcataaggggaaacggatcgagccgtcttgggcagacgtgaagaaagatctgatatcctatggaggcggttggaagcttgagggggaatggaaggagggagaagaggtccaggtgctggccttggaaccaggcaaaaaccccagagctgtacaaacgaagcctggcctattcaaaactaacaccgggacaattggagccgtctcactggactttagtccaggtaccagcggctcccccatcgtggataagaaagggaaggttgtgggactctacggcaatggtgtcgtgacaaggtctgggacttatgtttcggcaatcgctcagaccgagaagagcattgaggacaaccctgaaatcgaggatgacatattccgaaaaaagcggctgacgattatggatcttcacccgggagccggcaaaacaaagcgctacttacccgcgatcgtgagagaagccattaaaaggggcctgcggactctcatcttggcaccaacccgagtcgtggctgccgagatggaagaggctctgagagggctccctatacgctatcagacacccgcaattagggccgagcataccggacgtgaaatcgtagacctgatgtgtcacgccactttcaccatgcggcttctgtcaccaatcagagtgcctaattacaacttgattatcatggatgaggctcattttacagaccccgcgtccattgcagccaggggttatataagtacgcgcgttgaaatgggcgaggctgccgggatcttcatgactgcaaccccaccgggatctcgagacccttttccccagagcaatgccccaattatggatgaggaaagagagatccccgaacggtcctggaactcaggccacgagtgggtcacagacttcaagggtaagaccgtgtggtttgtgccttctatcaaagctgggaatgatattgcggcctgcctaaggaagaacggaaaaaaggtcatacaactgagccgcaaaactttcgacagtgaatacatcaagacacgtaccaatgattgggactttgtagtgacgactgatatttccgagatgggcgcaaacttcaaggctgagagagttatcgacccacggaggtgtatgaaacccgtgattctcacagatggcgaagagcgcgtcatcttagccgggcctatgccggtgacccacagctctgcagcccagcgaagaggacgggttggtaggaatccaaagaacgaaaatgaccagtacatatatatgggcgagcccctggaaaacgatgaggactgcgctcattggaaagaggccaagatgcttctggacaatatcaacacccctgaagggattatcccctcaatgtttgagccagaacgcgagaaagtggatgcgattgacggagaatacagactcaggggcgaggcacggaagactttcgtcgatttgatgcgtcgcggtgacctgcctgtgtggctcgcctatcgagtagctgccgaggggatcaactacgctgatagaaggtggtgttttgacggcgtgaaaaataaccaaatactggaagagaatgttgaagtcgagatttggacaaaggagggagaacggaagaaacttaagccccgctggctagatgcaagaatctattccgacccactggccttgaaagagttcaaggaattcgctgccggcaggaaaagtttaaccctgaacctcattacagagatggggcggctgcctacttttatgacgcagaaggcacgaaatgcgcttgataacctggccgtgctccacaccgctgaagccggaggtagagcatacaatcatgctttgagcgagctgccggagacactagaaactctgctccttctgaccttattggccacagtgaccggcgggatcttcctgtttctcatgtcgggaaagggcataggtaaaatgactctggggatgtgctgcatcattacggcatctatccttctgtggtatgcccagattcagccccactggatcgctgcgtccataattctcgagttctttttgatcgtcctgttaatcccagaacctgagaagcaacgcaccccccaggacaaccagctaacatacgttgtgattgccatcctgactgtagtggcagctaccatggccaatgaaatgggcttcctcgagaaaacaaagaaagattttggacttggcagcataaccactcagcaaccagagtcaaacattctggacatcgatttgaggcctgccagtgcatggacactgtacgctgtcgccacgaccttcattactcccatgctccggcactctatcgaaaattccagcgtgaacgtttcactgacagcgatagctaatcaggccaccgtgcttatggggctcggaaagggttggccgctgagtaagatggacatcggcgtcccattgctggcaattgggtgttatagccaggtaaaccctatcaccttaacagccgctctactgctccttgtggcacattacgccattatcggacccggcctgcaggcgaaagctactcgtgaggcccaaaagagagcagccgctggtattatgaaaaatccaacggttgacgggatcaccgtgatagatttggaccccattccttatgatccgaagtttgaaaaacagctgggccaggtcatgctcctggtgctttgcgtcacacaggtgttaatgatgaggactacctgggccctgtgtgaggcactcacattggctaccggacccatctccactctgtgggaaggcaacccagggcgcttctggaatacgacaatcgccgtttctatggcgaacatttttcggggaagctacctagccggcgcaggtctgctcttctccataatgaagaacaccgctaatactcgaagagggaccggaaacacaggcgagactcttggtgagaagtggaaaaataggctgaacgccttgggcaagtcagaatttcaaatctataaaaagtctgggattcaggaggtggaccgcaccctggcaaaagaaggaatcaagcggggcgagacagatcaccatgctgtaagtagagggtcggccaaactccgttggttcgtggagaggaatctggtcacgcctgaaggaaaggttgtggacttaggctgcggtcgggggggatggagctactattgtggcggtcttaagaacgtcaaagaggtgaagggcctgaccaaagggggacccggccacgaagagcctattccaatgtccacttacgggtggaatctcgtacgcctacagtctggagtggatgttttctttacaccccctgaaaagtgcgacaccctgttgtgtgatatcggcgagtcaagcccaaaccccactgtggaggccggtcgaacactgagagtcctcaatcttgtggaaaactggctgaataacaatacccaattctgcataaaagtcttgaacccgtacatgccttccgtgatcgagaagatggaagcgctgcagaggaagtatgggggagctctcgttcggaatccattaagtcgcaactctacgcatgagatgtactgggtaagcaacgcatcaggcaatattgtgtccagtgtcaacatgatcagcagaatgctgattaataggtttaccatgcgacacaaaaaggccacatatgaacccgacgtggatcttggctctgggactcggaacatcggaatagagtccgagacccctaatctggacattatcggtaaacgtatcgaaaagattaaacaggagcacgaaacatcatggcattacgatcaggaccacccatataagacttgggcttaccatggcagctatgagaccaagcaaacagggtcggcctctagtatggttaacggagtggtcagactactcaccaaaccctgggacgtgataccgatggtaactcagatggcaatgacggatacaacccctttcggccagcagcgcgtgtttaaggaaaaagttgacactaggacccaagagcccaaggagggtacaaaaaagctgatgaagatcacggccgaatggttgtggaaagagctggggaagaaaaagaccccacggatgtgtactagagaagagttcacacgcaaagtcaggtccaatgctgcgctcggagccatttttaccgatgagaacaagtggaaaagcgcacgagaagctgtggaggactcaggcttctgggaacttgtggataaggagcggaatctgcacttagaaggcaagtgcgagacttgtgtctacaacatgatggggaaaagagagaagaaactgggagaatttggtaaggccaaaggctccagggcaatctggtacatgtggttgggggcccgcttcctcgagtttgaagctctgggattcctaaatgaggaccactggttttctcgtgaaaacagccttagtggcgttgagggtgaggggctgcataagctcggatatattctgcgggatgtgtccatgaaggaaggcggcgccatgtacgcggacgatacagcagggtgggacaccagaatcacattggaggatctgaaaaatgaagagatggtaactaaccacatggaaggagagcataagaaactcgccgaggctatattcaagcttacctatcagaataaagtggtcagggtgcagcgccctacgccccgaggtaccgttatggacatcattagccggagagaccagaggggctctgggcaagtggtcacatacggactgaacactttcaccaacatggaagcccagttaatccgccagatggagggcgaaggtgtgtttaagtcaattcaacagctgacagtaactgaggagatcgcagttaagaattggttggtgagagtcgggcgggaaaggctcagtcgtatggctatttccggagatgactgcgtggtgaaaccactggatgaccgattcgccagcgctctaaccgcccttaacgatatgggcaaggtccgcaaagacatacagcagtgggagccctctagaggctggaatgattggacgcaagttcctttttgctcgcaccatttccacgaactgatcatgaaggacgggcgggtgctcgtagtgccatgtaggaaccaggatgagctgattggacgcgcaagaatctcacagggtgcgggctggagcttgcgggaaacagcctgcttagggaaatcctatgctcagatgtggagtctgatgtactttcacaggcgagacctccgtcttgccgcaaatgctatctgttctgccgtcccgagccattgggtgcccacctccagaactacatggtcaattcacgcaacccatgagtggatgactaccgaggatatgctgacagtttggaaccgcgtgtggatacaagaaaatccttggatggaggacaagacgccagtcgaaagttgggaggaaatcccctatctaggaaagcgggaggatcagtggtgcggctctctgattggtctcaccagcagggccacttgggcgaaaaacatccagacagctattaatcaggtgagatccttgatcgggaacgaggaatacaccgactacatgccttcaatgaagcgcttccggagggaggaagaggaagccggagtactgtggtga

SEQ ID NO: 14962 - RNA, 9876 nt, synthetic construct
  misc_feature 1..9876: note = derived and/or modified CDS sequence (opt3) from DENV-2__KC762680__SS-prME
  source 1..9876: mol_type = other RNA
accgcaggaatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgcaacgggagagcaccgccgagaaaaacgtagtgtagcgctcgtgccccatgtcggcatgggtctggagactcggaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtggccccatctatgacaatgagatgcatcggcatatcgaacagggactttgtcgaaggggtgtcaggaggtagctgggttgatattgttctggagcacggcagttgtgtgaccactatggctaaaaataagcccacactcgacttcgaattaatcaagaccgaggccaaacaccctgcgacgctgcggaagtactgcattgaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaagatcgtccagcctgaaaacctagagtatacaattgttataaccccacactccggagaagagaatgccgtgggtaacgatactggcaaacatgggaaggagatcaaagtaacgccgcagtcaagtattacagaagcagagctcaccggatacggcactgtgaccatggaatgtagccccaggacaggtctggacttcaatgagatggtccttctgcagatggaaaacaaggcttggttggtgcaccggcaatggtttctcgatctgcctttaccatggctgcccggggccgacacccagggctctaactggatccagaaagagactctcgttacattcaagaatcctcacgcgaagaaacaggatgtggtcgtgcttggatcccaagagggcgccatgcatacggcactgaccggggctactgaaatacagatgtcaagcggaaacttgctatttacaggtcacctgaagtgccgtctccgcatggacaaactgcagcttaagggcatgagttattctatgtgtaccgggaaattcaaggtagttaaggagattgccgaaacacaacatggaactatcgtgatcagagtccagtacgagggcgacggttccccatgcaaaattcccttcgagatcatggatctggaaaagaggtacgtgttggggcggctcattaccgtcaatccgatagtgacggagaaagacagccctgttaacatcgaagctgagcccccatttggcgattcgtatattatcatcggagtggaacctggccagctgaagttaaattggttcaaaaaggggtcttccattggacagatgtttgagaccacaatgcgaggtgccaagcgcatggcaatactgggcgacactgcctgggatttcgggtcactaggaggcgtatttaccagtatcggtaaagctctccaccaagtcttcggggcgatttacggcgcagcctttagcggagtgtcctggacaatgaagatcctgattggcgttgtgatcacttggatagggatgaactctagaagcacctcacttagtgtctccttggtgctggtaggagtggttacgctctatctgggcgtcatggtgcaggctgacagcggttgtgtggtctcttggaaaaataaggagcttaaatgcgggtcaggaatcttcattacagataacgttcatacctggactgaacagtacaagtttcagcccgagagtccaagcaagctggcctccgcaatccaaaaagcccacgaagagggcatttgtggtatcaggtctgtgacacggttggaaaatctcatgtggaagcagataacccccgagctgaaccacattttatcggagaatgaagtgaaactgactatcatgaccggcgacattaaggggatcatgcaggctggaaaacgcagcctaagacctcagccaacagagctcaagtattcctggaaagcctggggcaaggcaaagatgctgtcaacggaacttcataaccacaccttcttgatagatgggccggagactgcggaatgccccaatacaaacagggcttggaatagtctggaggtagaggactacggatttggcgtcttcaccacaaacatctggctcaaactgaaggaacgtcaagatgtgttttgtgactctaaattaatgagcgccgcaattaaggactcccgggccgttcatgctgatatgggttattggatcgagtcagccctgaacgacacttggaaaattgaaaaggccagcttcatcgaggtgaagtcttgccactggcctaaatcccacaccctttggagtaatggggtcttggagagcgaaatgataattccaaagaacttcgctggacccgtgtctcagcataattaccgacctggctaccacacgcagacagccggtccatggcatctcggcagactggagatggattttgacttctgtgaagggaccactgttgtggtaaccgaggattgcggaaacaggggcccctccctacgcacaactaccgcgtcagggaaactgatcacagaatggtgctgtcggagttgcacgctcccgcctctgagatataggggagaggacggctgttggtacggtatggagatccgcccacttaaggaaaaagaggaaaatttggtcaacagcctggtgaccgccgggcacggacagattgataatttttcgttaggcgtgctcggtatggctctgttccttgaggaaatgctgcgaactcgggtcggcacaaagcatgcaatcttgctcgttgccgtgtcctttgtaaccctgattactgggaacatgtctttccgtgacctaggaagagtgatggtcatggtgggcgctacaatgaccgatgacatagggatgggagttacgtatctggccctcctggcagcgtttaaggtgaggcccactttcgccgctggccttttgctgcgcaaattaaccagcaaggagctcatgatgacaaccatcggtattgtcctgctttcacaagccactatccctgagacaattctggaactaaccgatgcactcgctctggggatgatggtgttgaaaatcgttcggaatatggagaagtaccagctggccgtgacaataatggcaatcttatgcgtccccaacgccgtaattctccagaatgcttggaaagtgagttgtactaccctggcggttgtgtccgtctctccacttctgttgacgagctcccaacagaaggccgactggatccctctcgcactgacaattaagggactaaaccccaccgctatctttctgactaccctttcaagaacaagcaaaaagaggagttggccactcaatgaagccataatggccgtgggcatggtatctattctggcttccagcttgctgaaaaacgatatcccgatgactggccctttagtggcagggggactcctgaccgtctgctatgttcttacgggtcgatcggccgacctggagttggaacgcgcggctgacgtgcggtgggaggagcaggccgaaatctcaggctctagtcccattctctccataacaatcagcgaggatgggtctatgagcattaagaatgaagaggaggaacagaccctgactatcctaattagaacaggactgcttgtgatctccggcctcttcccagtctcaatacccatcaccgcagccgcttggtacctgtgggaggtgaaaaagcaaagggccggtgttttgtgggacgtacctagtccaccccctgtggggaaagccgaattagaggatggagcgtatcgtattaagcagaagggcatcctgggctacagccagattggggctggagtctacaaagaaggtacttttcacacaatgtggcacgtgacccgcggcgccgttctcatgcataaggggaaacggatcgagccgtcttgggcagacgtgaagaaagatctgatatcctatggaggcggttggaaacttgagggggaatggaaggagggagaagaggtccaggtgctggccttggaaccaggcaaaaaccccagagctgtacaaacgaagcctggcctattcaaaactaacaccgggacaattggagccgtctcactggactttagtccaggtaccagcggctcccccatcgtggataagaaagggaaggttgtgggactctacggcaatggtgtcgtgacaaggtctgggacttatgtttcggcaatcgctcagaccgaaaagagcattgaggacaaccctgaaatcgaggatgacatattcagaaagaagcggctgacgattatggatcttcacccgggagccggcaaaacaaagcgctacttacccgcgatcgtgagagaagccattaaaaggggcctgcggactctcatcttggcaccaacccgagtcgtggctgccgagatggaagaggctctgagagggctccctatacgctatcagacacccgcaattagggccgagcataccggacgtgaaatcgtagacctgatgtgtcacgccactttcaccatgcggcttctgtcaccaatcagagtgcctaattacaacttgattatcatggatgaggctcattttacagaccccgcgtccattgcagccaggggttatataagtacgcgcgttgaaatgggcgaggctgccgggatcttcatgactgcaaccccaccgggatctcgagacccttttccccagagcaatgccccaattatggatgaggaaagagagatccccgaacggtcctggaactcaggccacgagtgggtcacagacttcaagggtaagaccgtgtggtttgtgccttctatcaaagctgggaatgatattgcggcctgcctaaggaagaacggcaagaaggtcatacaactgagccgcaaaactttcgactttgaatacatcaagacacgtaccaatgattgggacttcgtagtgacgactgatattagtgagatgggcgcaaactttaaggctgagagagttatcgacccacggaggtgtatgaaacccgtgattctcacagatggcgaagaacgcgtcatcttagccgggcctatgccggtgacccactccagcgcagcccagcgaagaggacgggttggtaggaatccaaagaacgaaaatgaccagtacatatatatgggcgagcccctggaaaacgatgaggactgcgctcattggaaagaggccaagatgcttctggacaatatcaacacccctgaagggattatcccctctatgttcgagccagaacgcgagaaagtggatgcgattgacggagaatacagactcaggggcgaggcacggaagacttttgtcgatttgatgcgtcgcggtgacctgcctgtgtggctcgcctatcgagtagctgccgaggggatcaactacgctgatagaaggtggtgtttcgacggcgtgaaaaataaccaaatactggaagagaatgttgaagtcgagatttggacaaaggagggagaacggaagaaacttaagccccgctggctagatgcaagaatctattcagacccactggccttgaaagagttcaaggaatttgctgccggcaggaaatccttaaccctgaacctcattacagagatggggcggctgcctactttcatgacgcagaaggcacgaaatgcgcttgataacctggccgtgctccacaccgctgaagccggaggtagagcatacaatcatgctttgagtgagctgccggagacactagaaactctgctccttctgaccttattggccacagtgaccggcgggatctttctgttcctcatgagcggaaagggcataggtaaaatgactctggggatgtgctgcatcattacggcatcgatccttctgtggtatgcccagattcagccccactggatcgctgcgtctataattctcgagtttttcttgatcgtcctgttaatcccagaacctgagaagcaacgcacaccccaggacaaccagctaacatacgttgtgattgccatcctgactgtagtggcagctaccatggccaatgaaatgggctttctcgagaaaacaaagaaagatttcggacttggctccataaccactcagcaaccagagagcaacattctggacatcgatttgaggcctgcctcagcatggacactgtacgctgtcgccacgacctttattactcccatgctccggcacagtatcgaaaattcttccgtgaacgttagcctgacagcgatagctaatcaggccaccgtgcttatggggctcggaaagggttggccgctgtcaaagatggacatcggcgtcccattgctggcaattgggtgttatagtcaggtaaaccctatcaccttaacagccgctctactgctccttgtggcacattacgccattatcggacccggcctgcaggcgaaagctactcgtgaggcccaaaagagagcagccgctggtattatgaaaaatccaacggttgacgggatcaccgtgatagatttggaccccattccttatgatccgaagttcgaaaaacagctgggccaggtcatgctcctggtgctttgcgtcacacaggtgttaatgatgaggactacctgggccctgtgtgaggcactcacattggctaccggacccatcagcactctgtgggaaggcaacccagggcgcttttggaatacgacaatcgccgtttccatggcgaacattttccggggatcttacctagccggcgcaggtctgctctttagcataatgaagaacaccgctaatactcgaagagggaccggaaacacaggcgagactcttggtgagaagtggaaaaataggctgaacgccttgggcaagtccgagttccaaatctataaaaagtcagggattcaggaggtggaccgcaccctggcaaaagaaggaatcaagcggggcgagacagatcaccatgctgtatctagagggagtgccaaactccgttggttcgtggagaggaatctggtcacgcctgaaggaaaggttgtggacttaggctgcggtagagggggatggtcgtactattgtggcggtcttaagaacgtcaaagaggtgaagggcctgaccaaagggggacccggccacgaggaacctattccaatgagcacttacgggtggaatctcgtacgcctacagtccggagtggatgtatttttcacaccccctgaaaagtgcgacaccctgttgtgtgatatcggcgagtcttcaccaaaccccactgtggaggccggtcgaacactgagagtcctcaatcttgtggaaaactggctgaataacaatacccaattttgcataaaagtcttgaacccgtacatgcctagcgtgatcgagaagatggaagcgctgcagaggaagtatgggggagctctcgttcggaatccattatcccgcaacagtacgcatgagatgtactgggtatctaacgcaagcggcaatattgtgtcatccgtcaacatgatcagtagaatgctgattaataggttcaccatgcgacacaaaaaggccacatatgaacccgacgtggatcttggcagcgggactcggaacatcggaatagagtctgagacccctaatctggacattatcggtaaacgtatcgaaaagattaaacaggagcacgaaacatcctggcattacgatcaggaccacccatataagacttgggcttaccatggctcatatgagaccaagcaaacagggagcgcctcgtctatggttaacggagtggtcagactactcaccaaaccctgggacgtgataccgatggtaactcagatggcaatgacggatacaaccccttttggccagcagcgcgtgttcaaggaaaaagttgacactaggacccaagagcccaaggagggtaccaaaaagctgatgaagatcacggccgaatggttgtggaaagagctggggaagaaaaagaccccacggatgtgtactagagaagagtttacacgcaaagtcaggagtaatgctgcgctcggagccattttcaccgatgagaacaagtggaaatccgcacgagaagctgtggaggacagcggcttttgggaacttgtggataaggagcggaatctgcacttagaaggcaagtgcgagacttgtgtctacaacatgatggggaaaagagagaagaaactgggagagttcggtaaggccaaaggctcaagggcaatctggtacatgtggttgggggcccgctttctcgagttcgaagctctgggatttctaaatgaggaccactggttctcccgtgaaaactctcttagcggcgttgagggtgaggggctgcataagctcggatatattctgcgggatgtgagtatgaaggaaggcggcgccatgtacgcggacgatacagcagggtgggacaccagaatcacattggaggatctgaaaaatgaagagatggtaactaaccacatggaaggagagcataagaaactcgccgaggctatattcaaacttacctatcagaataaagtggtcagggtgcagcgccctacgccccgaggtaccgttatggacatcatttcccggagagaccagaggggcagcgggcaagtggtcacatacggactgaacacttttaccaacatggaagcccagttaatccgccagatggagggcgaaggtgtgttcaagtctattcaacagctgacagtaactgaggagatcgcagttaagaattggttggtgagagtcgggcgggaaaggctctcacgtatggctattagtggagatgactgcgtggtgaaaccactggatgaccgatttgcctccgctctaaccgcccttaacgatatgggcaaggtccgcaaagacatacagcagtgggagcccagcagaggctggaatgattggacgcaagttcctttctgctctcaccattttcacgaactgatcatgaaggacgggcgggtgctcgtagtgccatgtaggaaccaggatgagctgattggacgcgcaagaatctcgcagggtgcgggctggtcattgcgggaaacagcctgcttagggaaaagctatgctcagatgtggtccctgatgtacttccacaggcgagacctccgtcttgccgcaaatgctatctgtagtgccgtcccgtctcattgggtgcccaccagcagaactacatggtccattcacgcaacccatgagtggatgactaccgaggatatgctgacagtttggaaccgcgtgtggatacaagaaaatccttggatggaggacaagacgccagtcgaatcatgggaggaaatcccctatctaggaaagcgggaggatcagtggtgcggcagtctgattggtctcacctctagggccacttgggcgaaaaacatccagacagctattaatcaggtgcgcagcttgaaggggaacgaggaatacaccgactacatgccttccatgaaacgatttcggagggaggaaggagaggccggcgtactgtggtga

SEQ ID NO: 14963 - RNA, 9876 nt, synthetic construct
  misc_feature 1..9876: note = derived and/or modified CDS sequence (opt3) from DENV-2__JQ955624__SS-prME
  source 1..9876: mol_type = other RNA
accgccggagtgataattatgctgatacccactgctatggcattccacctcactacgcgaaacggggaacctcatatgatcgtctcaaggcaggaaaagggaaaatcccttctgtttaagaccgaagacggtgttaatatgtgcacgttgatggccatggatttaggcgaactgtgtgaggacactattacctacaactgcccactactccggcaaaatgaaccggaggatatcgactgttggtgcaactctacctcaacctgggtgacttatgggacatgtaccgcgacgggagagcaccgccgagaaaaacgtagtgtggctctggtgccccatgtcggcatgggtcttgagactagaaccgaaacatggatgagctccgagggggcctggaagcacgcacagaggattgagacttggatcctgcggcatcctggattcgccataatggctgcaatcttggcctacaccattggcacaacccactttcagcgcgtgctcatcttcattctgctgacggctgttgccccatctatgactatgagatgcatcggcatatcgaatagggattttgtggaaggggtctcaggaggtagctgggtggacattgtactcgagcacggcagttgtgttacaaccatggcgaaaaacaagcccactttagatttcgaactgatcaagacagaggcaaaacagcctgccacccttcggaagtattgcattgaagctaaattgacgaataccacaactgcctcccgctgtccaacccaaggggagccctctctgaacgaggaacaggacaagcgatttgtgtgcaaacatagcatggtcgatagaggatggggcaatggttgtgggctattcggaaagggcggcatcgtgacatgcgcaatgtttacttgcaagaaaaacatggaggggaagatcgtgcagcctgaaaatctcgagtacaccattgtcgttacaccacactccggagaagagaacgctgtgggtaatgacaccggcaaacatgggaaggagataaaagtaactccgcagtcaagtatcacggaagccgagctgacaggatatggcaccgtgactatggaatgtagccccaggaccggtcttgatttcaacgagatggtcctgttgcaaatggaaaataaggcgtggctcgtgcaccggcagtggtttctggacttacctctgccatggctccccggggccgatacacagggctctaactggattcagaaagagacccttgttactttcaagaaccctcacgcaaagaaacaagacgtggtcgtgctgggatcccaggagggcgctatgcatacagccttgacgggggctaccgaaatccagatgtcaagcggaaatctactgtttactggtcacctcaagtgccgtctgcgcatggacaaacttcaactgaagggcatgagttactctatgtgtacagggaaattcaaggtagttaaggagatagccgaaacccagcatggaacaattgtggtcagagtgcagtatgagggcgatggttccccatgcaaaatccccttcgagatcatggacttggaaaagaggcacgtcctcgggcggctgattactgtgaacccgatcgttaccgagaaagatagccctgtgaatattgaagcagagcccccatttggcgactcgtacataatcattggagtagaacctggccagttaaagctgtcttggttcaaaaaggggtcctcaatcggacaaatgtttgagacgaccatgcgaggtgccaagcgcatggctatcctaggcgatacagcgtgggacttcgggagtctcggaggcgtctttactagcattggtaaagcactgcatcaggtgttcggggccatatacggcgctgccttttccggagtttcttggaccatgaagatccttattggcgtggtcatcacatggattgggatgaacagcagatcaacaagtttgtccgtgagcctggtactcgtgggagttgtcaccctgtatcttggcgtgatggtgcaggcagattctggttgtgtcgtttcatggaaaaataaggagctgaaatgcgggagtggaatcttcataacggacaacgtgcacacatggaccgaacagtacaagtttcaacccgagagcccatccaagttggcctctgctatccagaaagcccacgaagagggcatttgtggtatcaggtcggtgactcggctcgaaaatctgatgtggaagcagattacacccgagttaaaccatatcctgagcgagaatgaagtaaaactaaccataatgactggcgatattaaggggatcatgcaggcaggaaaacgctccctcagacctcaaccaaccgagctgaagtattcatggaaaacatggggcaaggcgaagatgcttagtacggaatctcacaaccagaccttcttgattgacgggccggagactacagaatgccccaataccaacagggcttggaatagcctggaggtcgaggattacggatttggcgtgttcacaactaacatctggctcaaactgaaggaacgtcaggacgtattttgtgactccaaattaatgtcagccgcagtgaaggataatcgggccgtccatgctgacatgggttattggatagagagcgccctgaacgatacctggaaaatcgaaaaggcatctttcattgaggtgaagtcctgccactggcctaaaagtcacacgctttggagcaacggggttttggagtctgaaatgatcattccaaagaatttcgctggacccgtgtcccagcataactaccgacctggctatcacacacaaaccgccggtccatggcatctcggcaaactggagatggactttgatttctgtgaagggactaccgtagtcgtgacagaggactgcggaaatagaggcccctcactaaggactaccacagcgagtgggaagctgatcacggaatggtgctgtcgcagctgcaccctcccgcctctgcggtacagaggagaggatggctgttggtacggtatggagataaggccacttaaagaaaaggaggaaaacttggtaaattcgctggtcactgccgggcacggacagattgacaacttttccttaggcatcctcggtatggctctgttccttgaggaaatgctgcgcacacgagttggcaccaagcatgcagtgttgctcgtagccgtgtcttttatgactctgatcacagggaatatgagcttccgggatctaggacgtgtcatggtgatggttggcgctgccatgaccgacgatattgggatgggagtgacgtatctggcactcctggcggcctttaaagtcagacccactttcgctgccggccttttgctgaggaagttaacctcaaaagagctcatgatgacaaccatcggtattgtgctgcttagtcagtccactatacctgagacaatcctggaactaaccgacgcactcgctctggggatgatggttttgaagattgtgcgcaacatggagaaataccaactggccgtcacaatcatggcaattttatgcgtacccaatgccgtgatcctccagaacgcttggaaggtttcttgtactatactggcggtggtcagcgtgtccccacttctgttgacctcaagccagcagaaggccgattggatccctctcgcactgacgattaaaggactaaatcccacagctatctttctgaccactcttagtcggaccaacaagaaaagatcttggccactcaatgaagccattatggccgtaggcatggtgtccatcctggctagctcgttgctgaagaacgacataccgatgacaggccctttagtcgcagggggactcctgactgtttgctatgtgcttaccggtaggtcagccgacctggagttggaacgagcggctgatgtgcgctgggaggaccaagccgagatttctggcagttcccccatcctcagcatcacgatttctgaagatgggagcatgtccatcaagaatgaggaagaggagcagacactgaccatcctaattcggactggactgcttgtcatctcaggcctcttcccagtgagtattcccatcacagcagccgcttggtacctgtgggaagttaagaaacagagagccggtgttttgtgggacgtgcctagcccaccccctgtcgggaaggcagagttagaagatggagcgtataggataaagcagaaaggcatcctgggctactctcaaattggggctggagtgtataaggagggtacctttcacactatgtggcacgttacacgtggcgccgtgctcatgcataaagggaagcgcatcgaaccgtcctgggcagacgtccggaaagatctgatttcatacggaggcggttggaaacttgagggggagtggaaggaaggagaggaagtgcaggtactggccttggagccaggcaaaaaccccagagctgtccagaccaagcctggcctattcaaaacgaacactgggaccatcggagccgtgagtctggactttagcccaggtacatccggctctcccatagttgataagaaagggaaggtggtcggactctacggcaatggtgtggttaccaggtcggggacatatgtgagcgcaattgctcagtcagaaaagtccatcgaggacaaccctgagatcgaagatgacattttcagaaagaagcggctgactatcatggatcttcacccgggagccggcaaaaccaagcgctacttacccgcgatagtcagagaggccattaaaaggggcctgcggacgctcatcttggcaccaacacgagtggtagctgccgaaatggaggaagctctgagagggctccctattcgctatcaaactcccgcaatcagggccgagcataccggacgtgagatagtggacctgatgtgtcacgccacattcaccatgcggcttctgagtccagttagagtccctaattacaacttgattatcatggacgaagctcattttactgatcccgcgtctatcgcagccaggggttatattagcacccgcgtggagatgggcgaagctgccgggatcttcatgacagcaacgccaccgggatcccgagacccttttccccagtcaaatgccccaattatggatgaggagagagaaatacccgagcggtcttggaacagcggccacgaatgggtgactgacttcaagggtaagaccgtctggtttgtacctagtatcaaagctgggaatgatattgcggcctgcctaaggaagaacggcaaaaaggtgatccagctgtcccgcaaaacattcgacagcgagtacatcaagacccgtactaatgattgggactttgttgtgacaaccgatatttctgaaatgggcgcaaacttcaaggctgagagagtcatagacccacggaggtgtatgaaacccgtgatcctcacggatggcgaggaacgcgttattttagccgggcctatgccggtgactcactcatccgcagcccaacgaagaggacggatcggtaggaatccaaagaacgagaatgaccagtatatttacatgggcgaacccctggagaacgacgaagattgcgctcattggaaagaggccaagatgcttctggacaatatcaacacacctgaggggataatccccagtatgtttgaaccagagcgcgaaaaagtcgatgcgattgacggagagtacagactcaggggcgaagcacggaagaccttcgtggagttgatgcgtcgcggtgatctgcctgtatggctcgcctatcgagtggctgccgaggggatcaactacgctgacagaaggtggtgttttgatggcattaaaaataaccagatcctggaagagaatgttgaagtcgagatatggaccaaggagggagaacggaagaaacttaagccccgctggctagacgcaagaatttatagcgatccactggccttgaaagagttcaaggagttcgctgccggcaggaaatcgttaactctgaacctcatcacagagatggggcggctgcctacctttatgacacagaaggcacgaaatgcgcttgacaacctggccgtgctccacactgctgaagccggaggtagagcatacaatcatgctttgtctgagctgccggagacgctagaaaccctgctccttctgacattattggccactgtgaccggcgggattttcctgtttctcatgtccggaaagggcatcggtaaaatgacactggggatgtgctgcataatcaccgcaagcattcttctgtggtatgcccaaatccagccccactggattgctgcgtcaatcatactcgagttctttttgattgtcctgttaatcccagaacctgagaagcagcgcactccccaggataaccaactaacgtacgttgtgatcgccattctgaccgtagtggcagctacaatggccaatgaaatgggcttcctcgagaaaactaagaaagactttggattcggcagtatcgccacccagcagccagagtctaacatacttgatattgacctgaggcctgcatccgcttggacattgtatgccgtcgcgaccacttttatcacacccatgctgcggcacagcattgaaaattcaagtgtgaacgttagcctcacggctatcgccaatcaggcaaccgtgctgatggggcttggaaagggttggccgctctccaagatggacataggcgtcccactgttggccatcgggtgttactctcaagtaaaccctattactctgacagctgcattactactgctcgtggcccattacgcgatcattggacccggccttcaggctaaagccacccgtgaggcacagaagagagccgctgccggtatcatgaaaaatccaaccgttgatgggattacagtgatcgacctggatcccataccttatgacccgaagttcgaaaaacagttgggccaagtcatgctgctcgtgctgtgcgtcactcaggtgcttatgatgaggacgacctgggcattatgtgaggctctgacactcgccactggacccattagcaccttgtgggaaggcaacccagggcgcttttggaatacaaccatcgcggtttccatggccaacatcttccggggatcatacctggcaggcgctggtctactgttttctattatgaagaacactacgaatacacgaagagggaccggaaacactggcgagaccctcggtgagaagtggaaaaataggcttaacagtctgggcaagtcggagttccagatatataaacgcagcgggatccaagaggtggatcggacattggccaaggaaggaattaaaagaggcgagactgaccaccatgcagtatcccgtgggtctgctaagctgaggtggttcgtggagcggaatctcgtcacccctgaaggaaaagttatggatctgggctgcggtcgcgggggatggtcatactattgtggcggtttaaagaacgtgcgagaggtcaagggccttacaaaagggggacccggccacgaagaacctatcccaatgagcacgtacgggtggaatctggtgagactccagtccggagtagacgtgtttttcacaccccctgaaaagtgcgatactctactgtgtgacattggcgagagttctccaaaccccacagttgaggccggtaggaccttgcgggtgctgaatctcgtcgaaaactggcttaataacaatactcagttttgcatcaaagtgctgaacccgtatatgcctagcgtcatagagaagatggaaacattgcagcgcaaatacgggggagccctggtgagaaatccactctcaaggaactccacccatgagatgtactgggttagtaacgcgagcggcaatatcgtatcttccgtgaacatgatttcacgaatgttaatcaatcggttcacgatgcgtcacaagaaggctacctatgaacccgatgtcgacctgggcagcgggacaagaaacattggaatcgagtcggagactcctaatcttgatataattggtaaacgcatcgaaaagatcaaacaagagcacgaaacctcttggcattacgaccaggaccacccatataagacatgggcataccatggcagttatgagactaaacagaccgggtccgccagctcaatggtgaacggagttgtgaggctgctaacaaagccctgggatgtcattccgatggtgacccagatggctatgactgacacgacaccttttggccaacagcgggtattcaaggaaaaagtggataccagaactcaggagcccaaggagggtaccaaaaagctcatgaaaataacagccgaatggctgtggaaggagttggggaagaaaaagacgccacgcatgtgtaccagggaagagtttactcgaaaagttcggtccaatgcagccctgggagctatcttcacagacgagaacaagtggaaatctgcgagagaagccgtcgaggatagcaggttttgggaactcgtggacaaggagcgcaatcttcacctggaaggcaaatgcgagacctgtgtgtacaacatgatgggcaagcgtgagaagaaaatgggggagttcggaaaggcaaaaggtagtcgggctatttggtatatgtggttaggcgccagatttctggagttcgaagcattggggtttctcaatgaggatcactggttctccagggaaaacagcctgtctggagtcgagggcgagggtctacataaacttgggtacatcctgcgcgaagttagcaaaaaggagggaggcgccatgtacgctgacgatactgccggctgggacacacgaattaccctcgaagatctgaagaatgaggaaatggtgacaaaccacatggagggggagcataaaaagttggcggaagcaatcttcaaactgacttatcagaataaggtagtgcgggtccaaagacctacccccaggggaacggtgatggacataatcagtcgcagagaccagcggggttccggccaggttgggacctacggactcaacacatttactaacatgggcgcccaacttattaggcagatggagggtgaaggggtgttcaaaagcatccagcacctgaccacaactgaggaggtcgctgtgcaggattggttagcccgtgtaggacgagaacgcctgtctagaatggcaatttcgggcgacgattgcgttgtgaagccattggacgatcggtttgcttcagccctcaccgctctgaatgacatgggcaaggtcaggaaagatatccaacagtgggagcccagccgcgggtggaacgactggacacaggtgcctttctgctcccatcactttcacgaactaattatgaaggatggaagagtgcttgtcgttccatgtcggaatcaggacgagctgataggtagggcccgaatcagtcaaggcgcagggtggtctctccgtgaaacagcgtgcctgggaaaaagctatgcccagatgtggtccttgatgtacttccatagacgcgatttacggctggctgccaacgcaatttgttcagctgtgccgagtcactgggtacccacctctaggactacatggagcatccatgccagacacgagtggatgaccactgaggacatgctcaccgtgtggaatcgcgtctggatccaggaaaacccttggatggaggataagacaccagtggaatcctgggaggaaattccctatcttggcaaacgggaggaccagtggtgcggttcactgatagggctaacgagcagggcaacctgggccaagaatatccaaactgcgattaaccaggttcgatctctgatcggatccgaggaatacacagactatatgcctagtatgaagagatttcggagggaggaagaggaagctggcgtgctctggtga

SEQ ID NO: 14964 - RNA, 9876 nt, synthetic construct
  misc_feature 1..9876: note = derived and/or modified CDS sequence (opt3) from DENV-2__KJ918750__SS-prME
  source 1..9876: mol_type = other RNA
accgccggaatgatcattatgctgataccaacagtgatggctttccacctcactacgagaaacggggagcctcatatgatcgtcagcagacaggaaaagggaaaatcccttctgtttaagaccaaagacggtacaaatatgtgcactttgatggcaatggatttaggcgagctgtgtgaagacaccattacatacaagtgcccattccttcggcaaaacgagccggaagatatcgactgttggtgcaattctacctcaacttgggttacatatgggacctgtacgactaccggagagcaccgccgagagaaacgtagtgtggccctcgtaccccatgtgggcatgggtctggaaacaagaactgagacctggatgagctccgaaggggcgtggaagcacgctcagaggattgagatctggatacttcggcatcctggatttacaatcatggccgcaattctggcctacaccatcggcacgactcacttccagcgcgtcttgatttttatcctcctgacagctatagcaccatctatgaccatgagatgcattggcatctcgaacagggatttcgtggagggggtttcaggaggtagctgggtggacattgtcctggaacacggcagttgtgtgactacaatggccaagaataaacccaccctcgattttgagttaatcaagacggaagctaaacagcctgccaccctgcggaagtattgcatcgaggcgaaacttacaaacactaccacagactcccgctgtccaactcaaggggaacccaccttgaatgaggagcaggataagcgattcgtatgcaagcattctatggttgacagaggatggggcaacggttgtgggctgtttggaaaaggcggcattgtgacatgcgcaatgttcacatgcaagaaaataatgaaggggaaaatcgtccagcctgaaaatctagagtacactgtggtgattacgccacacagcggagaggaacatgccgtcggtaacgatacaggcaagcacgggaaagaagttaagatcaccccgcagtcctcaataactgaggctgagctcaccggatatggcacagtgaccatggaatgtagtcccaggactggtctggactttaatgagatggtacttctgcaaatggaagataaggcctggttggtgcaccggcagtggttcctcgacctgcctttaccatggctgcccggggcagacacacagggcagcaactggattcagaaagagacgctcgtcacctttaagaatcctcatgctaaaaagcaagatgtggttgtgcttggatctcaggaaggcgccatgcacactgcgctgacaggggccaccgagatccagatgtcctcaggaaacttgctattcacaggtcatctgaaatgccgtctccgcatggacaagctgcaacttaagggcatgagctacagtatgtgtactgggaaattcaaggtcgtgaaagagatcgcagaaacccagcacggaacgattgtaatcagagttcagtatgagggcgatggttctccatgcaagattccctttgaaataatggacctggagaaaaggcatgtgttggggcggctcatcaccgtcaatccgattgtgacagagaaggattcccctgtcaacatcgaagctgagcccccattcggcgacagctacatcattataggagtggaacctggccagctgaagttaaactggtttaaaaaggggtcgtctatcggacaaatgctggagactaccatgcgaggtgccaaacgcatggctattctaggcgatacagcctgggacttcgggtccctcggaggcgtttttacttcaatcggtaaggcactgcaccaggtgttcggggccatttacggcgctgcgtttagtggagtaagctggaccatgaaaatccttacgggcgtcataatcacatggattgggatgaactccagatctaccagcttgtcagtgagtctggttctcgtgggaatcgtcactctgtatcttggcgtgatggtacaggcagattccggttgtgtggttagctggaagaacaaggaactgaaatgcgggtctggaattttcgtcacagacaatgtgcacacctggactgagcagtacaagtttcaacccgagtcaccaagtaaattggccagcgctatccagaaggcccatgaagagggcatatgtggtattaggtccgtgacccggctcgaaaacctgatgtggaaacagatcacacccgagttaaatcacattctgtctgaaaacgaggtcaagctaacgatcatgaccggcgatataaaagggatcatgcaggttggaaagcgctcgctcagacctcaaccaactgagctgaggtatagctggaagacatggggcaaagcaaagatgctttccaccgaattgcataatcagacattcctgattgacgggccggagactgccgaatgccccaacaccaatcgtgcttggaactcactcgaggtggaagactacggatttggcgtgttcacgacaaatatctggctgcggttacgagagaaacaggatgtattttgtgacagtaagctgatgtctgccgcaattaaagataacagagcggtccacgctgacatgggttattggatcgagagcgcccttaatgatacctggaagatagaaaaggcatccttcattgaggtgaaatcatgccactggcctaagagccatactttgtggtctgacggggttctcgaatccgagatggtgatccccaagaatttcgccggacccgtcagtcagcacaataacaggcctggctaccatacccaaacagctggtccatggcacctgggcaagctagagatggattttgacttctgtgaagggactaccgtggttgtgacagaggattgcggaaaccgcggccccagcctgcggacgaccactgcctctgggaaactcatcacagaatggtgctgtagatcctgcaccctgccgcctcttaggtatcgcggagaggacggctgttggtacggtatggaaattcgaccattgaaggagaaggaggaaaatctggtatcaagtttagtcactgcagggcatggacagatcgataactttagcctcggcattctgggtatggctcttttcctggaggaaatgttgcggacacgtgtgggcaccaaacacgccatactcctggtggcggtctcgtttgttacgctaatcactgggaatatgtccttcagagacctgggaagggtgatggtaatggtgggcgccaccatgacagatgacattgggatgggagtcacctacctcgctctgcttgcagcctttaaggtgcgccccactttcgctgccggcttgctgttacggaaactcacatctaaggagctgatgatgaccacaatcggtattgttcttctgagccagtcaagtatccctgaaactatactagagctcaccgacgcactggcgttggggatgatggtgctgaaaatggtcagaaacatggagaagtatcaattagccgtgacgatcatggctattctctgcgttcccaatgccgtgatcctgcagaacgcatggaaggtctcctgtacaattcttgctctggtatctgtgagcccattgtttctcacctcctcacagcagaaagccgattggatccctctggcactaactataaagggactgaatcccaccgccattttccttacaactctcagcaggaccagtaaaaagcgatcttggccactgaacgaagctatcatggcggttggcatggtgtccatcttggccagctcgctgctaaagaatgacattccgatgacgggccctctcgtcgcagggggactgcttacagtgtgctacgtactgaccggtcgctcagctgatttggagctcgaacgggccgccgacgtgaagtgggatgaccaagctgagatatctggcagttcccccatcctgagcattactatctctgaagatgggagcatgtccattaaaaacgaggaggaagaacagacactaaccatcctgataagaactggacttctcgtcatctcaggcctgtttccagttagtattcccatcacagcagccgcgtggtatttgtgggaagtgaagaagcagagggctggtgtgttatgggacgtccctagcccaccccctgtggggaaagccgagctggaggatggagcataccgtattaagcagaaaggcatcctcggctattctcaaataggggccggagtttacaaggaaggtaccttccacacgatgtggcatgtaactcgcggcgctgtgctgatgcacaaagggaagcggattgagccgtcctgggcagacgtcaagaaagatcttatctcatatggaggcggttggaagctggaaggggagtggaaagaaggagaggaggtgcaggttttggccctagaaccaggcaagaatcccagagcggtgcagaccaaacctggcctgtttaagacaaacaccgggacaatcggagctgtcagtctcgacttcagcccaggtacttccggctctcccattgtggataagaaagggaaggtagtcggactgtacggcaatggtgtggttaccaggtcgggggcctacgtgagcgcaatcgcccagacggagaaatcaatagaagacaaccctgagattgaagacgatatcttccgaaagcggcgccttacaattatggacttacatccgggagctggcaaaactaagagatatctgcccgccatcgtcagggaggcaataaagcggggcctccgaaccttgattctggctccaacaagagtggttgccgcggagatggaagaggccctccgcgggctgcctatcaggtaccaaacccccgcaatccgtgctgaacacactggacgggagattgtggatcttatgtgtcatgccacctttacaatgagactgttgtccccaatcagggtccctaattataacctaattataatggacgaagctcacttcacggatcccgcaagtatcgccgcccgcggttacatttctactcgagtggagatgggcgaggctgcggggatctttatgaccgcaacaccaccgggaagcagagaccctttcccccagtccaacgccccaatcatggatgaagaacgggaaattcccgagaggtcatggaactctggccacgagtgggtaaccgactttaaaggtaagactgtgtggttcgttcctagcataaaaacagggaacgatatcgctgcctgcctgcgcaagaatggaaaacgtgtcattcagctcagtagaaagacctttgactccgaatatgtgaagacgcggactaacgattgggacttcgtggtcacaaccgacatcagcgagatgggcgcaaattttaaagccgaaagggtaattgatccacgccgatgtatgaagcccgtgatcttaaccgacggcgaggaaagagttatactggctgggcctatgccggtgactcattcttcagcggcccaacggaggggacgcatcggtagaaaccccaaaaatgagaacgatcagtacatttatatgggcgagccccttgaaaatgacgaggattgcgcacactggaaggaagctaaaatgctgctcgacaacatcaatacacctgaggggattatcccctccatgttcgaaccagagagggagaaggtcgatgccatagacggagaataccggttgcgtggcgaggcacgcaaaacctttgtggatctgatgcgaagaggtgacctccctgtttggctggcctacaaggtggctgccgaagggattaactatgcggataggcggtggtgtttcgacggcacacgcaataaccagatccttgaggaaaatgtcgaggtggagatttggactaaggaaggagagaggaaaaagctaaaacccaggtggctggatgcacggatctacagtgacccattggccttaaaggagttcaaagagtttgctgccggccgaaagagcctgacgctcaacctgataaccgagatggggagacttcctacattcatgactcagaaggctcgcgacgcactggataacctcgccgtattgcataccgctgaagccggaggtaaagcatataatcacgcgctgtcggagctaccggaaacactggagaccctccttctgttaactttgctggccacggtgaccggcgggatctttctcttcctgatgtctggaaggggcattggtaagatgacacttgggatgtgctgcatcattactgcttccatcctgctctggtgtgcccaaatacagccccactggattgcagctagcatcatcttggaatttttcctgattgttttactaatcccagagcctgagaaacagcggaccccacaggacaaccaactgacatacgtcataattgccatcctcaccgtggtggcagccactatggctaatgaaatgggctttcttgagaagaccaaaaaggatctgggattgggcaacattgtcacgcagcagccagaatcaaatatcctggacatagatctccgtcctgcgagtgcctggaccctgtatgcagttgctactacattcatcacccccatgcttagacattctattgagaactccagcgtgaatatgtcactcaccgccatcgccaaccaggcaacagtactgatggggttgggaaagggttggccgctgagtaaaatggacattggcgtgccattactagctatcgggtgctgtagccaagtcaatcctattactctgacggccgcgctctttcttctggtggctcactacgccatcataggacccggcttgcaggcaaaggccaccagggaagctcagaaacgcgcagccgcgggtattatgaagaacccaacagttgatgggatcactgtgatcgacctggatcccattccttatgacccgaaattcgagaagcagctcggccaagtcatgctgcttgtattatgcgtgacccaggttctgataatgcggacaacctgggctctctgtgaggccttgactctggcaacgggacccgtgtccacactatgggaaggcaatccagggcgattttggaacaccactatcgccgtctctatggctaatattttcagaggaagctacctggccggcgcaggtctcctattttgcatcatgaacaataccacaaggctgcgccgggggactggacatttgagaaagaccctgggcgataaatgtaagtcccgtctcaacacactgggtaaatcagagttccagatttacaagaaatctggcatccaagaagtggacaggacgttagctaaggaggggataaaacggggagaaaccgatcaccatgccgtcagtcgcggctcggcgaaacttcgatggttcgtggagagaaatctggttactcctgaggggaaggtggtagacctcggatgcggcaggggtgggtggagctattactgtggaggcctgaaaaatgtgcgggaagtcaagggtttaacaaaaggcgggcccggacacgaggaacctatcccaatgtccacctatggctggaacttggttcgcctgcagtctggggtggacgtctttttcattccccctgagaagtgcgatactctcctttgtgacatcggagagtcaagcccaaatcccacagtggaagccggcagaaccctgagggtattgaacctggtggagaattggctcaacaataacacgcagttttgcattaaagttttaaatccgtacatgccttccgtgatcgaaaagatggagaccctgcagcgaaagtatggtggggcacttgtccggaacccactgagtcgtaattctacacacgaaatgtactgggtgagcaacgcttcaggaaatatagtctccagtgtgaacatgattagcagaatgctaatcaatcgcttcactatgaggcataaaaaggccacctatgagcccgatgttgacctcggctctggcacacggaacatcgggattgagtccgaaactcctaatctggatataatcggaaaaagaattgagaagatcaaacaagaacacgagacctcatggcattacgaccaggatcacccatacaagacatgggcatatcacggtagctacgaaaccaagcagactggctcggcttctagtatggtaaacggggtggtccgcttgctgacgaaaccctgggacgtggttccgatggtgacacagatggccatgaccgatactaccccttttggacaacagagggtcttcaaggagaaagtggacacacgaacgcaggagcccaaggaaggcaccaaaaagctcatgaagattactgccgagtggctttggaaagaactgggtaagaaaaagacaccacggatgtgcaccagagaggaatttactaaaaaggtaaggtccaacgcggctttaggggcaatcttcacagatgagaataaatggaaaagcgcccgcgaggctgtggaagacggacgtttttgggagctggttgacaaggaacggaacttgcatctcgagggcaaatgtgagacctgcgtctataatatgatgggcaagagagagaaaaagctgggggagttcggaaaagccaagggttcaagggcaatatggtacatgtggctaggcgcccgctttcttgagttcgaggctctggggtttctcaacgaagatcactggttctcccgagaaaattctctgagcggagtggagggcgaaggtttgcataagctggggtatatcctccgggaggtgagtaaaaaggaaggaggcgcgatgtacgccgacgatacagcaggctgggacactagaattaccatcgaggatcttaaaaacgaagagatgattacgaatcacatggctggggagcataagaaactggccgaagcaatcttcaagttaacctatcagaacaaggtcgttagggtgcaacgccctacacccagaggaactgtaatggacattatatcccggagggatcagcgtggtagcggccaggtggggacctacggactgaatacatttactaacatggaggcccaattgatccgacagatggaaggcgagggtattttcaaatctatccagcacctcaccgctacggaagagatcgccgtccaggactggctggcgcgcgtggggagagagcggctatcaaggatggcaattagtggagatgactgtgttgtgaagccacttgatgaccgctttgccagagctctgacagccctcaatgatatgggcaaagtccggaaggacatacaacagtgggaaccctccaggggctggaacgactggacccaggtgcctttctgcagccaccattttcacgagctgatcatgaaagatgggcgaactttggtagttccatgtcgtaatcaggacgaattaattggcagagcacgcatctctcaaggtgctggctggtcgctgcgggagacagcctgcctcgggaagtcatacgctcagatgtggagccttatgtatttccataggagagatctgcgcctagccgcaaacgcgatttgttccgccgtgccgagtcactgggtccccacctctcggactacctggagcatccacgcttcccatgagtggatgacaacggaagacatgctgaccgtgtggaatagggtgtggatacaggagaacccttggatggaagataagactccagtcgagtcatgggaagagatcccctacctcggaaaacgagaggaccagtggtgcggcagtttgattggtctgacatctagagccacctgggcaaagaacatccaaactgctattaatcaggttcggagccttatcgggaacgaagagtatacagattacatgccttccatgaaaaggtttcgccgtgaagaggaagaggccggagtgctgtggtga

SEQ ID NO: 14965 - RNA, 9876 nt, synthetic construct
  misc_feature 1..9876: note = derived and/or modified CDS sequence (opt3) from DENV-2__KU517845__SS-prME
  source 1..9876: mol_type = other RNA
accgcaggaatcattataatgatgatccccacagtgattgctttccacctgactacgagaaacggggagcctcatatgatcgtcagcaggcaggaaaagggaaaatccctcctttttaagaccgagaatggtgttaacatgtgcacactgatggcaatggacttgggcgaattatgtgaggatactattacctacaattgcccactgctgcggcaaaacgaaccggaggacatcgattgttggtgcaattctacatcagcctgggtgacctatgggacttgtacagcgaccggagagcaccgccgagaaaaacgtagtgtagctctcgtgccccatgtcggcatgggtctggagacgcggactgaaacctggatgagctccgagggggcctggaagcacgcacagaggatagagacatgggtgcttcggcatcctggattcactatcatggccgctattctggcatacaccatcggcacaacctattttcagcgcgttttgattttcatcctcctgacggccgtgactccatctatgacaatgagatgcataggcatttcgaacagggactttgtcgaaggggtgtcaggaggtagctgggtagatatcgttctggagcacggcagttgtgtgaccactatggctaaaaataagcccacactcgacttcgaattaattaagaccgaggccaaacaccctgcgacgctgcggaagtactgcatcgaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaagattgtccagcctgaaaacctagagtatacaatagttatcaccccacactccggagaagagaatgccgtgggtaacgatactggcaaacatgggaaggagattaaagtaacgccgcagtcaagtatcacagaagcagagctcaccggatacggcactgtgaccatggaatgtagccccaggacaggtctggacttcaatgagatggtccttctgcagatggaaaacaaggcttggttggtgcaccggcaatggtttctcgatctgcctttaccatggctgcccggggccgacacccagggctctaactggatacagaaagagactctcgttacattcaagaatcctcacgcgaagaaacaggatgtggtcgtgcttggatcccaagagggcgccatgcatacggcactgaccggggctactgaaattcagatgtcaagcggaaacttgctatttacaggtcacctgaagtgccgtctccgcatggacaaactgcagcttaagggcatgagttattctatgtgtaccgggaaattcaaggtagttaaggagatcgccgaaacacaacatggaactatcgtgattagagtccagtacgagggcgacggttccccatgcaaaatccccttcgagattatggatctggaaaagaggcacgtgttggggcggctcataaccgtcaatccgatcgtgacggagaaagacagccctgttaacattgaagctgagcccccatttggcgattcgtacatcatcattggagtggaacctggccagctgaagttatcttggttcaaaaaggggtcctcaataggacagatgtttgagaccacaatgcgaggtgccaagcgcatggcaatcctgggcgacactgcctgggatttcgggagtctaggaggcgtatttaccagcattggtaaagctctccatcaagtcttcggggcgatctatggcgcagccttttccggagtgtcttggacaatgaagattctgatcggcgttgtgataacttggatcgggatgaatagcagatcaaccagtctttccgtcagcttggtgctggtaggagtggttacgctctacctgggcgtcatggtgcaggctgactctggttgtgtggtctcatggaaaaacaaggagcttaaatgcgggagtggaattttcatcacagataatgttcacacctggactgaacagtataagtttcagcccgagagcccatccaagctggcctctgcaattcaaaaagcccacgaagagggcatctgtggtataaggtcggtgacacggttggaaaacctcatgtggaagcagattacccccgagctgaatcatatcttaagcgagaacgaagtgaaactgactattatggctggcgacatcaaggggataatgcaggccggaaaacgctccctaagacctcagccaaccgagctcaagtactcatggaaagcatggggcaaggcgaagatgctgagtacagaacttcacaatcatacgttcttgatcgatgggccggagaccgctgaatgccccaacactaatagggcctggaactctctggaggtagaggactatggatttggcgtcttcacaaccaatatttggctcaaactgaaggaacgtcaagatgcattttgtgacagcaaattaatgtccgccgctatcaaggacaaccgggccattcacgcagatatgggttactggatcgagtcagctctgaacgacacatggaaaatagaaaaggccagcttcattgaggtgaagtcttgccactggcctaaatcccatactctttggagtaatggggttttggagagcgaaatgatcatcccaaagaacttcgcgggacccgtgtctcagcacaattatcgacctggctaccatacccagacggccggtccatggcacctcggcagactggagatggattttgacttctgtgaagggacaaccgtcgtggttactgaggattgcggaaacaggggcccctccctacgcaccacaactgcttcagggaaactgattaccgaatggtgctgtcggagttgcacactcccgcctctgagatacaggggagaggacggctgttggtatggtatggagatccgcccacttaaggaaaaagaggaaaatttggtgaacagcctggtaacggcagggcatggacagattgataatttttcgttaggcgtcctcggtatggccctgttccttgaggaaatgctgcgaacccgggtgggcactaagcacgctatattgctcgtggccgtctcctttgttacactgatcaccgggaacatgtctttccgtgacctaggaagagtgatggtaatggtgggcgcaactatgacagatgacattgggatgggagtcacctacctggcgctcctggccgcttttaaggtgaggcccacgttcgccgcaggccttttgctgcgcaaattaactagcaaggagctcatgatgaccacaatcggtattgttctgctttcacaaagtaccatccctgagactatactggaactaacagatgctctcgccctggggatgatggtgttgaaaatcgtccggaatatggagaagtatcagctggcagtgaccattatggccatcttatgcgttcccaacgctgtgattctccagaatgcgtggaaagtctcctgtacaactctggccgtagtgtctgttagcccacttctgttgacctcctcacaacagaaggcagactggatccctctcgtgctgacgataaagggactaaaccccacagctatttttctgaccactcttagcagaaccagtaaaaagaggtcttggccactcaatgaagccatcatggccgtcggcatggtgtccatcctggctagctcgttgctgaaaaacgatattccgatgacaggccctttagtagcagggggactcctgactgtgtgctacgtccttaccggtcgatcagccgacctggagttggaacgcgcggctgacgttcggtgggaggagcaggccgaaatatctggcagttcccccatcctcagcattacggtgtctgaggatgggagcatgtccatcaagaatgaagaggaggaacagacactgaccattctaatcagaactggactgcttgtgatatcaggcctcttcccagtcagtatccccattacagcagccgcttggtatctgtgggaggtgaaaaagcaaagggccggtgttttgtgggacgtacctagcccaccccctgtggggaaagccgaattagaggatggagcgtaccgtatcaagcagaagggcattctgggctattctcagatcggggctggagtctacaaagaaggtacctttcacactatgtggcatgtgacacgcggcgccgttctcatgcacaaggggaaacggatagagccgtcctgggcagacgtgaagaaagatctgatttcatacggaggcggttggaaacttgagggggaatggaaggagggagaagaggtccaggtgctggccttggaaccaggcaaaaaccccagagctgtacaaaccaagcctggcctattcaaaacgaacactgggaccatcggagccgtcagtctggactttagcccaggtacatccggctctcccatcgtggataagaaagggaaggttgtgggactctatggcaatggtgtcgtgaccaggtcggggacatacgttagcgcaattgctcagactgagaagtcaatcgaggacaaccctgaaatagaggatgacattttcagaaagaaacggctgaccatcatggatcttcatccgggagccggcaaaacgaagcgctatttacccgcgattgtgagagaagccatcaaaaggggcctgcggacactcatattggcaccaactcgagtcgtggctgccgagatggaagaggctctgagagggctccctattcgctaccagacccccgcaatcagggccgagcacacaggacgtgaaatcgtagacctgatgtgtcatgccaccttcactatgcggcttctgtccccaattagagtgcctaattataacttgatcattatggatgaggctcactttaccgaccccgcgagtatagcagccaggggttacatctctacacgcgttgaaatgggcgaggctgccgggattttcatgacggcaactccaccgggaagccgagacccttttccccagtccaatgccccaatcatggatgaggaaagagagatccccgaacggtcatggaactctggccacgagtgggtcaccgacttcaagggtaagacagtgtggtttgtgcctagcattaaagctgggaatgatatagcggcctgcctaaggaagaacggcaaaaaggtcatccaactgagtcgcaaaaccttcgactccgaatatattaagactcgtacaaatgattgggactttgtagtgaccacggatatcagcgagatgggcgcaaacttcaaggctgagagagttattgacccacggaggtgtatgaaacccgtgatcctcactgatggcgaagaacgcgtcatattagccgggcctatgccggtgacacattcttcagcagcccagcgaagaggacgggttggtaggaatccaaagaacgaaaatgaccagtacatctacatgggcgagcccctggaaaacgatgaggactgcgctcactggaaagaggccaagatgcttctggacaatattaacacccctgaagggatcattccctccatgtttgagccagaacgcgagaaagtggatgcgatcgacggagaatatagactcaggggcgaggcacggaagaccttcgtcgatttgatgcgtcgcggtgacctgcctgtgtggctcgcctaccgagtagctgccgaggggataaactatgctgatagaaggtggtgttttgacggcgtgaaaaataaccaaattctggaagagaatgttgaagtcgagatctggactaaggagggagaacggaagaaacttaagccccgctggctagatgcaagaatttacagtgacccactggccttgaaagagttcaaggagttcgctgccggcaggaagtcgttaacactgaacctcatcaccgagatggggcggctgcctacatttatgactcagaaggcacgaaatgcgcttgataacctggccgtgctccatacggctgaagccggaggtagagcatataatcacgctttgagcgagctgccggagaccctagaaacactgctccttctgactttattggccaccgtgacaggcgggatattcctgtttctcatgtctggaaagggcatcggtaaaatgaccctggggatgtgctgcattatcactgcatccattcttctgtggtacgcccagatccagccccactggatagctgcgagcattatcctcgagttctttttgatcgtcctgttaattccagaacctgagaagcaacgcacgccccaggacaaccagctaacctatgttgtgatcgccatactgacagtagtggcagctactatggccaatgaaatgggcttcctcgagaaaaccaagaaagattttggacttggctcaattgccaaccagcaaccagagagtaatatcctggacattgatttgaggcctgcatctgcttggacactgtacgccgtcgcgaccactttcatcacacccatgctccggcattccatagaaaacagctcagtgaatgttagtctgacggctatcgccaaccaggcaaccgtgcttatggggctcggaaagggttggccgctgagcaagatggacattggcgtcccattgctggccatcgggtgttactcccaggtaaatcctattactttaacagctgcactactgctccttgtggcccactatgcgatcattggacccggcctgcaggctaaagccacccgtgaggcacaaaagagagccgctgccggtatcatgaaaaacccaaccgttgacgggataacagtgattgatttggaccccatcccttacgatccgaagtttgaaaaacagctgggccaggtcatgctcctggtgctttgcgtcactcaggtgttaatgatgaggacgacctgggcactgtgtgaggctctcacattggccactggacccatctctaccctgtgggaaggcaatccagggcgcttctggaacacaaccattgcggttagcatggccaacatatttcggggatcctatctagcaggcgctggtctactcttctcaatcatgaagaatactgccaacacgcgaagagggacaggaaataccggcgagactcttggtgagaagtggaaaaacaggctgaatgcattgggcaagtctgaatttcaaatttacaaaaagagtgggatccaggaggtggaccgcaccctggctaaagaaggaattaagcggggcgagacagatcatcacgccgtatcgagagggagcgccaaactccgttggttcgtggagaggaacctggtcactcctgaaggaaaggttgtggacttaggctgcggtagagggggatggtcctattactgtggcggtcttaagaatgtcaaagaggtgaagggcctgaccaaagggggacccggccatgaggaacctatcccaatgtctacatatgggtggaacctcgtacgcctacagtcaggagtggatgttttctttacgccccctgaaaagtgcgacaccctgttgtgtgatataggcgagagctccccaaatcccactgtggaggcgggtcgaacactgagagtcctcaaccttgtggaaaattggctgaacaataacacccaattctgcatcaaagtcttgaatccgtacatgcctagtgtgattgagaagatggaagctctgcagaggaagtacgggggagcactcgttcggaacccattatctcgcaacagcactcacgagatgtattgggtatcaaatgcctccggcaacatcgtgagtagcgtcaatatgatttctagaatgctgatcaacaggtttacaatgcgacacaaaaaggctacctacgaacccgacgtggatcttggctccgggacgcggaatataggaattgagtcagagacccctaacctggacatcatcggtaaacgtattgaaaagataaaacaggagcatgaaacaagctggcactatgatcaggaccatccatacaagacttgggcctatcacggctcgtacgagaccaagcaaacagggtctgcaagttccatggttaatggagtggtcagactactcactaaaccctgggacgtgatcccgatggtaacccagatggccatgacagataccactcctttcggccagcagcgcgtgtttaaggaaaaagttgacacgaggacacaagagcccaaggagggtaccaaaaagattatgaagatcactgctgaatggctgtggaaagagttggggaagaaaaagaccccacggatgtgtacaagagaagagttcacgcgcaaagtcaggagcaacgcggccctgggagcaatttttaccgatgagaataagtggaaatcagctcgagaagccgtggaggactccggcttctgggaactcgtggataaggagcggaaccttcacctggaaggcaagtgcgagacttgtgtctataatatgatggggaaaagagagaagaaattaggagaatttggtaaggcaaaaggctctagggccatctggtacatgtggctgggggctcgcttcttggagtttgaagccctcggattcctgaacgaggaccattggtttagccgtgaaaatagtctatccggcgttgagggtgaggggcttcacaagctgggatacatactccgggatgtgagcaagaaagaaggcggcgcgatgtatgcagacgatacagccgggtgggacaccagaatcactctggaggatttgaagaacgaagagatggtaacatctcatatgaaaggagaacacaggaagctggctgaggccattttcaaactcacctaccagaataaggtggtccgcgtgcagcgacctacaccccggggtactgttatggacatcatttcaagaagggaccagcgcggcagtgggcaagtggtcacctatggacttaacacgttcaccaacatggaggcacagctgatcagacagatggaaggcgagggtgtgtttaagtccattcaacagttaacagtaactgaagagatagctgttaaaaattggctggtgcgggtcgggagggagcgtttgagccgaatggccatctctggagatgactgcgtggtgaagccactcgatgaccgcttcgcttcggccctgaccgcactaaacgatatgggcaaagtcagaaaggacattcagcagtgggaaccctcacggggctggaatgattggacacaagttcctttttgcagccatcacttccacgagcttatcatgaaagacgggagggtgctggtagtgccatgtcgcaaccaggatgaactcatcggacgagcgcggatttcccagggtgccggctggagtctgagggagactgcttgcttggggaagtcttacgcccagatgtggagcttaatgtattttcatcgacgtgacctgagactcgcagctaatgccatatgttccgcagtcccgtcacactgggtgcccaccagtcgcacgacatggtctatccatgccacccacgaatggatgactacagaggatatgcttaccgtttggaaccgggtgtggattcaagagaatccttggatggaagacaagactccagtcgagagctgggaagagatcccctacctgggaaaaagggaagatcagtggtgcggctccctaattggtctgacctcaagagcgacatgggctaagaacatccagacggccataaatcaggtgcgcagcctcatcgggaacgaggagtataccgactacatgccttctatgaaacggttcaggcgagaagaggaagaggcaggagtattgtggtga

SEQ ID NO: 14966 - RNA, 9876 nt, synthetic construct
  misc_feature 1..9876: note = derived and/or modified CDS sequence (opt3) from DENV-2__KU517847__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtggccccatctatgacaatgagatgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaacaccctgcgacgctgcggaagtactgcattgaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaagatcgtccagcctgaaaacctagagtatacaattgttataaccccacactccggagaagagaatgccgtgggtaacgatactggcaaacatgggaaggagatcaaagtaacgccgcagtcaagtattacagaagcagagctcaccggatacggcactgtgaccatggaatgtagccccaggacaggtctggacttcaatgagatggtccttctgcagatggaaaacaaggcttggttggtgcaccggcaatggtttctcgatctgcctttaccatggctgcccggggccgacacccagggctctaactggatccagaaagagactctcgttacattcaagaatcctcacgcgaagaaacaggatgtggtcgtgcttggatcccaagagggcgccatgcatacggcactgaccggggctactgaaatacagatgtcaagcggaaacttgctatttacaggtcacctgaagtgccgtctccgcatggacaaactgcagcttaagggcatgagttattctatgtgtaccgggaaattcaaggtagttaaggagattgccgaaacacaacatggaactatcgtgatcagagtccagtacgagggcgacggttccccatgcaaaattcccttcgagatcatggatctggaaaagaggcacgtgttggggcggctcattaccgtcaatccgatagtgacggagaaagacagccctgttaacatcgaagctgagcccccatttggcgattcgtacattatcatcggagtggaacctggccagctgaagttatcttggttcaaaaaggggtcctcaattggacagatgtttgagaccacaatgcgaggtgccaagcgcatggcaatactgggcgacactgcctgggatttcgggagtctaggaggcgtatttaccagcatcggtaaagctctccatcaagtcttcggggcgatttatggcgcagccttttccggagtgtcttggacaatgaagatcctgattggcgttgtgatcacttggatagggatgaatagcagatcaaccagtctttccgtcagcttggtgctggtaggagtggttacgctctacctgggcgtcatggtgcaggctgactctggttgtgtggtctcatggaaaaacaaggagcttaaatgcgggagtggaatcttcattacagataatgttcacacctggactgaacagtataagtttcagcccgagagcccatccaagctggcctctgcaatccaaaaagcccacgaagagggcatttgtggtatcaggtcggtgacacggttggaaaacctcatgtggaagcagataacccccgagctgaatcatattttaactgagaacgaagtgaaactgaccatcatgacaggcgacattaaggggatcatgcaggctggaaaacgcagcctaagacctcagccaacggagctcaagtactcctggaaagcctggggcaaggcaaaggtactgtcaaccgaacttcacaatcatactttcttgatagatgggccggagacagcggaatgccccaacaccaatagggcttggaacagtctggaggtcgaggactatggatttggcgtgttcacaactaatatctggctcaaactgaaggaacgtcaagatgtttcttgtgacagcaaattaatgtccgccgcaattaaggacaaccgggccgtgcacgctgatatgggttactggatcgagtcagccctgaacgacacctggaaaattgaaaaggcaagctttatcgaggtcaagtcttgccactggcctaaatcccatacgctttggagtaatggggtgttggagagcgaaatgataattccaaagaacttcgctggacccgtttctcagcacaattatcgacctggctaccatacacagaccgccggtccatggcacctcggcagactggagatggatttcgacttttgtgaagggactaccgtggtagtcacagagaactgcggaaataggggcccctccctacgcactaccacagcgtcagggaaactgatcacggaatggtgctgtcggagttgcaccctcccgcctctgagatacaggggagaggatggctgttggtatggtatggagatccgcccacttaaggaaaaagaggaaaacttggtgaatagcctggtgactgccgggcatggacagattgacaacttctcgttaggcgtcctcggtatggctctgtttcttgaggaaatgctgcgaacacgggttggcaccaagcacgcaatcttgctcgtggccgtatccttcgtgactctgattacagggaatatgtcttttcgtgatctaggaagagtcatggtgatggttggcgctaccatgacggacgatatagggatgggagtgacttacctggccctcctggcagcgttcaaggtcaggcccacctttgccgctggccttttgctgcgcaaattaacaagcaaggagctcatgatgaccactatcggtattgtgctgctttcacaaagtacaatccctgagaccattctggaactaacagacgccctcgcactggggatgatggttttgaaaatcgtgcggaacatggagaagtatcagctggctgtcactataatggccatcttatgcgtacccaatgcagtgattctccagaacgcctggaaagtttcctgtaccgctctggcggtggtctctgtgagcccacttctgttgacgtcctcacaacagaagacagattggatccctctcgccctgaccattaagggactaaatcccactgcaatcttcctgaccacacttagcagaactagtaaaaagaggtcttggccactcaacgaagctataatggccgtaggcatggtgtccattctggccagctcgtttttgaaaaatgacatcccgatgaccggccctctggtcgctgggggattactcacggtttgctacgtgctgacaggtcgatcagcagatcttgagctggaacgcgccgcggacatccggtgggaggagcaggctgaaatttctggcagttcccccatattgagcatcaccatttctgaggacgggagcatgtccatcaagaacgaagaggaggaacagactctcacaattctgatcagaaccggactactggtgatatcaggccttttcccagccagtatccccattactgcagccgcttggtatctctgggaggtcaaaaagcaaagggcaggtgtgctgtgggatgttcctagcccaccccctgtagggcgtgccgaattggaggacggagcgtaccgcatcaaacagaagggcattttaggctattctcagatcggggctggagtgtacaaggaaggtacatttcacaccatgtggcatgtcacgcggggcgccgtgctgatgcacaaagggaagagaatagagccgtcctgggcagatgttaaaaaggacctcatttcatacggaggcggttggaaactggagggggaatggaaggagggagaagaggtgcaggtccttgccctggaaccaggcaagaaccccagggctgtgcaaactaaacctggcttgttcaagaccaatacagggaccatcggagccgtaagtctagattttagcccaggtacatccggctctcccatcgtcgacaaaaaggggaaagtggttggactgtatggcaacggtgtggtcactcgatcggggacctacgtgagcgcaattgctcagacggagaagtcaatcgaggataatcctgaaatagaggacgatattttccggaagaaacgcctcacaatcatggacctgcatccgggagccggcaagactaaaagatatcttcccgcgattgttagggaagccatcaagcggggcttacgaaccctgatactcgcaccaacaagagtggtcgctgccgagatggaagaggctttgcgcgggctgcctattaggtaccagacccccgcaatccgtgccgagcacactggacgggaaatcgtggatctcatgtgtcatgccaccttcacaatgagactgctttccccaattagggtacctaactataatctgatcattatggacgaggctcactttacggatcccgcgagtatagcagcccgcggttacatctctactcgagtggaaatgggcgaggctgccgggattttcatgaccgcaacaccaccgggaagcagagacccttttccccagtccaacgccccaatcatggacgaggaacgggagatccccgaaaggtcatggaattctggccacgagtgggttaccgatttcaaaggtaagactgtctggtttgtgcctagcattaaggctgggaacgacatagcggcctgcttgcgcaaaaatggaaagaaagtgatccaactaagtcgtaagacattcgattccgaatatattaaaaccagaacgaacgactgggattttgtcgtaactacagacatcagcgagatgggcgcaaatttcaaggctgagcgggtgattgatccaaggcgctgtatgaagcccgttatcctgaccgacggcgaagagcgagtgatactcgccgggcctatgccggtcacccattcttcagcagcccagagacggggaagggtgggtcgcaacccaaaaaatgaaaacgatcagtacatctacatgggcgagcccttagaaaatgacgaggattgcgctcactggaaggaggccaaaatgctgcttgacaacattaacactcctgaagggatcattccctccatgtttgagccagaaagagagaaggttgacgcgatcgatggagaatataggctgcggggcgaggcacgtaaaacattcgtggacctcatgcgccgaggtgatttgcctgtctggctggcctacagagtggctgccgaggggataaattatgctgacaggcggtggtgttttgatggcgtaaagaacaatcaaattctcgaagagaacgtggaagttgagatctggaccaaagagggagaacgcaagaagctgaaacccagatggcttgacgcaaggatttacagtgatccactagccctgaaggagttcaaagaattcgctgccggccggaagagcttgacattaaatctgatcactgagatggggcgactccctacgtttatgacccagaaagcaagaaacgcgctggacaatcttgccgtcctgcatacagctgaagccggaggtcgcgcatataaccacgctctctcggagttgccggagactctggaaaccctactgctccttacactgttagccaccgtgactggcgggatattcttgtttctgatgtctggaaagggcatcggtaagatgacgctcgggatgtgctgcattgtgaccgcatccatcctgctttggtacgcccagattcagccccactggatcgctgcgagcataattctggagttctttctcatcgtcttgctgatcccagaacctgagaaacaaaggacaccccaggataatcagttaacttatgttgtgattgccatcctaaccgtagtggcagctacaatggccaacgaaatgggcttcctggagaagaccaaaaaggactttggactcggctcaataactacacagcaaccagagagtaatattcttgatatcgacctgcggcctgcctctgcatggacgttgtacgctgtcgccaccactttcattacacccatgctgcgtcattccatcgaaaacagctcagtgaatgttagtctcaccgcgatagctaaccaggccaccgtgctgatggggcttggaaaaggttggccgctcagcaagatggatatcggcgtcccactgttggcaattgggtgttactcccaggtaaatcctatcacactgactgccgctttactactgctcgtggcacactatgccattatcggacccggccttcaggcgaaggctacgagagaggcccaaaaaagggcagccgctggtattatgaagaacccaaccgttgacgggatcacagtgatagacctggatcccattccttacgacccgaaatttgaaaagcagttgggccaggtcatgctgctcgtgctgtgcgtcactcaggtgcttatgatgcgcaccacatgggccttatgtgaggcactgaccctcgctactggacccatctctacgttgtgggaaggcaatccagggcggttctggaacacaaccatcgccgttagcatggcgaacatttttcgaggatcctatctggccggcgcaggtctactgttctcaataatgaaaaatactgctaacaccagaagggggacaggaaatactggcgagaccctcggtgagaagtggaagaaccgccttaatgccctgggcaaatctgaatttcaaatctacaagaaaagtgggattcaggaggtggatcggacattggcaaaggaaggaatcaaaagaggcgagacggaccatcacgctgtatcgcgtgggagcgccaagctgaggtggttcgtggagcggaacctcgtcacccctgaaggaaaagttgtggatctgggctgcggtcgcgggggatggtcctattactgtggcggtttaaagaatgtcaaggaggtgaaaggccttactaaggggggacccggccatgaagagcctattccaatgtctacatatgggtggaacctggtacgactccagtcaggagtggacgttttctttaccccccctgaaaaatgcgatactctactgtgtgacatcggcgagagctccccaaatcccacagtggaggccggtagaaccttgagggtcctgaacctcgtggaaaattggcttaacaataacacgcaattctgcataaaggtcctgaatccgtacatgcctagtgtgatcgagaaaatggaagcgttgcagcggcgctacgggggagctctggttagaaacccaccctctaggaacagcacccacgagatgtattgggtatcaaatgcatccggcaacattgtgagtagcgtcaatatgatctctcgaatgctcattaaccggtttacaatgcgtcacaagaaggccacttacgaacctgatgtggacttaggctccgggaccagaaatatcggaatagagtcagaggttccaaacctggatattatcggtaaacgcatcgaaaagattaaacaggagcatgaaacaagctggcactatgaccaggatcatccctacaagacttgggcttatcacggctcgtacgagaccaaacaaacagggtctgccagttccatggtgaatggagtcgtgaggcttctgaccaagccgtgggacgtaatacctatggtgactcagatggcaatgacggacacaacccccttcggccagcagcgggtttttaaggaaaaagtcgatactagaacccaagagccaaaggagggtacaaaaaagctaatgaaaatcacggccgaatggctctggaaggagctggggaagaaaaagacccctcgcatgtgtactagggaagagttcacacgaaaagtgcggagcaacgctgcgttgggagccatttttaccgacgagaataagtggaaatcagcaagagaagctgtggaggattccggcttctgggaactggtcgacaaggagaggaacctccaccttgaaggcaaatgcgagacttgtgtttataatatgatggggaagcgcgagaagaaactgggagaatttggtaaggccaaaggctctcgtgcaatctggtacatgtggttaggggcccggttcctggagtttgaagctttgggattcctcaacgaggatcattggtttagcagagaaaatagtctgtccggcgtggagggtgaggggctacacaagcttggatacattctgagggacgtaagcaaaaaggaaggcggcgccatgtatgcggatgacacagcagggtgggatacccgcatcacactcgaggacctgaagaacgaagagatggtgactaatcatatggaaggagagcacaaaaagttggccgaggctatattccgactgacctaccagaacaaagtcgtgcgggttcagagacccacgccaaggggtaccgtgatggatatcatttctcgcagagaccagcggggctcagggcaagtcgtgacatatggactcaacactttcaccaatatggaagcccagcttatcaggcagatggagggcgaaggtgtatttaagagtattcaacatctgacagcaactgaggagatcgctgttaaaaactggttagtgcgtgtcgggcgagaacgcctgtccagaatggccattagcggagacgattgcgtggtgaagcccttcgacgatcggtttgctaatgccttgaccgcactcaacgacatgggcaaggtcaggaaagatatacagcagtgggagccttctcgcggctggaatgactggacgcaggttccattctgctcgcaccactttcatgaactgatcatgaaggatgggagagtgctagtagtgccgtgtcggaaccaagacgagcttattggaagggcgcgaatctcacagggtgccggctggagcctgcgtgaaacagcttgcctcgggaaatcctacgcccagatgtggagtctgatgtatttccacagacgcgatttgcggttagcagctaatgccatctgttctgcagtccccagccattgggtgcctacctccaggactacatggtcaattcacgccacccacgagtggatgactaccgaggacatgctgacagtttggaacagagtgtggatacaggaaaatccatggatggaggataagacgcccgtcgaaagttgggaggaaatcccttacctcggaaaacgcgaggaccaatggtgcggctctcttattggtctgaccagccgggcgacttgggctaagaacatccagacagccattaatcaggtgaggtccctaatcgggaacgaggaatataccgattacatgccatcaatgaagcgatttagacgggaggaagaggaagcaggagtactgtggtga

SEQ ID NO: 14967 - RNA, 9876 nt, synthetic construct
  misc_feature 1..9876: note = derived and/or modified CDS sequence (opt3) from DENV-2__JQ955623__SS-prME
  source 1..9876: mol_type = other RNA
accgccggcatgatcattatgctgatacccacagctatggcattccacctcactacgagaaacggggagcctcatatgatcgtgagcaggcaggaaaagggaaaatcccttctgtttaagaccgaggacggtgtcaatatgtgcacattgatggccatggatttaggcgaactgtgtgaggacactattacctacaactgcccactactccggcaaaatgaaccggaggatatcgactgttggtgcaactctacatcaacctgggttacttatgggacatgtaccgcgacgggagagcaccgccgagaaaaacgtagtgtggctctggtaccccatgtgggcatgggtcttgagactagaaccgaaacatggatgagctccgagggggcctggaagcacgcacagaggattgagacttggatcctgcggcatcctggattcaccataatggccgctatcttggcatacacaattggcaccacgcactttcagcgcgtcctcatcttcattctgctgactgccgtggctccatctatgacaatgagatgcatcggcatatcgaatagggattttgttgaaggggtgtcaggaggtagctgggtcgacattgtgctcgagcacggcagttgtgtaaccactatggccaaaaacaagcccacattagatttcgaactgatcaagaccgaggcgaaacagcctgcaacgcttcggaagtattgcattgaagccaaattgaccaatacaactaccgcttcccgctgtccaacacaaggggagccctctctgaacgaggaacaggacaagcgatttgtttgcaaacatagcatggtggatagaggatggggcaatggttgtgggctattcggaaagggcggcatcgtcacttgcgccatgtttacctgcaagaaaaacatggaggggaagatcgtgcagcctgaaaatctcgagtacacaattgtggtcaccccacactccggagaagagaacgcagttggtaatgacactggcaaacatgggaaggagataaaagtgacgccgcagtcaagtatcacagaagctgagctgaccggatatggcactgtaaccatggaatgtagccccaggacaggtcttgatttcaacgagatggtgctgttgcaaatggaaaataaggcctggctcgtccaccggcagtggtttctggacttacctctgccatggctccccggggcggatacccagggctctaactggattcagaaagagactcttgtgacattcaagaaccctcacgccaagaaacaagacgttgtggtcctgggatcccaggagggcgcaatgcatacggctttgaccggggccactgaaatccagatgtcaagcggaaatctactgtttacaggtcacctcaagtgccgtctgcgcatggacaaacttcaactgaagggcatgagttactctatgtgtaccgggaaattcaaggtggtaaaggagatagctgaaacacagcatggaactattgttatcagagtgcagtatgagggcgatggttccccatgcaaaatccccttcgagattatggacttggaaaagaggcacgtcctcgggcggctgatcaccgtgaacccgattgtcacggagaaagatagccctgtgaatatagaagccgagcccccatttggcgactcgtacatcattgttggagtggaacctggccagttaaagctgtcttggttcaaaaaggggtcctcaatcggacaaatgtttgagaccacaatgcgaggtgcaaagcgcatggccatcctaggcgatactgcttgggacttcgggagtctcggaggcgtatttaccagcattggtaaagcgctgcatcaggtcttcggggcaatatacggcgccgctttttccggagtgtcttggacaatgaagatccttattggcgttgtgatcacttggattgggatgaacagcagatcaaccagtttgtccgtcagcctggtgctcgtaggaatcgtgacgctgtatcttggcgttatggtccaggccgattctggttgtgtggtgtcatggaaaaataaggagctgaaatgcgggagtggaatattcatcacagacaacgtccacacctggactgaacagtacaagtttcaacccgagagcccatccaagttggcatctgccattcagaaagctcacgaagagggcatctgtggtattaggtcggttacacggctcgaaaatctgatgtggaagcagatcacccccgagttaaaccatatactgagcgagaatgaagtgaaactaactattatgaccggcgatatcaaggggattatgcaggccggaaaacgctccctcagacctcaaccaacagagctgaagtattcatggaaaacgtggggcaaggcaaagatgcttagtaccgaaccgcacaaccagactttcttgatcgacgggcccgagacagcggaatgccctaataccaacagggcttggaattctctggaggtggaggattacggatttggcgtattcacaactaacatatggctcaaactgaaggaacgtcaggacgtcttttgtgacagcaaattaatgtccgccgcaatcaaggataatcgggccgtgcatgctgacatgggttattggattgagtcagccctgaacgatacctggaaaatcgaaaaggcaagcttcattgaggttaagtcttgccactggccaaaatcccacacgctttggagtaacggggtgttggagagcgaaatgatcatacccaagaatttcgctggacctgtctctcagcataactaccgaccaggctatcacacacaaaccgccggtccctggcatctcggcaaactggagatggactttgatttctgtgaagggactaccgtggttgtgacagaggactgcggaaatagaggcccgtccctaaggactaccacagcgtcagggaagctgattacggaatggtgctgtcgcagttgcaccctccctccactgcggtacagaggagaggatggctgttggtacggtatggagatcaggccccttaaagaaaaggaggaaaacttggtaaatagcctggtcactgccgggcacggacagatcgacaacttttcgttaggcgtgctcggtatggctctgttccttgaggaaatgctgcgcacacgagtgggcaccaagcatgcagtcttgctcgttgccgtgtcctttatgactctgattacagggaatatgtctttccgggatctaggacgtgtaatggtgatggtcggcgctgccatgaccgacgatatcgggatgggagtgacgtatctggcactcctggcggcctttaaagttagacctactttcgctgccggccttttgctgaggaagttaaccagcaaagagctcatgatgacaaccattggtatagtgctgctttcacagagtactatccccgagacaattctggaactaaccgacgcactcgctctggggatgatgatcttgaagattgtccgcaacatggagaaataccaactggccgtgacaatcatggcaatattatgcgttccaaatgccgtgatcctccagaacgcttggaaggtctcctgtactattctggcggtagtgtctgttagccctcttctgttgacctcctcacagcagaaggccgattggatccccctcgcactgacgattaaaggactaaatccaacagctatctttctgaccactcttagccggaccaacaagaaaagaagttggccgctcaatgaagccataatggccgtgggcatggtctctattctggcttccagcttgctgaagaacgacatccctatgacaggccccttagtggcagggggactcctgactgtatgctatgtgcttaccggtaggtcggccgacctggagttggaacgagcggctgatgtccgctgggaggaccaagccgagatctcaggctctagtccaattctctccataacgatcagcgaagatgggtctatgagcattaaaaatgaggaagaggagcagacactgaccatcctaattcggactggactgcttgttatctccggcctcttccccgtgtcaatacctatcacagcagccgcttggtacctgtgggaagtgaagaaacagagagcaggtgtcttgtgggacgtgccaagtccccctccggttgggaaggccgagttagaagatggagcgtataggattaagcagaaaggcatcctgggctacagccaaattggggctggagtatataaggagggtacctttcacactatgtggcacgtgacacgtggcgccgtcctcatgcataaagggaagcgcatcgaaccatcttgggcagacgtgcggaaagatctgatatcctacggaggcggttggaagcttgagggggagtggaaggaaggagaggaagttcaggtgctggccttggagcccggcaaaaaccctagagctgtccagaccaagccaggcctattcaaaacgaacactgggaccattggagccgtgtcactggactttagtcccggtacaagcggctcccctatcgtagataagaaagggaaggtcgtgggactctacggcaatggtgttgtgaccaggtctgggacatatgtctcggcaatcgctcagactgaaaagagcattgaggacaacccggagatcgaagatgacatattccgaaaaaagcggctgaccattatggatcttcaccccggagccggcaaaacgaagcgctacttaccagcgatcgtgagagaggccattaaaaggggcctgcggacactcatcttggcacctactcgagttgtggctgccgaaatggaggaagctctgagagggctccccatacgctatcaaaccccagcaattagggccgagcatacaggacgtgagatcgtcgacctgatgtgtcacgccaccttcactatgcggcttctgtcacctgtgagagtacccaattacaacttgatcattatggacgaagctcattttaccgatccagcgtccatcgcagccaggggttatattagtacacgcgtggagatgggcgaagctgccgggatattcatgacggcaactccgcctggatctcgagacccctttccacagagcaatgcccccatcatggatgaggagagagaaattcctgagcggtcctggaactcaggccacgaatgggttaccgacttcaagggtaagacagtctggtttgtgccatctatcaaagctgggaatgatatcgcggcctgcctaaggaagaacggaaaaaaggtgattcagctgagccgcaaaaccttcgacagtgagtacataaagactcgtacaaatgattgggactttgtcgtaaccacggatatctccgaaatgggcgcaaacttcaaggctgagagagtgattgacccccggaggtgtatgaaacctgttatcctcactgatggcgaggaacgcgtgattttagccgggccgatgccagtcacacacagctctgcagcccaacgaagaggacggatcggtaggaatcccaagaacgagaatgaccagtatatatacatgggcgaacctctggagaacgacgaagattgcgctcattggaaagaggccaagatgcttctggacaatatcaacacccccgaggggattatcccatcaatgtttgaacctgagcgcgaaaaagtggatgcgattgacggagagtacagactcaggggcgaagcacggaagaccttcgttgatttgatgcgtcgcggtgacctgcccgtgtggctcgcctatcgagtcgctgccgaggggatcaactacgctgatagaaggtggtgttttgacggcataaaaaataaccagattctggaggaaaatgtggaggtagaaatctggactaaggagggagagcggaagaaacttaagccacgctggctagatgcaagaatttattccgaccctctggccttgaaagaattcaaggagttcgctgccggcaggaaaagtttaacactgaacctcatcaccgaaatggggcggctgccgacatttatgactcagaaggcacgaaatgcgcttgataacctggccgtgctccacacggctgaggccggaggtagagcatacaatcatgctttgagcgaactgcccgagaccctagagacactgctccttctgactttattggccaccgttacaggcgggatattcctgtttctcatgtcgggaaagggcatcggtaaaatgaccctggggatgtgctgcattatcactgcatctattcttctgtggtatgcccaaatccagccacactggatagctgcgtccattatcctcgaattctttttgatcgtcctgttaattcctgagcccgaaaagcagcgcacgccacaggacaaccaactaacctacgtggtgatcgccatactgacagtcgttgcagctactatggccaatgagatgggcttcctcgaaaaaaccaagaaagattttggacttggcagcattgccacacagcagctggagtcaaacatcttggacattgacctgaggcctgcaagtgcttggaccctctatgccgtggcgactacattcatcacgcccatgctgcggcactctatagagaattccagcgtaaacgtgtcacttaccgctatcgccaatcaggcaactgtcctcatggggctgggaaagggttggccgttgagtaagatggatattggcgtgccactgttagccatcgggtgttacagccaagttaaccctattacactaaccgctgcactgctccttctggtggcccattacgcgatcattggacccggcttgcaggctaaagccacccgtgaagcacagaagagagccgctgccggtatcatgaaaaatccaacagtcgacgggataactgtaattgatctggaccccatcccttatgatccgaagtttgagaaacagctcggccaagtgatgctgcttgttttatgcgtgacgcaggtcctgatgatgaggaccacatgggcactctgtgaagctttgactctggccaccggacccatctccacactatgggagggcaacccagggcgcttctggaataccactattgcggtgtctatggccaacatatttcggggaagctacctggcaggcgctggtctccttttctccatcatgaagaacacgacaaatacccgaagagggactggaaacaccggcgaaacactgggtgagaagtggaaaaataggttgaactcactgggcaagtctgagtttcagatttataaacgcagtgggatccaagaagtcgaccggactctcgccaaggagggaattaaaagaggcgaaaccgatcaccatgcagtgtcgcgtgggagcgctaagctgaggtggttcgttgagcggaatttagtgacacctgagggaaaagtagtggaccttggctgcggtcgcgggggatggtcctactattgtggcggtctgaagaacgtccgagaagttaagggcctcacgaaagggggacccggccacgaggaacctatcccaatgtctacctacgggtggaatctagtgagactgcagtcaggagtcgatgtgttctttactccccctgagaagtgcgacacattgctgtgtgatataggcgaaagctccccaaaccccaccgtagaggccggtaggactctccgggtgcttaatctggttgagaactggttgaataacgacacacagttctgcatcaaagtgctgaatccgtatatgcctagtgtcattgaaaagatggaggccctccagcgcaaatacgggggagcgttagtgagaaacccactgtctaggaatagcacccatgaaatgtactgggtctcaaacgcttccggcaacatcgtgagtagcgttaatatgatttctcgaatgcttatcaaccggtttacgatgcgtcacaagaaggcaacctatgagcccgatgtagacctgggctccgggacaagaaatataggaattgaatcagagactcctaacctagacatcatcggtaaacgcattgagaagataaaacaagaacacgagaccagctggcattacgatcaggaccacccatataagacatgggcctaccatggctcgtatgaaactaaacagaccgggtctgctagttccatggtgaatggagtcgtgaggctcctgacaaagccctgggatgttatcccgatggtgacccagatggccatgactgacacgacacctttcggccaacagcgggtctttaaggagaaagtggataccagaactcaggaacccaaggagggtaccaaaaagttgatgaaaattacagcagagtggctgtggaaggaactcgggaagaaaaagacgccacgcatgtgtaccagggaggaattcactcgaaaagtacggagcaacgccgctcttggagcgatctttacagacgagaataagtggaaatcagccagagaggcagtggaagattccaggttctgggagctggttaacaaggaacgcaatttacacctggagggcaaatgcgaaacctgtgtctacaacatgatgggcaagcgtgagaagaaaattggggagtttggaaaggctaaaggttctcgggccatctggtatatgtggttgggcgcaagattcctcgaatttgaggccctggggttcctaaatgaagaccactggtttagcagggagaacagtctttccggagtggaaggcgagggtctgcataagctcgggtacatactgcgcgaggtgagcaaaaaggaaggaggcgctatgtacgccgatgacactgcgggctgggatacacgaatcaccttggaggacctgaagaatgaagagatggtcacaaaccacatggaaggggagcataaaaagctcgcagaggccattttcaaacttacttatcagaataaggttgtgcgggtacaaagacctacccccaggggaacggtgatggacatcatttctcgcagagatcagcggggttcaggccaggtcgggacctacggactgaacacattcactaacatgggcgctcaattaatcaggcagatggaaggtgagggggtgtttaaaggaattcagcacctgaccgccacagaagagactgcagttcatgactggttggctcgtgtgggccgagagcgcctcagtagaatggccatatccggcgatgactgcgtcgtgaagccactggatgaccggttcgctagcgccctaaccgcacttaatgatatggggaaggtaaggaaagacatccagcaatgggaaccctctcgcggatggaacgattggacgcaggttcctttttgctcgcaccacttccatgagctgattatgaaggacggtagagtgctcgtcgtgccatgtcggaatcaggatgaactgatcggcagggcgcgaatctcacagggggccggatggagcttgcgtgagacagcttgcttaggcaaatcctatgcccaaatgtggagtctgatgtactttcacagacgcgacctccggcttgcagctaacgccatttgttctgcagtgccgagccattgggtccccacctccaggactacatggtcaatacacgccagacacgaatggatgaccactgaggatatgctgaccgtttggaatcgcgtgtggatccaggagaacccttggatggaagacaagacaccagtagagagttgggaagagattccctatctaggtaaacgggaagaccagtggtgcgggtctctgatcggactcacgagcagggcgacctgggctaagaatattcagactgccatcaaccaagtgcgatccttgataggctcagaggagtacacagattatatgcctagcatgaagagattccggagggaagaggaagaggcaggcgtcctgtggtga

SEQ ID NO: 14968 - RNA, 9876 nt, synthetic construct
  misc_feature 1..9876: note = derived and/or modified CDS sequence (opt3) from DENV-2__KR779782__SS-prME
  source 1..9876: mol_type = other RNA
accgccggaatcattataatgatgatccccacagtgatggctttccacctgactacgcgaaacggggaacctcatatgattgtcagcaggcaggaaaagggaaaatccctcctttttaagaccgaaaatggtgttaacatgtgcacactgatggcaatggacttgggcgaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgttgcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgaggtgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacaccctgcgacgctgcggaagtactgcgtggaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaaggtcgttcagcctgaaaacctagagtatacaatcgtgattaccccacactccggagaagagaatgccgtaggtaacgatactggcaaacatgggaaggagataaaagtgacgccgcagtcaagtatcacagaagcagagctcaccggatacggcactgtcaccatggaatgtagccccaggacaggtctggacttcaatgagatggtgcttctgcagatggaaaacaaggcttggttggttcaccggcaatggtttctcgatctgcctttaccatggctgcccggggccgacacccagggctctaactggattcagaaagagactctcgtgacattcaagaatcctcacgcgaagaaacaggatgtcgtggtacttggatcccaagagggcgccatgcatacggcactgaccggggctactgaaatccagatgtcaagcggaaacttgctatttacaggtcacctgaagtgccgtctccgcatggacaaactgcagcttaagggcatgagttattctatgtgtaccgggaaattcaaggttgtgaaggagatagccgaaacacaacatggaactattgtcatcagagtgcagtacgagggcgacggttccccatgcaaaatccccttcgagattatggatctggaaaagaggcacgtcttggggcggctcatcaccgtgaatccgattgttacggagaaagacagccctgtgaacatagaagctgagcccccatttggcgattcgtacatcattatcggagtagaacctggccagctgaagttatcttggttcaaaaaggggtcctcaatcggacagatgtttgagaccacaatgcgaggtgccaagcgcatggcaattctgggcgacactgcctgggatttcgggagtctaggaggcgtctttaccagcataggtaaagctctccatcaagtgttcggggcgatctatggcgcagccttttccggagtttcttggacaatgaagattctgatcggcgtggtcattacttggatcgggatgaatagcagatcaaccagtctttccgtgagcttggtactggtgggagttgtcacgctctacctgggcgtgatggtgcaggctgactctggttgtgtcgtttcatggaaaaacaaggagcttaaatgcgggagtggaatattcatcacagataatgtgcacacctggactgaacagtataagtttcagcccgagagcccatccaagctggcctctgcaattcaaaaagcccacgaacagggcatctgtggtattaggtcggtgacacggttggagaacctcatgtggaagcagatcacccccgaactgaatcatatattaactgagaacgaggtaaaactgaccattatgacaggcgacatcaaggggattatgcaggctggaaaacgcagcctaagacctcaaccaacggaactcaagtactcctggaaagcctggggcaaggcaaagatgctgtcaaccgagcttcacaatcatactttcttgatcgatgggccggaaacagcggagtgccccaacaccaatagggcttggaacagtctggaagtcgaggactatggatttggcgtgttcacaactaatatatggctcaaactgaaggagcgtcaggatgtattttgtgactctaaattaatgagcgccgcaatcaaggacaaccgggccgtgcacgctgatatgggttactggattgaatccgccctgaacgacacctggaaaatcgagaaggcatcattcattgaagtcaagagctgccactggcctaaatctcatacgctttggtccaatggggtgttggagagtgagatgatcataccaaagaacttcgctggacccgttagccagcacaattatcgacctggctaccatacacagaccgccggtccatggcacctcggcagactggaaatggattttgacttctgtgaggggactaccgtggtagtcacagaagattgcggaaacaggggcccctctctacgcactaccacagcgtccgggaaactgattacggagtggtgctgtcggtcatgcaccctcccgcctctgagatacaggggagaagacggctgttggtatggtatggagatccgcccacttaaggagaaagaagagaatttggtgaacagtctggtgactgccgggcatggacaaatcgataattttagcttaggcgtcctcggtatggctctgttccttgaagagatgctgcgaacacgggttggcaccaagcacgcaattttgctcgtggccgtatcgtttgtgactctgatcacagggaacatgtccttccgtgacctaggaagagtcatggtgatggttggcgctaccatgacggatgacattgggatgggagtgacttacctggccctcctggcagcgtttaaggtcaggcccaccttcgccgctggccttttgctgcgcaaattaacatctaaggaactcatgatgaccactataggtatcgtgctgcttagccagtcaacaattcctgagagtatcctggagctaaccgatgccctcgcactggggatgatggttttgaaaattgtgcggaatatggaaaagtatcagctggctgtcacaatcatggccatattatgcgtacccaacgcagtgatcctccaaaatgcctggaaagtttcctgtactaccctggctgtggtctctgtgagcccacttctgttgacgtcctcacagcagaaggcggactggattcctctcgccctgacaatcaagggactaaaccccaccgcaatttttctgactacccttagcagaacaagtaaaaagaggtcttggccactcaatgaggctatcatggccgtaggcatggtgtccatactggccagctcgttgctgaaaaacgatattccgatgactggccctttagtcgctgggggactcctgaccgtttgctacgtgcttacgggtcgatcagcagacctggaattggagcgcgccgcggacgtgcggtgggaagaacaggctgagatctctggcagttcccccatcctcagcattacaatatctgaagatgggagcatgtccatcaagaatgaggaagaggagcaaaccctgactattctaatcagaacaggactgcttgtcatttcaggcctcttcccagtgagtatccccataaccgccgcagcctggtatctgtgggaagttaaaaagcagagggctggtgtattgtgggacgtgcctagcccaccccctgtcgggaaagcagagttagaagatggagcctaccgtatcaagcagaagggcattctgggctattctcagatcggggcgggagtgtacaaagagggtacttttcacacaatgtggcatgttacccgcggcgctgtgctcatgcacaaggggaaacggattgaaccgtcctgggccgacgtcaagaaagatctgatctcatacggaggcggttggaaacttgagggggagtggaaggaaggagaggaagtgcaagtactggcattggagccaggcaaaaaccccagagccgtccagacgaagcctggcctattcaaaactaacaccgggacaataggagctgtgagtctggactttagcccaggtacctccggctctcccattgttgataagaaagggaaggtggtcggactctatggcaatggtgtggttacaaggtcggggacttacgtgagcgccatcgcacagaccgaaaagtcaatcgaggacaaccctgagattgaagatgacatcttcagaaagaaacggctgacgataatggatcttcatccgggagctggcaaaacaaagcgctatttacccgccattgtcagagaggcgatcaaaaggggcctgcggactctcattttggccccaacccgagtggtagcagctgaaatggaggaagccctgagagggctccctatccgctaccagacacccgctataagggcagagcacaccggacgtgagattgtggacctgatgtgtcatgccactttcaccatgcggcttctgtccccaatcagagttcctaattataacttgatcattatggatgaagcccactttacagaccccgctagtatcgcggcaaggggttacatttctacgcgcgtcgagatgggcgaagccgctgggatattcatgactgccaccccaccgggaagccgagacccttttccccaatccaatgcaccaatcatggatgaggagagagaaattcccgagcggtcatggaactctggccacgaatgggtgacagacttcaagggtaagaccgtgtggtttgtccctagcatcaaagccgggaatgatatcgctgcgtgcctaaggaagaacggcaagaaggtaattcagctgagtcgcaaaactttcgactccgagtatataaagacacgtaccaatgattgggactttgtggttacgactgatatcagcgaaatgggcgccaacttcaaggcagagagagtgattgacccacggaggtgtatgaaacccgtcatcctcacagatggcgaggaacgcgtgattttagctgggcctatgccggttacccattcttcagccgcacagcgaagaggacgggtgggtaggaatccaaagaacgagaatgaccaatacatctacatgggcgaacccctggagaacgatgaagactgcgcccactggaaagaggctaagatgcttctggacaatataaacacccctgaggggatcattccctccatgtttgaaccagagcgcgaaaaagtcgatgccatcgacggagagtatagactcaggggcgaagcgcggaagactttcgtggatttgatgcgtcgcggtgacctgcctgtatggctcgcataccgagtggccgctgaggggattaactatgccgatagaaggtggtgttttgacggcgttaaaaataaccagatcctggaggaaaatgtcgaggtggaaatatggacaaaggagggagagcggaagaaacttaagccccgctggctagatgctagaatttacagtgacccactggcattgaaagagttcaaggagttcgccgctggcaggaagtcgttaaccctgaacctcatcacagaaatggggcggctgcctacttttatgacgcagaaggccaagaatgcacttgataacctggcggtgctccataccgccgaggctggaggtcgagcctataatcacgcattgagcgaactgccggagacactagagactctgctccttctgaccttattggctacagtcaccggcgggattttcctgtttctcatgtctggaaaaggcatcggtaagatgactctggggatgtgctgcataatcacggcctccattcttctgtggtacgcacagatccaaccccactggattgccgctagcatcatactcgagttctttttgattgttctgttaatcccagagcctgaaaaacagagaacaccccaggacaaccagctaacatatgtggtaatcgcgattctgactgtggtcgccgcaaccatggctaatgagatgggcttcctcgaaaagaccaagaaggattttggacttggctcaatcaccactcaacagccagagagtaacatactggacattgatttgcgccctgcctctgcctggacactgtacgcagtggctacgaccttcatcactcccatgctcaggcattccattgagaatagctcagttaacgtgagtctgacagccatcgcgaatcaggctaccgtccttatggggctcggaaagggttggccgctgagcaaaatggacataggcgtaccattgctggccatcgggtgttactcccaggtgaaccctattaccttaacagcagccctactgctccttgttgctcactatgcaatcattggacccggcctgcaagccaaggcgactcgggaagctcagaaacgtgccgcagccggtatcatgaagaatccaacggtggacgggatgaccgtcattgatttggaccccatcccttacgatccgaaatttgagaagcagctgggccaggtgatgctcctggtcctttgcgtgacacaagttttaatgatgagaactacctgggctctgtgtgaagccctcacattggcaaccggacccatatctactctgtgggagggcaacccagggaggttctggaatacgacaattgctgtgagcatggccaacatctttcgcggatcctatctagcgggcgccggtctactcttctcaatcatgaagaacaccgcaaatactcggcgagggaccggaaacacaggcgaaactcttggtgagaaatggaagaatagactgaacgctttgggcaaatctgagtttcagatttacaagaaaagtgggatacaggaagtagacaggaccctggccaaggagggaatcaaacgcggcgaaacagatcatcacgcagtgtcgcgggggagcgctaagctcagatggttcgtcgagcgtaatctggttacgcctgagggaaaggtggtcgacttaggctgcggtagagggggatggtcctattactgtggcggtcttaaaaacgtgaaggaagtaaaaggcctgaccaaagggggacccggccatgaggaacctattccaatgtctacttatgggtggaatctcgtgcggctacaatcaggagttgatgtgttctttacaccccctgagaaatgcgacaccctgttgtgtgatatcggcgaaagctccccaaaccccactgtcgaggccggtcgcacactgcgagtgctcaatcttgtcgagaactggctgaataacaatacccagttctgcattaaggtgttgaacccgtacatgcctagtgttatcgaaaagatggaggccctgcagagaaaatacgggggagcgctcgtaaggaatccattatctcggaacagcacgcacgaaatgtattgggtgtcaaacgcttccggcaatatagtcagtagcgtgaacatgatctctcgcatgctgattaatagatttaccatgaggcacaagaaagcaacatacgagcccgacgttgatcttggctccgggactcgaaacatcggaattgaatcagagacccctaatctggacatcataggtaagcggattgagaaaatcaagcaggaacatgagacaagctggcactatgatcaagaccatccatacaagacttgggcctatcacggctcgtacgaaaccaaacagacagggtctgctagttccatggtgaacggagtcgtgcgtctactcaccaagccctgggacgtaatcccgatggtgactcagatggccatgacggatacaacccctttcggccagcaaagagtttttaaagagaaggtcgacactcgcacccaggaacccaaagagggtacaaagaagctgatgaaaattacggcagagtggttgtggaaggaactggggaaaaagaaaaccccaaggatgtgtactcgggaggagttcacaagaaaggtgcgcagcaatgccgctctcggagcgatatttaccgatgagaacaaatggaagtcagccagggaggcagtggaagactccggcttctgggagcttgtcgataaggaacgaaatctgcacttagagggcaaatgcgaaacttgtgtttataacatgatggggaagcgggagaaaaagctgggagagtttggtaaagctaagggctctagagccatctggtacatgtggttgggggcaaggttcctcgaatttgaggccctgggattcctaaatgaagaccattggtttagccgcgagaacagtctttccggcgtggaaggtgaggggctgcacaagctcggatacattctgcgtgatgtaagcaaaaaggagggcggcgctatgtatgccgacgatacagcggggtgggacacccggatcacattggaagatctgaaaaatgaggaaatggtgactaaccatatggagggagaacacaagaaactcgcagaggccattttcaaacttacctaccagaataaggtcgtgagagttcagaggcctacgccccgcggtaccgtgatggacatcatatctcgacgggaccaaagaggctcagggcaggtcgtgacatatggactgaacactttcaccaacatggaggctcagttaatcaggcaaatggaaggcgagggtgtatttaaaagtattcagcagctgacagttaaggaagagatcgccgtgaaaaattggttgattcgcgtcgggagagagcggctctccaggatggcaatcagcggagatgactgcgtggtgaagccactggatgaccgtttcgcttctgccctaactgctcttaacgatatgggcaaagtccgaaaggacattcagcaatgggaaccctcgcgcggctggaatgattggacccaggttcctttttgctcacatcacttccacgagctgataatgaaggacgggagagtgctcgtagtgccatgtcggaaccaggatgaactgatcggaagggcccgcattagccagggtgcaggctggtccttgagagagacggcgtgcttagggaaaagttacgcccaaatgtggtctctgatgtattttcatcggagggacctccgacttgctgccaatgcaatctgtagcgctgtcccgtcccactgggtgcccacatcacgtaccacttggagtatccatgccacacacgaatggatgaccactgaggatatgctgaccgtttggaacagagtgtggattcaggagaatccttggatggaagacaagacaccagtcgagtcttgggaagagataccctacctaggaaaacgcgaagatcagtggtgcggcagcctgatcggtctcacgtcccgggcaacctgggccaagaacattcagactgcgatcaatcaagtgaggtcattgattgggaacgaggagtatacagactacatgcctagcatgaaaagattccgccgggaagaggaagaggctggagtactgtggtga

SEQ ID NO: 14969 - RNA, 9876 nt, synthetic construct
  misc_feature 1..9876: note = derived and/or modified CDS sequence (opt3) from DENV-2__KM279608__SS-prME
  source 1..9876: mol_type = other RNA
accgcaggcatcattataatgatgatcccaacagtgatggctttccacctgactacgagaaatggggagcctcatatgattgtcagcaggcaggaaaagggaaaatccctcctttttaagaccgagaatggtgttaatatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgtgacgggagagcaccgccgagaaaaacgtagtgtggccctcgtcccccatgtgggcatgggtctggagactagaaccgaaacatggatgagctccgagggggcgtggaagcacgctcagaggatcgagacttggatacttcggcatcctggattcaccatcatggccgcaattctggcctacacaatcggcaccacgtatttgcagcgcgttctcatttttatcctgctgactgctgtgacaccatctatggcaatgagatgcataggcatttcgaacagggacttcgtcgaaggggtgtcaggaggtagctgggtagatatcgttctcgagcacggcagttgtgtgaccactatggccaaaaataagcccacattagactttgaactgattaagaccgaggctaaacaccctgccacgcttcggaagtactgcgtcgaagcgaaattgaccaacacaactaccgcatcccgctgtccaacacagggggagccctctctgaatgaggaacaagataagcgattcgtgtgcaaacatagcatggtggacagaggatggggcaacggttgtgggctatttggaaagggcggcatcgtcacttgcgccatgttcacatgcaagaaaaatatggaggggaaggttgtgcagcctgaaaacctcgagtatacaatcgtaattaccccacactccggagaagagaatgctgtgggtaacgatactggcaaacatgggaaggagataaaagtcacgccgcagtcaagtatcacagaagccgagctgaccggatacggcactgtgaccatggaatgtagccccaggacaggtcttgactttaatgagatggttctgttgcagatggaaaacaaggcatggctcgtgcaccggcaatggttcctggatttacctctgccatggctccccggggctgacacccagggctctaactggattcagaaagagactcttgtcacatttaagaatcctcacgccaagaaacaggatgtggtagttctgggatcccaagagggcgcgatgcatacggccttgaccggggcaactgaaatccagatgtcaagcggaaacctactgttcacaggtcacctcaagtgccgtctgcgcatggacaaacttcagctgaagggcatgagttattctatgtgtaccgggaaatttaaggtggtcaaggagatagctgaaacacaacatggaactattgtgatcagagtccagtacgagggcgacggttccccatgcaaaatccccttcgagattatggatttggaaaagaggcacgtgctcgggcggctgatcaccgttaatccgattgtgacggagaaagacaaccctgtaaatatagaagccgagcccccattcggcgatagctacatcattatcggagtcgaacctggccagttaaagctgtcgtggtataaaaaggggtcttccatcggacagatgtttgagaccacaatgcgaggtgctaagcgcatggccattctaggcgacactgcatgggatttcgggtcactcggaggcgtgtttaccagtataggtaaagccctgcatcaagttttcggggctatctacggcgcggcatttagcggagtgtcctggacaatgaagattcttatcggcgtcgtgattacttggatcgggatgaactctagaagcacctcattgagtgtatccctggtgctcgttggagtcgtgacgctgtatcttggcgtgatggtccaggccgacagcggttgtgttgtgtcttggaggaataaagagctgaagtgcgggtcaggaatattcatcacagataacgtgcacacctggactgaacagtacaaatttcagcccgagagtccaagcaagttggcttccgccattcaaaaggcacacgaagagggcatctgtggtattcggtctgtaacacgcctcgaaaatctgatgtggaaacagatcacccccgagttaaaccatatactgactgagaatgaagtcaagctaaccattatgacaggcgacatcaaagggattatgcaggccggaaagagatcgctcaggcctcagccaacggagctgaaatatagctggaaggcttggggcaaagccaagatgctttccaccgaattgcacaaccatactttcctgatcgatgggccggagacagcagaatgccccaataccaaccgtgcgtggaactcactcgaggtggaggactacggatttggcgttttcacaactaacatatggctgaagttaaaagaacggcaagatgtgttttgtgacagtaagctgatgtctgctgccatcaaagacaaccgagcagtccacgccgatatgggttattggattgagagcgctcttaatgacacctggaagatcgaaaaagcctccttcattgaggtgaagtcatgccactggcctaagagccatacgttgtggtctaacggggttctcgagtccgaaatgatcatacccaagaattttgcaggacccgtgagtcagcacaactacagacctggctaccatacacagaccgctggtccatggcacctgggcaggctagagatggatttcgacttctgtgaagggactaccgtagtcgtgacagaggattgcggaaatcgcggccccagcctgcggactaccacagcctctgggaagctcattacggaatggtgctgtagatcctgcaccctgccgcctcttaggtatcgcggagaggacggctgttggtacggtatggagatccgaccattgaaagaaaaggaggaaaacctggtaaattcattagtcactgcggggcatggacagatcgataactttagtctcggcgttctgggtatggcccttttcctggaggaaatgttgcggacacgtgtgggcaccaaacacgctattctcctggtagcagtgagctttgtcactctaatcacagggaatatgtcgttcagagacctgggaagggtgatggttatggtgggcgccaccatgacggatgacattgggatgggagtcacttatctcgctctgcttgccgcatttaaggtgcgccccaccttcgcggccggcttgctgttacggaagctcacatccaaagagctgatgatgaccactataggtatcgttcttctgtctcaaagcacaattcctgagtcaatcctagaactcaccgatgctctggccttggggatgatggtgctgaagattgtcagaaacatggagaaataccagttagcagtaacaatcatggctatactctgcgtgcccaatgccgttatcctggaaaacgcatggaaggtgagttgtactacccttgccgtcgtgtccgtatctccactgttgctcacgagctcccagcaaaaagctgactggattcctctggcgctaacaatcaagggactgaatcccaccgccatttttcttactaccctctcaaggacaagcaagaaacgaagttggccactgaacgaggcaatcatggctgtgggcatggtctctatattggcctccagcctgttaaagaatgatattccgatgactggccctctcgttgccgggggactgcttaccgtgtgctatgtgctgacgggtcgctcggctgacttggaactcgagcgggcagccgacgtcagatgggaggaacaggcggagatctcaggctctagtcccatcctgtccattacaataagcgaagatgggtctatgagcatcaaaaacgaggaggaagaacagaccctaactattctgatcaggacaggacttctcgtgatttccggcctgttcccagtttcaatccccataaccgctgccgcatggtacttgtgggaagtaaagaaacagcgtgccggtgtgttatgggacgtccctagtccaccccctgtggggaaggctgagctggaagatggagcatatcgcatcaaacaaaagggcattctcggctacagccagatcggggccggagtttacaaggagggtacttttcacacaatgtggcatgtgacccggggcgcggtcctgatgcacaaagggaagagaattgagccgtcttgggctgacgtgaaaaaggatcttatctcctatggaggcggttggaaactggaaggggagtggaaggaaggagaggaagtacaggtcttggccctagagccaggcaagaaccccagggcagtgcagacgaaacctggcctgttcaagactaataccgggacaataggagccgtttcactcgactttagtccaggtaccagcggctcccccattgtggataaaaaggggaaagtcgtgggactgtacggcaacggtgttgtgacacgatctgggacttatgtctcggctatcgcccaaaccgaaaagagcatcgaagacaatcctgagattgaagatgacatcttccggaagaaacgccttacgataatggatttacatccgggagcaggcaagacaaaaagatacctgcccgctattgtgagggaggccatcaagcggggcctccgaactttgattctggcgccaaccagagtagtggccgcagaaatggaggaggctctccgcgggctgcctatcaggtatcagacacccgccatacgtgctgaacacaccggacgggagattgttgaccttatgtgtcatgcaacttttaccatgagactgttgtcaccaatcagggtccctaactacaatctaatcattatggatgaagcccacttcacagaccccgcctccatcgctgcgcgcggttatattagtacgcgagtggagatgggcgaggcagccgggatattcatgactgctaccccaccgggatctagagacccttttccccagagcaacgccccaatcatggatgaagaacgggaaattcccgagaggtcctggaactcaggccacgaatgggtgacagacttcaaaggtaagaccgtctggtttgtaccttctatcaaggcagggaacgatatcgccgcttgcctgcgcaaaaatggaaagaaagtgattcagctcagccgtaagactttcgacagtgagtacataaaaacaagaaccaacgattgggactttgttgtgacgactgatatctccgagatgggcgcgaatttcaaggccgaacgggtcattgacccaaggcgctgtatgaagcccgtgatcttaacagatggcgaggaacgagttattctggcagggcctatgccggtgacccatagctctgctgcccaaagacggggaagggtcggtcgcaaccccaagaatgagaacgaccagtacatctatatgggcgaaccccttgagaatgatgaggactgcgcacactggaaggaagccaaaatgctgctcgacaacataaacacccctgaggggatcattccctcaatgtttgaaccagagagagaaaaggtggatgctatcgacggagagtacaggttgcggggcgaggcccgtaaaactttcgtagatctgatgcgccgaggtgacctccctgtgtggctggcgtataaggttgcagccgaagggattaattacgctgatagaaggtggtgttttgacggcgtcaaaaacaatcagatccttgaggaaaacgtggaggtggagatatggacaaaggaaggagagcggaagaaactaaagccccgctggctggatgccagaatttattccgacccattggctttaaaagagttcaaggagtttgcagccggcaggaaaagtctgaccctcaatctgatcacagaaatggggcggcttcctactttcatgacgcaaaaggctaagaacgccctggataatctcgcagtcttgcataccgcggaggccggaggtcgagcttacaaccacgccctgagcgagctaccggaaacactggagactctccttctgttaaccttgctggcaacagttaccggcgggattttcctctttctgatgtcgggaaaaggcatcggtaagatgactcttgggatgtgctgcataatcacggcttctattctgctctggtatgcccagatccagccccactggattgcagcctccatcatattggagttctttctgattgtgttactaatcccagagcctgaaaaacagagaaccccacaagacaatcagctgacatacgtagtgatcgctattctcactgtcgtggcggccaccatggcaaacgagatgggcttccttgagaagaccaagaaggattttggactgggcagcatcaccactcagcagccagaatcaaatatattggacattgatctgcgccctgctagtgcctggacactctacgccgttgcaacgaccttcatcactcccatgctgaggcattctattgagaactccagcgtgaatgtctcacttacagctatcgccaaccaagcgaccgtactcatggggctgggaaagggttggccgttgagtaaaatggacataggcgtgccactgttagctatcgggtgttatagccaggttaatcctattaccctaacagccgcactgctccttctggtggcccactacgctatcattggacccggcttgcaggcaaaggccactcgggaagcgcagaaacgtgctgccgcaggtatcatgaagaacccaacggtcgacgggattaccgtgatcgatctggaccccataccttatgatccgaaatttgagaagcaactcggccaggtcatgctgcttgtgttatgcgttacacaggtgctgatgatgagaactacctgggccctctgtgaggctttgacactggccaccggacccatttccactctatgggagggcaatccagggaggttctggaacacgacaatcgcagtatctatggctaacatctttcgcggaagctacctggccggcgcgggtctccttttctccattatgaagaataccgccaacactcggcgagggaccggaaatacaggcgagactctgggtgaaaaatggaagaacagattgaatgcactgggcaaatcagagtttcagatatataagaaatctgggatccaagaagtggacaggaccctcgctaaggagggaattaaacgcggcgagacagatcatcacgccgtcagtcgggggtcggcaaagctgagatggttcgttgaacgtaacttagtgacgcctgagggaaaggtcgtggaccttggctgcggtaggggagggtggagctactattgtggcggtctgaaaaatgtaaaggaagtgaaaggcctcaccaaaggcgggcccgggcatgaggaacctatcccaatgtccacttacgggtggaacctagttcggctgcagtctggagtggatgtctttttcacaccccctgagaaatgcgacaccttgctgtgtgatattggcgagtcaagcccaaatcccactgtggaagctggtcgcacactccgagtccttaacctggtggagaattggttgaacaataacacccagttctgcatcaaggttctgaatccgtacatgccttccgtaatagaaaagatggaggccctccaaagaaaatatgggggagccttagtgaggaacccactgagtcggaactctacgcacgaaatgtactgggtcagcaatgcgtcaggcaacatcgtgtccagtgttaatatgattagccgcatgcttatcaacagatttaccatgaggcacaagaaagctacatatgagcccgacgtggatctgggctctgggactcgaaatattggaatcgagtccgaaacccctaacctagacataattggtaagcggatcaaaaagatcaagcaggagcatgaaacatcatggcactacgatcaggaccatccatataaaacttgggcataccacggcagctatgagaccaagcagacagggtcggcctctagtatggtcaatggagtggtacgtctcctgaccaaaccctgggacgtgattccgatggttactcaaatggctatgacggatacaacccctttcggccagcagagagtctttaaggaaaaagtggacactcgcacccaggagcccaaggagggtacaaagaaattgatgaagataacggccgaatggctgtggaaagagctcgggaagaaaaagaccccaaggatgtgtactcgggaagagttcacaagaaaagtgcgctccaacgcagcccttggagctatctttaccgatgagaataagtggaaaagcgcgagggaagccgtcgaggactcaggcttctgggaactggttgataaagagcgaaacttacacctggaaggcaagtgcgagacttgtgtgtacaatatgatggggaaacgggagaagaaattgggagaatttggtaaggcaaagggctccagagctatttggtacatgtggctcggggccaggttcctggagtttgaagcactaggattccttaacgaggaccattggttttctcgcgaaaatagcctgagtggcgtagagggtgaggggctccacaaactgggatatatcttgcgtgatgtgtccaagaaagaaggcggcgccatgtacgctgacgatacagccgggtgggacacccggattacactggaggatctcaagaacgaagagatggtcactaatcatatggaaggagagcacaagaaacttgcggaggcaatcttcaaactgacctatcaaaacaaagtggttagagtgcagaggcctacgccccgcggtaccgtcatggacataatcagccgacgggaccagagaggctctggacaggtggtaacatacggattaaacacttttaccaatatggaagcccaactgattaggcagatggagggcgaaggtgttttcaagtcaatccagcaattgacagtgaaagaggagattgctgtcaagaactggctcatccgcgtggggagagaacggctgagtaggatggccatttccggagatgactgcgtggtcaaaccactagatgaccgtttcgcaagcgctcttactgccctgaatgatatgggcaaggttcgaaaggacatacagcagtgggagccctctcgcggctggaacgattggacccaggtgcctttttgctcgcatcacttccacgaactcatcatgaaagacgggagagtactggtggtcccatgtcggaatcaagatgagttgattggaagggctcgcatctcacagggtgccggctggagcttaagagaaacggcatgcctggggaagtcctatgcgcagatgtggagtctcatgtactttcatcggagggaccttcgactggccgctaacgccatctgttctgcagtgccgagccactgggttcccacatcccgtaccacttggtcaattcatgctacacacgagtggatgaccactgaggatatgctaaccgtgtggaatagagtctggatacaggaaaacccttggatggaggacaaaacaccagtggaaagttgggaggaaatcccctatctgggaaagcgcgaggatcaatggtgcggctctctcattggtttgacgagccgggccacctgggccaaaaatatccagactgccattaaccaggtaaggtccctgatcgggaatgaggaatacacagactacatgccttcaatgaagagattccgccgggaggaagaggaagcgggagttctttggtga

SEQ ID NO: 14970 - RNA, 9876 nt, synthetic construct
  misc_feature 1..9876: note = derived and/or modified CDS sequence (opt3) from DENV-2__KM279605__SS-prME
  source 1..9876: mol_type = other RNA
accgccggaatcattataatgatgatccccaccgtgatggctttccacctgactacgcgaaatggggaacctcatatgattgtcagcaggcaggaaaagggaaagtccctcctttttaagaccgagaatggtgttaatatgtgcacactgatggcaatggacttgggcgaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgtggcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacaccctgcgacgctgcggaagtactgcgtggaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaaggtcgttcagcctgaaaacctagagtatacaatcgtgattaccccacactccggagaagagaatgccgtaggtaacgatactggcaaacatgggaaggagataaaagtgacgccgcagtcaagtatcacagaagcagagctcaccggatacggcactgtcaccatggaatgtagccccaggacaggtctggacttcaatgagatggtgcttctgcagatggaaaacaaggcttggttggttcaccggcaatggtttctcgatctgcctttaccatggctgcccggggccgacacccagggctctaactggattcagaaagagactctcgtgacattcaagaatcctcacgcgaagaaacaggatgtcgtggtacttggatcccaagagggcgccatgcatacggcactgaccggggctactgaaatccagatgtcaagcggaaacttgctatttacaggtcacctgaagtgccgtctccgcatggacaaactgcagcttaagggcatgagttattctatgtgtaccgggaaattcaaggttgtgaaggagatagccgaaacacaacatggaactattgtcatcagagtgcagtacgagggcgacggttccccatgcaaaatccccttcgagattatggatctggaaaagaggcacgtcttggggcggctcatcaccgtgaatccgattgttacggagaaagacaaccctgtgaatatagaagctgagcccccatttggcgatagctacatcattatcggagtagaacctggccagctgaagttatcgtggttcaaaaaggggtcttccatcggacagatgtttgagaccacaatgcgaggtgccaagcgcatggcaattctgggcgacactgcctgggatttcgggtcactaggaggcgtctttaccagtataggtaaagctctccatcaagtgttcggggcgatctatggcgcagcctttagcggagtttcctggacaatgaagattctgatcggcgtggtcattacttggatcgggatgaactctagaagcacctcacttagtgtgtccttggtactggtgggagttgtcacgctctacctgggcgtgatggtgcaggctgacagcggttgtgtcgtttcttggaaaaataaggagcttaaatgcgggtcaggaatattcatcacagataacgtgcacacctggactgaacagtataagtttcagcccgagagtccaagcaagctggcctccgcaattcaaaaagcccacgaagagggcatctgtggtattaggtctgtgacacggttggaaaatctcatgtggaagcagatcacccccgagctgaaccatatattaactgagaatgaagtaaaactgaccattatgacaggcgacatcaaggggattatgcaggctggaaaacgctcgctaagacctcagccaacggagctcaagtacagctggaaagcctggggcaaggcaaagatgctgtccaccgaacttcacaaccatactttcttgatcgatgggccggagacagcggaatgccccaataccaacagggcttggaactcactggaggtcgaggactatggatttggcgtgttcacaactaacatatggctcaaactgaaggaacgtcaagatgtattttgtgacagtaaattaatgtctgccgcaatcaaggacaaccgggccgtgcacgctgatatgggttactggattgagagcgccctgaatgacacctggaaaatcgaaaaggcatccttcattgaggtcaagtcatgccactggcctaaaagccatacgctttggtctaacggggtgttggagtccgaaatgatcataccaaagaatttcgctggacccgttagtcagcacaactatcgacctggctaccatacacagaccgccggtccatggcacctcggcagactggagatggattttgacttctgtgaagggactaccgtggtagtcacagaggattgcggaaataggggccccagcctacgcactaccacagcgtctgggaaactgattacggaatggtgctgtcggtcctgcaccctcccgcctctgagatacaggggagaggacggctgttggtatggtatggagatccgcccacttaaggaaaaagaggaaaacttggtaaattcactggtgactgccgggcatggacagatcgataactttagtttaggcgtcctcggtatggctctgttccttgaggaaatgctgcgaacacgggttggcaccaagcacgcaattttgctcgtggccgttagctttgtgactctgatcacagggaatatgtcgttccgtgacctaggaagagtcatggtgatggttggcgctaccatgacggatgacattgggatgggagtgacttacctggccctcctggcagcgtttaaggtcaggcccaccttcgccgctggccttttgctgcgcaaattaacatccaaggagctcatgatgaccactataggtatcgtgctgctttctcaaagcacaattcctgagtcaatcctggaactaaccgatgccctcgcactggggatgatggttttgaaaattgtgcggaacatggagaagtatcagctggctgtcacaatcatggccatattatgcgtacccaatgcagtgatcctcgaaaacgcctggaaagttagttgtactaccctggctgtggtctccgtgtctccacttctgttgacgagctcccagcaaaaggcggactggattcctctcgccctgacaatcaagggactaaatcccaccgcaatttttctgactaccctttcaagaacaagcaaaaagaggagttggccactcaacgaggctatcatggccgtaggcatggtgtctatactggcctccagcttgctgaaaaatgatattccgatgactggccctttagtcgctgggggactcctgaccgtttgctacgtgcttacgggtcgatcggcagacctggaattggagcgcgccgcggacgtgcggtgggaggaacaggctgagatctcaggctctagtcccatcctctccattacaataagcgaagatgggtctatgagcatcaagaacgaggaggaagaacagaccctgactattctaatcagaacaggactgcttgtcatttccggcctcttcccagtgtcaatccccataaccgccgcagcctggtatctgtgggaagttaaaaagcagagggctggtgtattgtgggacgtgcctagtccaccccctgtcgggaaagcagagttagaagatggagcctaccgtatcaagcaaaagggcattctgggctatagccagatcggggcgggagtgtacaaagagggtacttttcacacaatgtggcatgttacccgcggcgctgtgctcatgcacaaggggaaacggattgagccgtcttgggccgacgtcaagaaagatctgatctcctacggaggcggttggaaacttgaaggggagtggaaggaaggagaggaagtgcaggtactggcattggagccaggcaaaaaccccagagccgtccagacgaagcctggcctattcaaaactaataccgggacaataggagctgtgtcactggactttagtccaggtaccagcggctcccccattgttgataagaaagggaaggtggtcggactctatggcaacggtgtggttacaaggtctgggacttacgtgtcggccatcgcacaaaccgaaaagagcatcgaagacaatcctgagattgaagatgacatcttcagaaagaagcggctgacgataatggatcttcatccgggagctggcaaaacaaagcgctatttacccgccattgtcagagaggcgatcaaaaggggcctgcggactctcattttggccccaacccgagtggtagcagctgaaatggaggaggccctgagagggctccctatccgctaccagacacccgctataagggcagaacacaccggacgtgagattgtggacctgatgtgtcatgccactttcaccatgcggcttctgtcaccaatcagagttcctaactataatttgatcattatggatgaagcccactttacagaccccgcttccatcgcggcaaggggttacattagtacgcgcgtcgagatgggcgaggccgctgggatattcatgactgccaccccaccgggatctcgagacccttttccccagagcaacgcaccaatcatggatgaagagagagaaattcccgagcggtcctggaactcaggccacgaatgggtgacagacttcaagggtaagaccgtgtggtttgtcccttctatcaaagccgggaacgatatcgctgcgtgcctaaggaagaatggcaagaaggtaattcagctgagccgcaaaactttcgacagtgagtatataaagacacgtaccaacgattgggactttgtggttacgactgatatctccgagatgggcgccaatttcaaggcagaaagagtgattgacccacggaggtgtatgaaacccgtcatcctcacagatggcgaggaacgcgtgattttagctgggcctatgccggttacccatagctctgccgcacaacgaagaggacgggtgggtaggaacccaaagaatgagaacgaccagtacatctacatgggcgaacccctggagaatgatgaggactgcgcccactggaaagaagctaagatgcttctggacaacataaacacccctgaggggatcattccctcaatgtttgaaccagagcgcgaaaaagtcgatgccatcgacggagagtatagactcaggggcgaggcgcggaagactttcgtggatttgatgcgtcgcggtgacctgcctgtatggctcgcatacaaagtggccgctgaagggattaattatgccgatcgaagatggtgttttgacggcgttaagaacaatcagatcctggaggaaaacgtcgaggtggagatatggacaaaggaaggagagaggaagaaacttaaaccccggtggctagatgctcgcatttactccgacccactggcattgaaagagttcaaagagttcgccgctggcagaaagagtttaaccctgaatctcatcacagaaatggggaggctgcctacttttatgacgcaaaaggccaaaaacgcacttgataatctggcggtgctccataccgccgaggctggaggtcgggcctataaccacgcattgagcgagctgccggaaacactagagactctgctccttctgaccttattggctacagtcaccggcgggattttcctgtttctcatgtcgggaaagggcatcggtaaaatgactctggggatgtgctgcataatcacggcctctattcttctgtggtacgcacagatccagccccactggattgccgcttccatcatactcgagttctttttgattgttctgttaatcccagagcctgaaaagcagcgaacaccccaagacaatcagctaacatatgtggtaatcgcgattctgactgtggtcgccgcaaccatggctaacgagatgggcttcctcgagaaaacaaagaaggattttggacttggcagcatcaccactcagcagccagaatcaaatatactggacattgatttgagacctgccagtgcctggacactgtacgcagtggctacgaccttcatcactcccatgctccgccattctattgagaactccagcgttaatgtgtcactgacagccatcgcgaaccaagctaccgtccttatggggctcggaaaaggttggccgctgagtaagatggacataggcgtaccattgctggccatcgggtgttacagccaggtgaatcctattaccttaacagcagccctactgctccttgttgctcactatgcaatcattggacccggcctgcaggccaaagcgactagggaagctcagaagcgggccgcagccggtatcatgaaaaacccaacggtggacgggattaccgtcatcgatttggaccccataccttacgatccgaagtttgagaagcaactgggccaggtgatgctcctggtcctttgcgtgacacaggttttaatgatgcgtactacctgggctctgtgtgaagccctcacattggcaaccggacccatttccactctgtgggagggcaatccagggagattctggaacacgacaatcgctgtgtctatggccaacatctttaggggaagctatctagcgggcgccggtctactcttctccattatgaaaaataccgcaaacactcgccgggggaccggaaatacaggcgagactcttggtgaaaagtggaaaaaccgactgaatgctttgggcaagtcagagtttcagatatacaaaaagtctgggatccaagaagtagacagaaccctggccaaagagggaattaagaggggcgagacagatcatcacgcagtgagtcgcgggtcggctaagctccggtggttcgtcgaaagaaacctggttacgcctgagggaaaagtggtcgacttaggctgcggtcgtgggggatggagctattactgtggcggtcttaagaatgtgaaagaagtaaagggcctgaccaaagggggacccggccatgaggaacctatcccaatgtccacttatgggtggaacctcgtgaggctacagtctggagttgatgtgttctttacaccccctgagaagtgcgacaccctgttgtgtgatattggcgagtcaagcccaaatcccactgtcgaagccggtcggacactgcgcgtgctcaaccttgtcgagaattggctgaacaataacacccagttctgcatcaaggtgttgaatccgtacatgccttccgttatagagaagatggaggccctgcaacgaaagtacgggggagcgctcgtaagaaacccattaagtaggaactctacgcacgaaatgtattgggtgagcaatgcttcaggcaacatcgtctccagtgtgaatatgattagccggatgctgatcaaccgctttaccatgagacacaaaaaggcaacatacgagcccgacgttgatcttggctctgggactaggaatattggaatcgagtccgaaacccctaacctggacataattggtaaacgaatcgagaagatcaagcaggaacatgagacatcatggcactatgatcaggaccatccatacaaaacttgggcctatcacggcagctacgaaaccaagcagacagggtcggcttctagtatggtgaatggagtcgtgcggctactcaccaaaccctgggacgtaattccgatggtgactcaaatggccatgacggatacaacccctttcggccagcagcgtgtttttaaggagaaagtcgacactagaacccaggagcccaaggaaggtacaaagaaactgatgaagataacggcagagtggttgtggaaagaactggggaagaaaaagaccccacgcatgtgtactagggaggagttcacacggaaagtgagatccaacgccgctctcggagcgatctttaccgatgaaaataagtggaaaagcgcccgcgaggcagtggaagactcaggcttctgggagcttgtcgataaagaaaggaacctgcacttagagggcaagtgcgagacttgtgtttataatatgatggggaaacgagaaaagaaactgggagagtttggtaaggctaagggctcccgggccatttggtacatgtggttgggggcaagattcctcgaatttgaggccctgggattcctaaacgaagaccattggttttctagggagaatagccttagtggcgtggagggtgaagggctgcacaaactcggatacatcctgcgcgatgtatccaagaaagagggcggcgctatgtatgccgacgatacagcggggtgggacacccgtattacattggaagatctgaagaacgaggaaatggtgactaatcatatggagggagagcacaaaaagctcgcagaagccatcttcaaacttacctaccaaaacaaagtcgtgcgggttcagagacctacgcccaggggtaccgtgatggacataatcagccgccgagaccagcggggctctgggcaggtcgtgacatatggactgaacactttcaccaatatggaggctcaattaattagacagatggaaggcgagggtgtatttaagtcaatccagcaactgacagttaaagaggaaattgccgtgaagaactggttgatcagggtcgggcgcgagagactcagtcggatggcaatttccggagatgactgcgtggtgaaaccactggatgacaggttcgctagcgccctaactgctcttaatgatatgggcaaggtccgtaaggacatacagcagtgggaaccctctcgaggctggaacgattggacccaggttcctttttgctcgcatcacttccacgagctgatcatgaaagacgggcgcgtgctcgtagtgccatgtagaaatcaagatgaactgattggacgggccaggatctcacagggtgcaggctggagcttgcgcgagacggcgtgcttagggaagtcctacgcccagatgtggagtctgatgtattttcatagacgggacctcaggcttgctgccaacgcaatctgttctgctgtcccgagccactgggtgcccacatcccgaaccacttggtcaattcatgccacacacgagtggatgaccactgaagatatgctgaccgtttggaatcgtgtgtggatacaggagaacccttggatggaagacaaaacaccagtcgagagttgggaagagatcccctacctaggaaagagagaggatcaatggtgcggctctctgattggtctcacgagccgcgcaacctgggccaaaaatatccagactgcgattaaccaggtgcggtccttgatcgggaatgaagagtatacagactacatgccttcaatgaagaggttcagacgcgaagaggaagaggctggagtactgtggtga

SEQ ID NO: 14971 - RNA, 9876 nt, synthetic construct
  misc_feature 1..9876: note = derived and/or modified CDS sequence (opt3) from DENV-2__KM279609__SS-prME
  source 1..9876: mol_type = other RNA
accgccggaatcattataatgatgatccccacagtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgttgcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgaggtgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcagcctcagaccccagcctacggagctgaagtactcctggaaagcctggggcaaggcaaagatgctttcaaccgaattgcacaatcatactttcctgatcgatgggccagagacagcggaatgcccgaacaccaatagggcttggaacagtctcgaggtcgaggactatggatttggcgtgttcacaactaatatatggctgaaattaaaggaacgtcaagatgtattttgtgactctaaactgatgagcgccgcaatcaaggacaaccgggccgtgcacgctgatatgggttactggattgagtccgcccttaacgacacctggaaaatcgaaaaggcatcattcattgaggtcaagagctgccactggcccaaatctcatacgttgtggtccaatggggtgctcgagagtgaaatgatcatacctaagaacttcgctggaccagttagccagcacaattatcgacccggctaccatacacagaccgccggtccttggcacctgggcagactagagatggattttgacttctgtgaagggactaccgtggtagtcacagaggattgcggaaacaggggcccatctctgcgcactaccacagcgtccgggaaactcattacggaatggtgctgtcggtcatgcaccctgcccccgcttagatacaggggagaggacggctgttggtatggtatggagatccgccctttgaaggaaaaagaggaaaatctggtgaacagtttagtgactgccgggcatggacagatcgataattttagcctcggcgtcctgggtatggctcttttcctggaggaaatgttgcgaacacgggttggcaccaagcacgcaattctcctggtggccgtatcgtttgtgactctaatcacagggaacatgtccttccgtgacctgggaagagtcatggtgatggttggcgctaccatgacggatgacattgggatgggagtgacttacctcgccctgcttgcagcgtttaaggtcaggccaaccttcgccgctggcttgctgttacgcaaactcacatctaaggagctgatgatgaccactataggtatcgtgcttctgagccaatcaacaattcccgagagtatcctagaactcaccgatgccctggcattggggatgatggttctgaaaattgtgcggaatatggagaagtatcagttagctgtcacaatcatggccatactctgcgtacctaacgcagtgatcctgcagaatgcctggaaagtttcctgtactacccttgctgtggtctctgtgagccccctgttgctcacgtcctcacaacagaaggcggactggattccactggccctaacaatcaagggactgaaccctaccgcaatttttcttactaccctcagcagaacaagtaaaaagaggtcttggcccctgaatgaagctatcatggccgtaggcatggtgtccatattggccagctcgctgctaaagaacgatattccaatgactggcccgctcgtcgctgggggactgcttaccgtttgctacgtgctgacgggtcgatcagcagacttggagctcgaacgcgccgcggacgtgcggtgggaggagcaggctgaaatctctggcagttcccctatcctgagcattacaatatctgaggatgggagcatgtccatcaagaatgaagaggaggaacagaccctaactattctgatcagaacaggacttctcgtcatttcaggcctgttccccgtgagtatcccaataaccgccgcagcctggtatttgtgggaggttaaaaagcaaagggctggtgtattatgggacgtgcccagccctccacccgtcgggaaagcagaactggaggatggagcctaccgtatcaagcagaagggcattctcggctattctcagatcggggcgggagtgtacaaagaaggtacttttcacacaatgtggcatgttacccgcggcgctgtgctgatgcacaaggggaaacggattgagccttcctgggccgacgtcaagaaagatcttatctcatacggaggcggttggaagctggagggggaatggaaggagggagaagaggtgcaggtattggcactagaaccgggcaaaaacccaagagccgtccaaacgaagcccggcctgttcaaaactaacaccgggacaataggagctgtgagtctcgactttagccctggtacctccggctctccaattgttgataagaaagggaaggtggtcggactgtatggcaatggtgtggttacaaggtcggggacttacgtgagcgccatcgcacagaccgagaagtcaatcgaggacaaccccgaaattgaggatgacatcttccggaaaaagagacttacgataatggatttacatcctggagctggcaaaacaaagcgctatctgccggccattgtcagagaagcgatcaaaaggggcctccggactttgattctggcccccacccgagtggtagcagctgagatggaagaggccctcagagggctgccaatccgctaccagacccctgctataagggcagagcacaccggacgtgaaattgtggaccttatgtgtcatgccactttcaccatgcggctgttgtcccccatcagagttccaaattataacctaatcattatggatgaggcccactttacagaccctgctagtatcgcggcaaggggttacatttctacgcgcgtcgaaatgggcgaggccgctgggatattcatgactgccacacccccaggaagccgagacccgtttcctcagtccaatgcacccatcatggatgaggaaagagagattccagaacggtcatggaactctggccacgagtgggtgacagacttcaagggtaagaccgtgtggtttgtccccagcatcaaagccgggaatgatatcgctgcgtgcctgaggaagaacggcaaaaaggtaattcaactcagtcgcaaaactttcgactccgaatatataaagacacgtaccaatgattgggactttgtggttacgactgatatcagcgagatgggcgccaacttcaaggcagagagagtgattgaccctcggaggtgtatgaaaccagtcatcttaacagatggcgaagaacgcgtgattctggctgggcccatgcctgttacccattcttcagccgcacagcgaagaggacgggtgggtaggaatccgaagaacgaaaatgaccagtacatctacatgggcgagccacttgaaaacgatgaggactgcgcccactggaaagaggctaagatgctgctcgacaatataaacacccccgaagggatcattccttccatgtttgagcccgaacgcgagaaagtcgatgccatcgacggagaatatagattgaggggcgaggcgcggaagactttcgtggatctgatgcgtcgcggtgacctcccagtatggctggcataccgagtggccgctgaggggattaactatgccgatagaaggtggtgttttgacggcgttaaaaataaccaaatccttgaagagaatgtcgaagtggagatatggacaaaggagggagaacggaagaaactaaagcctcgctggctggatgctagaatttacagtgaccccttggcattaaaagagttcaaggagttcgccgctggcaggaaaagcctgaccctcaacctgatcacagagatggggcggcttccaacttttatgacgcagaaggccaagaatgcactggataacctcgcggtgttgcataccgccgaagctggaggtcgagcctataatcacgcactgtcggagctacctgagacactggaaactctccttctgttaaccttgctggctacagtcaccggcgggattttcctctttctgatgtctggaaaaggcatcggtaagatgactcttgggatgtgctgcataatcacggcctccattctgctctggtacgcacagatccagccgcactggattgccgctagcatcatattggagttctttctgattgttttactaatccccgaaccagagaaacaaagaacccctcaggacaaccagctgacatatgtggtaatcgcgattctcactgtggtcgccgcaaccatggctaatgaaatgggcttccttgagaagaccaaaaaggattttggactgggctcaatcaccactcagcaacccgagagtaacatattggacattgatctgcgcccagcctctgcctggacactctacgcagtggctacgaccttcatcactcctatgctgaggcattccattgaaaatagctcagttaacgtgagtcttacagccatcgcgaatcaggctaccgtcctcatggggctgggaaagggttggcccttgagcaaaatggacataggcgtaccgctgttagccatcgggtgttactcccaggtgaacccaattaccctaacagcagccctgctccttctggttgctcactatgcaatcattggacctggcttgcaggccaaggcgactcgggaggctcaaaaacgtgccgcagccggtatcatgaagaatcccacggtggacgggatgaccgtcattgatctggacccaatcccctacgatcctaaatttgaaaagcagctcggccaggtgatgctgcttgtcttatgcgtgacacaggttctgatgatgagaactacctgggctctctgtgaggccttgacactggcaaccggaccgatatctactctatgggaaggcaaccccgggaggttctggaatacgacaattgctgtgagcatggccaacatctttcgcggatcctatctggcgggcgccggtctccttttctcaatcatgaagaacaccgcaaatactcggcgagggaccggaaacacaggcgagactctgggtgagaaatggaagaatagattgaacgctctgggcaaatctgaatttcaaatttacaagaaaagtgggatacaggaggtagacaggaccctcgccaaggaaggaatcaaacgcggcgagacagatcatcacgcagtgtcgcgggggagcgctaagctgagatggttcgtcgagcgtaatttagttacgccagaaggaaaggtggtcgaccttggctgcggtagagggggatggtcctattactgtggcggtctgaaaaacgtgaaggaggtaaaaggcctcaccaaagggggacctggccatgaagaacccattcctatgtctacttatgggtggaatctagtgcggctgcagtcaggagttgatgtgttctttacaccacccgaaaaatgcgacaccttgctgtgtgatatcggcgagagctcccctaacccaactgtcgaggccggtcgcacactccgagtgcttaatctggtcgaaaactggttgaataacaatacccaattctgcattaaggtgctgaacccctacatgccgagtgttatcgagaagatggaagccctccagagaaaatacgggggagcgttagtaaggaatcctctgtctcggaacagcacgcacgagatgtattgggtgtcaaacgcttccggcaatatagtcagtagcgtgaacatgatctctcgcatgcttattaatagatttaccatgaggcacaagaaagcaacatacgaaccagacgttgatctgggctccgggactcgaaacatcggaattgagtcagagacccccaatctagacatcataggtaagcggattgagaaaatcaagcaggagcatgaaacaagctggcactatgatcaggaccatccttacaagacttgggcctatcacggctcgtacgagaccaaacaaacagggtctgctagttccatggtgaacggagtcgtgcgtctcctgaccaagccatgggacgtaatccccatggtgactcagatggccatgacggatacaaccccgttcggccagcagagagtttttaaagaaaaggtcgacactcgcacccaagagcctaaagagggtacaaagaagttgatgaaaattacggcagaatggctgtggaaggagctcgggaaaaagaaaacccccaggatgtgtactcgggaagagttcacaagaaaggtgcgcagcaatgccgctcttggagcgatatttaccgatgagaacaaatggaagtcagccagggaagcagtggaggactccggcttctgggaactggtcgataaggagcgaaatttacacctggaaggcaaatgcgagacttgtgtttataacatgatggggaagcgggagaaaaagttgggagaatttggtaaagctaagggctctagagccatctggtacatgtggctcggggcaaggttcctggagtttgaagccctaggattccttaatgaggaccattggtttagccgcgaaaacagtctgtccggcgtggagggtgaggggctccacaagctgggatacattttgcgtgatgtaagcaaaaaggaaggcggcgctatgtatgccgacgatacagcggggtgggacacccggatcacactggaggatctcaaaaatgaagagatggtgactaaccatatggaaggagagcacaagaaacttgcagaggccattttcaagctgacctaccagaataaggtcgtgagagttcagaggccaacgcctcgcggtaccgtgatggacatcatatctcgacgggaccagagaggctcagggcaagtcgtgacatatggattaaacactttcaccaacatggaagctcagctgatcaggcagatggagggcgaaggtgtatttaaaagtattcaacagttgacagttaaggaggagatcgccgtgaaaaattggctcattcgcgtcgggagagaacggctgtccaggatggcaatcagcggagatgactgcgtggtgaagcccctagatgaccgtttcgcttctgcccttactgctctgaacgatatgggcaaagtccgaaaggacattcagcagtgggagccatcgcgcggctggaatgattggacccaagttcccttttgctcacatcacttccacgaactcataatgaaggacgggagagtgctggtagtgccttgtcggaaccaggatgagttgatcggaagggcccgcattagccagggtgcaggctggtccttaagagaaacggcgtgcctggggaaaagttacgcccagatgtggtctctcatgtattttcatcggagggaccttcgactggctgccaatgcaatctgtagcgctgtcccatcccactggatcccgacatcacgtaccacttggagtattcatgccacacacgagtggatgaccactgaggatatgctaaccgtgtggaacagagtttggatacaagaaaatccctggatggaggacaagacacctgtggaatcttgggaggaaatcccatacctgggaaaacgcgaggatcagtggtgcggcagcctcattggtttgacgtcccgggcaacctgggccaagaacatccagactgcgattaatcaggtcaggtcactgatcgggaacgaggaatatacagactacatgcccagcatgaaaagattccgccgggaggaagaggaagctggagtgctttggtga

SEQ ID NO: 14972 - RNA, 9876 nt, synthetic construct
  misc_feature 1..9876: note = derived and/or modified CDS sequence (opt3) from DENV-2__KM279607__SS-prME
  source 1..9876: mol_type = other RNA
accgccggaatcattataatgatgatccccaccgtgatggctttccacctgactacgagaaatggggaacctcatatgattgtcagcaggcaggaaaagggaaaatccctcctttttaagaccgaaaatggtgttaatatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgtggcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtatttgcagcgcgtgctcatttttatcctgctgactgcagttacaccatctatggccatgagatgcataggcatttcgaacagggacttcgtggaaggggtctcaggaggtagctgggtggatatcgtactcgagcacggcagttgtgttaccactatggctaaaaataagcccacattagactttgaactgattaagaccgaggccaaacaccctgcgacgcttcggaagtactgcgtggaagcaaaattgaccaacacaactaccgcctcccgctgtccaacacagggggagccctctctgaatgaggaacaagataagcgattcgtctgcaaacatagcatggtggacagaggatggggcaacggttgtgggctatttggaaagggcggcatcgtgacttgcgctatgttcacatgcaagaaaaatatggaggggaaggtcgttcagcctgaaaacctcgagtatacaatcgtgattaccccacactccggagaagagaatgccgtaggtaacgatactggcaaacatgggaaggagataaaagtgacgccgcagtcaagtatcacagaagcagagctgaccggatacggcactgtcaccatggaatgtagccccaggacaggtcttgactttaatgagatggtgctgttgcagatggaaaacaaggcttggctcgttcaccggcaatggttcctggatttacctctgccatggctccccggggccgacacccagggctctaactggattcagaaagagactcttgtgacatttaagaatcctcacgcgaagaaacaggatgtcgtggtactgggatcccaagagggcgccatgcatacggcattgaccggggctactgaaatccagatgtcaagcggaaacctactgttcacaggtcacctcaagtgccgtctgcgcatggacaaacttcagctgaagggcatgagttattctatgtgtaccgggaaatttaaggttgtgaaggagatagccgaaacacaacatggaactattgtcatcagagtgcagtacgagggcgacggttccccatgcaaaatccccttcgagattatggatttggaaaagaggcacgtcctcgggcggctgatcaccgtgaatccgattgttacggagaaagacaaccctgtgaatatagaagctgagcccccattcggcgatagctacatcattatcggagtagaacctggccagttaaagctgtcgtggtataaaaaggggtcttccatcggacagatgtttgagaccacaatgcgaggtgccaagcgcatggcaattctaggcgacactgcctgggatttcgggtcactcggaggcgtctttaccagtataggtaaagctctgcatcaagtgttcggggcgatctacggcgcagcctttagcggagtttcctggacaatgaagattcttatcggcgtggtcattacttggatcgggatgaactctagaagcacctcattgagtgtgtccctggtactcgtgggagttgtcacgctgtatcttggcgtgatggtgcaggctgacagcggttgtgtcgtttcttggaaaaataaggagctgaaatgcgggtcaggaatattcatcacagataacgtgcacacctggactgaacagtacaagtttcagcccgagagtccaagcaagttggcctccgcaattcaaaaagcccacgaagagggcatctgtggtattaggtctgtgacacggctcgaaaatctgatgtggaagcagatcacccccgagttaaaccatatactgactgagaatgaagtaaaactaaccattatgacaggcgacatcaaggggattatgcaggctggaaaacgctcgctcagacctcagccaacggagctgaagtatagctggaaagcctggggcaaggcaaagatgctttccaccgaattgcacaaccatactttcctgatcgatgggccggagacagcggaatgccccaataccaacagggcttggaactcactcgaggtcgaggactacggatttggcgtgttcacaactaacatatggctgaaattaaaggaacgtcaagatgtattttgtgacagtaaactgatgtctgccgcaatcaaggacaaccgggccgtgcacgctgatatgggttattggattgagagcgcccttaatgacacctggaaaatcgaaaaggcatccttcattgaggtcaagtcatgccactggcctaaaagccatacgttgtggtctaacggggtgctcgagtccgaaatgatcataccaaagaattttgctggacccgttagtcagcacaactaccgacctggctaccatacacagaccgccggtccatggcacctgggcagactagagatggatttcgacttctgtgaagggactaccgtggtagtcacagaggattgcggaaataggggccccagcctgcgcactaccacagcgtctgggaaactcattacggaatggtgctgtcggtcctgcaccctgccgcctcttagatataggggagaggacggctgttggtacggtatggagatccgcccattgaaggaaaaagaggaaaacctggtaaattcattagtgactgccgggcatggacagatcgataactttagtctcggcgtcctgggtatggctcttttcctggaggaaatgttgcgaacacgggttggcaccaagcacgcaattctcctggtggccgttagctttgtgactctaatcacagggaatatgtcgttccgtgacctgggaagagtcatggtgatggttggcgctaccatgacggatgacattgggatgggagtgacttatctcgccctgcttgcagcgtttaaggtcaggcccaccttcgccgctggcttgctgttacgcaaactcacatccaaggagctgatgatgaccactataggtatcgtgcttctgtctcaaagcacaattcctgagtcaatcctagaactcaccgatgccctggcattggggatgatggttctgaaaattgtgcggaacatggagaagtaccagttagctgtcacaatcatggccatactctgcgtacccaatgcagtgatcctggaaaacgcctggaaagttagttgtactacccttgctgtggtctccgtgtctccactgttgctcacgagctcccagcaaaaggcggactggattcctctggccctaacaatcaagggactgaatcccaccgcaatttttcttactaccctctcaagaacaagcaaaaagaggagttggccactgaacgaggctatcatggccgtaggcatggtgtctatattggcctccagcctgctaaagaatgatattccgatgactggccctctcgtcgctgggggactgcttaccgtttgctatgtgctgacgggtcgatcggcagacttggaactcgagcgcgccgcggacgtgcggtgggaggaacaggctgagatctcaggctctagtcccatcctgtccattacaataagcgaagatgggtctatgagcatcaagaacgaggaggaagaacagaccctaactattctgatcagaacaggacttctcgtcatttccggcctgttcccagtgtcaatccccataaccgccgcagcctggtacttgtgggaagttaaaaagcagagggctggtgtattatgggacgtgcctagtccaccccctgtcgggaaagcagagctggaagatggagcctatcgtatcaagcaaaagggcattctcggctacagccagatcggggcgggagtgtacaaagagggtacttttcacacaatgtggcatgttacccgcggcgctgtgctgatgcacaaggggaaacggattgagccgtcttgggccgacgtcaagaaagatcttatctcctatggaggcggttggaagctggaaggggagtggaaggaaggagaggaagtgcaggtattggcactagagccaggcaaaaaccccagagccgtccagacgaagcctggcctgttcaaaactaataccgggacaataggagctgtgtcactcgactttagtccaggtaccagcggctcccccattgttgataagaaagggaaggtggtcggactgtacggcaacggtgtggttacaaggtctgggacttatgtgtcggccatcgcacaaaccgaaaagagcatcgaagacaatcctgagattgaagatgacatcttccggaaaaagagacttacgataatggatttacatccgggagctggcaaaacaaagcgctacctgcccgccattgtcagagaggcgatcaaaaggggcctccggactttgattctggccccaacccgagtggtagcagctgaaatggaggaggccctcagagggctgcctatccgctatcagacacccgctataagggcagaacacaccggacgtgagattgtggaccttatgtgtcatgccacttttaccatgcggctgttgtcaccaatcagagttcctaactacaatctaatcattatggatgaagcccacttcacagaccccgcttccatcgcggcaaggggttatattagtacgcgcgtcgagatgggcgaggccgctgggatattcatgactgccaccccaccgggatctcgagacccttttccccagagcaacgcaccaatcatggatgaagagagagaaattcccgagcggtcctggaactcaggccacgaatgggtgacagacttcaagggtaagaccgtgtggtttgtcccttctatcaaagccgggaacgatatcgctgcgtgcctgaggaagaatggcaaaaaggtaattcagctcagccgcaaaactttcgacagtgagtacataaagacacgtaccaacgattgggactttgtggttacgactgatatctccgagatgggcgccaatttcaaggcagaaagagtgattgacccacggaggtgtatgaaacccgtcatcttaacagatggcgaggaacgcgtgattctggctgggcctatgccggttacccatagctctgccgcacaacgaagaggacgggtgggtaggaacccaaagaatgagaacgaccagtacatctatatgggcgaaccccttgagaatgatgaggactgcgcccactggaaagaagctaagatgctgctcgacaacataaacacccctgaggggatcattccctcaatgtttgaaccagagcgcgaaaaagtcgatgccatcgacggagagtacagattgaggggcgaggcgcggaagactttcgtggatctgatgcgtcgcggtgacctccctgtatggctggcatataaagtggccgctgaagggattaattacgccgatcgaagatggtgttttgacggcgttaagaacaatcagatccttgaggaaaacgtcgaggtggagatatggacaaaggaaggagagaggaaaaagctaaaaccccggtggctggatgctcgcatttattccgacccattggcattaaaggagttcaaagagtttgccgctggcagaaagagtctgaccctcaatctgatcacagaaatggggaggcttcctactttcatgacgcaaaaggccaaaaacgcactggataatctcgcggtgttgcataccgccgaggctggaggtcgggcctacaaccacgcactgagcgagctaccggaaacactggagactctccttctgttaaccttgctggctacagtcaccggcgggattttcctctttctgatgtcgggaaagggcatcggtaaaatgactcttgggatgtgctgcataatcacggcctctattctgctctggtatgcacagatccagccccactggattgccgcttccatcatattggagttctttctgattgttttactaatcccagagcctgaaaagcagcgaacaccccaagacaatcagctgacatacgtggtaatcgcgattctcactgtggtcgccgcaaccatggctaacgagatgggcttccttgagaaaacaaagaaggattttggactgggcagcatcaccactcagcagccagaatcaaatatattggacattgatctgagacctgccagtgcctggacactctacgcagtggctacgaccttcatcactcccatgctgcgccattctattgagaactccagcgttaatgtgtcacttacagccatcgcgaaccaagctaccgtcctcatggggctgggaaaaggttggccgttgagtaagatggacataggcgtaccactgttagccatcgggtgttatagccaggtgaatcctattaccctaacagcagccctgctccttctggttgctcactacgcaatcattggacccggcttgcaggccaaagcgactagggaagctcagaagcgggccgcagccggtatcatgaaaaacccaacggtggacgggattaccgtcatcgatctggaccccataccttatgatccgaagtttgagaagcaactcggccaggtgatgctgcttgtcttatgcgtgacacaggttctgatgatgcgtactacctgggctctctgtgaagccttgacactggcaaccggacccatttccactctatgggagggcaatccagggagattctggaacacgacaatcgctgtgtctatggccaacatctttaggggaagctacctggcgggcgccggtctccttttctccattatgaaaaataccgcaaacactcgccgggggaccggaaatacaggcgagactctgggtgaaaagtggaaaaaccgattgaatgctctgggcaagtcagagtttcagatatataaaaagtctgggatccaagaagtagacagaaccctcgccaaagagggaattaagaggggcgagacagatcatcacgcagtgagtcgcgggtcggctaagctgcggtggttcgtcgaaagaaacttagttacgcctgagggaaaagtggtcgaccttggctgcggtcgtgggggatggagctactattgtggcggtctgaagaatgtgaaagaagtaaagggcctcaccaaagggggacccggccatgaggaacctatcccaatgtccacttacgggtggaacctagtgaggctgcagtctggagttgatgtgtttttcacaccccctgagaagtgcgacaccttgctgtgtgatattggcgagtcaagcccaaatcccactgtcgaagccggtcggacactccgcgtgcttaacctggtcgagaattggttgaacaataacacccagttctgcatcaaggtgctgaatccgtacatgccttccgttatagagaaaatggaggccctccaacgaaagtatgggggagcgttagtaagaaacccactgagtaggaactctacgcacgaaatgtactgggtgagcaatgcttcaggcaacatcgtctccagtgtgaatatgattagccggatgcttatcaaccgctttaccatgagacacaaaaaggcaacatatgagcccgacgttgatctgggctctgggactaggaatattggaatcgagtccgaaacccctaacctagacataattggtaaacgaatcgagaagatcaagcaggaacatgagacatcatggcactacgatcaggaccatccatataaaacttgggcctaccacggcagctatgaaaccaagcagacagggtcggcttctagtatggtgaatggagtcgtgaaactcctgaccaagccctgggacgtaattccgatggtgactcaaatggccatgacggatacaacccctttcggccagcagcgggtttttaaagagaaggtcgacactcgtacccaggagcccaaggaaggtaccaaaaagttgatgaaaataacggcagagtggctgtggaaggaactcgggaaaaagaaaaccccaagaatgtgtactcgcgaggagttcacaaggaaggtgcggtccaacgccgctcttggagcgatctttaccgatgaaaataagtggaaaagcgccagagaggcagtggaagactcaggcttctgggagctggtcgataaggaacgcaacttacacctggagggcaaatgcgagacttgtgtttacaatatgatggggaagagggagaaaaagttgggagagtttggtaaggctaaaggctcccgagccatttggtacatgtggctcggggcacggttcctggaatttgaggccctaggattccttaacgaagaccattggttttctagagagaatagcctgagtggcgtggagggtgaagggctccacaagctgggatatatcttgagggatgtatccaaaaaggagggcggcgctatgtacgccgacgatacagcggggtgggacacccgcattacactggaagatctcaaaaacgaggaaatggtgactaatcatatggagggagagcacaagaaacttgcagaagccatcttcaaactgacctatcaaaacaaggtcgtgcgtgttcagcggcctacgcccagaggtaccgtgatggacataatcagcaggcgcgaccagcgaggctctgggcaggtcgtgacatacggattaaacacttttaccaatatggaggctcaactgattcggcagatggaaggcgagggtgtattcaaatcaatccagcaattgacagttaaggaggaaattgccgtgaaaaactggctcatcagagtcgggagggagcgcctgagtagaatggcaatttccggagatgactgcgtggtgaagccactagatgaccggttcgctagcgcccttactgctctgaatgatatgggcaaggtcaggaaagacatacagcagtgggaaccctctcgtggctggaacgattggacccaggttcctttttgctcgcatcacttccacgagctcatcatgaaggacgggcgagtgctggtagtgccatgtcgcaatcaagatgaattgattggacgagcccggatctcacagggtgcaggctggagcttaagggagacggcgtgcctggggaaatcctatgcccagatgtggagtctcatgtactttcatcgcagagaccttcggctggctgccaacgcaatctgttctgctgtcccgagccactgggtgcccacatccaggaccacttggtcaattcatgccacacacgagtggatgaccactgaagatatgctaaccgtttggaatcgagtgtggatacaggagaacccttggatggaagacaagacaccagtcgagagttgggaagagatcccctatctgggaaaacgtgaggatcaatggtgcggctctctcattggtttgacgagcagagcaacctgggccaagaatatccagactgcgattaaccaggtgcgctccctgatcgggaatgaagagtacacagactacatgccttcaatgaagcggttcaggagagaagaggaagaggctggagtactttggtga

SEQ ID NO: 14973 - RNA, 9876 nt, synthetic construct
  misc_feature 1..9876: note = derived and/or modified CDS sequence (opt3) from DENV-2__KM279606__SS-prME
  source 1..9876: mol_type = other RNA
accgccggaatcattataatgatgatccccaccgtgatggctttccacctgactacgcgaaatggggagcctcatatgattgtaagcaggcaggaaaaggggaagtccctcctttttaagaccgagaatggtgttaatatgtgcactctgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtggcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacaccctgcgacgctgcggaagtactgcgtggaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaaggtcgttcagcctgaaaacctagagtatacaatcgtgattaccccacactccggagaagagaatgccgtaggtaacgatactggcaaacatgggaaggagataaaagtgacgccgcagtcaagtatcacagaagcagagctcaccggatacggcactgtcaccatggaatgtagccccaggacaggtctggacttcaatgagatggtgcttctgcagatggaaaacaaggcttggttggttcaccggcaatggtttctcgatctgcctttaccatggctgcccggggccgacacccagggctctaactggattcagaaagagactctcgtgacattcaagaatcctcacgcgaagaaacaggatgtcgtggtacttggatcccaagagggcgccatgcatacggcactgaccggggctactgaaatccagatgtcaagcggaaacttgctatttacaggtcacctgaagtgccgtctccgcatggacaaactgcagcttaagggcatgagttattctatgtgtaccgggaaattcaaggttgtgaaggagatagccgaaacacaacatggaactattgtcatcagagtgcagtacgagggcgacggttccccatgcaaaatccccttcgagattatggatctggaaaagaggcacgtcttggggcggctcatcaccgtgaatccgattgttacggagaaagacaaccctgtgaatatagaagctgagcccccatttggcgatagctacatcattatcggagtagaacctggccagctgaagttatcgtggtataaaaaggggtcttccatcggacagatgttcgagaccacaatgcgaggtgccaagcgcatggcaattctgggcgacactgcctgggattttgggtcactaggaggcgtcttcaccagtataggtaaagctctccatcaagtgtttggggcgatctacggcgcagccttcagcggagtttcctggacaatgaagattctgatcggcgtggtcattacttggatcgggatgaactctagaagcacctcacttagtgtgtccttggtactggtgggagttgtcacgctctatctgggcgtgatggtgcaggctgacagcggttgtgtcgtttcttggaaaaataaggagcttaaatgcgggtcaggaatatttatcacagataacgtgcacacctggactgaacagtacaagttccagcccgagagtccaagcaagctggcctccgcaattcaaaaagcccacgaagagggcatctgtggtattaggtctgtgacacggttggaaaatctcatgtggaagcagatcacccccgagctgaaccatatattaactgagaatgaagtaaaactgaccattatgacaggcgacatcaaggggattatgcaggctggaaaacgctcgctaagacctcagccaacggagctcaagtatagctggaaagcctggggcaaggcaaagatgctgtccaccgaacttcacaaccatacatttttgatcgatgggccggagacagcggaatgccccaataccaacagggcttggaactcactggaggtcgaggactacggattcggcgtgtttacaactaacatatggctcaaactgaaggaacgtcaagatgttttctgtgacagtaaattaatgtctgccgcaatcaaggacaaccgggccgtgcacgctgatatgggttattggattgagagcgccctgaatgacacctggaaaatcgaaaaggcatcctttattgaggtcaagtcatgccactggcctaaaagccatacgctttggtctaacggggtgttggagtccgaaatgatcataccaaagaatttcgctggacccgttagtcagcacaactaccgacctggctaccatacacagaccgccggtccatggcacctcggcagactggagatggatttcgacttttgtgaagggactaccgtggtagtcacagaggattgcggaaataggggccccagcctacgcactaccacagcgtctgggaaactgattacggaatggtgctgtcggtcctgcaccctcccgcctctgagatataggggagaggacggctgttggtacggtatggagatccgcccacttaaggaaaaagaggaaaacttggtaaattcactggtgactgccgggcatggacagatcgataacttcagtttaggcgtcctcggtatggctctgtttcttgaggaaatgctgcgaacacgggttggcaccaagcacgcaattttgctcgtggccgtcagcttcgtgactctgatcacagggaatatgtcgtttcgtgacctaggaagagtcatggtgatggttggcgctaccatgacggatgacattgggatgggagtgacttatctggccctcctggcagcgttcaaggtcaggcccacctttgccgctggccttttgctgcgcaaattaacatccaaggagctcatgatgaccactataggtatcgtgctgctttctcaaagcacaattcctgagtcaatcctggaactaaccgatgccctcgcactggggatgatggttttgaaaattgtgcggaacatggagaagtaccagctggctgtcacaatcatggccatattatgcgtacccaatgcagtgatcctcgaaaacgcctggaaagttagttgtactaccctggctgtggtctccgtgtctccacttctgttgacgagctcccagcaaaaggcggactggattcctctcgccctgacaatcaagggactaaatcccaccgcaattttcctgactaccctttcaagaacaagcaaaaagaggagttggccactcaacgaggctatcatggccgtaggcatggtgtctatactggcctccagcttgctgaaaaatgatattccgatgactggccctttagtcgctgggggactcctgaccgtttgctatgtgcttacgggtcgatcggcagacctggaattggagcgcgccgcggacgtgcggtgggaggaacaggctgagatctcaggctctagtcccatcctctccattacaataagcgaagatgggtctatgagcatcaagaacgaggaggaagaacagaccctgactattctaatcagaacaggactgcttgtcatttccggcctctttccagtgtcaatccccataaccgccgcagcctggtacctgtgggaagttaaaaagcagagggctggtgtattgtgggacgtgcctagtccaccccctgtcgggaaagcagagttagaagatggagcctatcgtatcaagcaaaagggcattctgggctacagccagatcggggcgggagtgtacaaagagggtactttccacacaatgtggcatgttacccgcggcgctgtgctcatgcacaaggggaaacggattgagccgtcttgggccgacgtcaagaaagatctgatctcctatggaggcggttggaaacttgaaggggagtggaaggaaggagaggaagtgcaggtactggcattggagccaggcaaaaaccccagagccgtccagacgaagcctggcctatttaaaactaataccgggacaataggagctgtgtcactggacttcagtccaggtaccagcggctcccccattgttgataagaaagggaaggtggtcggactctacggcaacggtgtggttacaaggtctgggacttatgtgtcggccatcgcacaaaccgaaaagagcatcgaagacaatcctgagattgaagatgacatctttagaaagaagcggctgacgataatggatcttcatccgggagctggcaaaacaaagcgctacttacccgccattgtcagagaggcgatcaaaaggggcctgcggactctcattttggccccaacccgagtggtagcagctgaaatggaggaggccctgagagggctccctatccgctatcagacacccgctataagggcagaacacaccggacgtgagattgtggacctgatgtgtcatgccactttcaccatgcggcttctgtcaccaatcagagttcctaactacaatttgatcattatggatgaagcccacttcacagaccccgcttccatcgcggcaaggggttatattagtacgcgcgtcgagatgggcgaggccgctgggatatttatgactgccaccccaccgggatctcgagaccctttcccccagagcaacgcaccaatcatggatgaagagagagaaattcccgagcggtcctggaactcaggccacgaatgggtgacagactttaagggtaagaccgtgtggttcgtcccttctatcaaagccgggaacgatatcgctgcgtgcctaaggaagaatggcaagaaggtaattcagctgagccgcaaaacttttgacagtgagtacataaagacacgtaccaacgattgggacttcgtggttacgactgatatctccgagatgggcgccaattttaaggcagaaagagtgattgacccacggaggtgtatgaaacccgtcatcctcacagatggcgaggaacgcgtgattttagctgggcctatgccggttacccatagctctgccgcacaacgaagaggacgggtgggtaggaacccaaagaatgagaacgaccagtacatctatatgggcgaacccctggagaatgatgaggactgcgcccactggaaagaagctaagatgcttctggacaacataaacacccctgaggggatcattccctcaatgttcgaaccagagcgcgaaaaagtcgatgccatcgacggagagtacagactcaggggcgaggcgcggaagacttttgtggatttgatgcgtcgcggtgacctgcctgtatggctcgcatataaagtggccgctgaagggattaattacgccgatcgaagatggtgtttcgacggcgttaagaacaatcagatcctggaggaaaacgtcgaggtggagatatggacaaaggaaggagagaggaagaaacttaaaccccggtggctagatgctcgcatttattccgacccactggcattgaaagaatttaaagagttcgccgctggcagaaagagtttaaccctgaatctcatcacagaaatggggaggctgcctactttcatgacgcaaaaggccaaaaacgcacttgataatctggcggtgctccataccgccgaggctggaggtcgggcctacaaccacgcattgagcgagctgccggaaacactagagactctgctccttctgaccttattggctacagtcaccggcgggatttttctgttcctcatgtcgggaaagggcatcggtaaaatgactctggggatgtgctgcataatcacggcctctattcttctgtggtatgcacagatccagccccactggattgccgcttccatcatactcgaatttttcttgattgttctgttaatcccagagcctgaaaagcagcgaacaccccaagacaatcagctaacatacgtggtaatcgcgattctgactgtggtcgccgcaaccatggctaacgagatgggctttctcgagaaaacaaagaaggatttcggacttggcagcatcaccactcagcagccagaatcaaatatactggacattgatttgagacctgccagtgcctggacactgtacgcagtggctacgacctttatcactcccatgctccgccattctattgagaactccagcgttaatgtgtcactgacagccatcgcgaaccaagctaccgtccttatggggctcggaaaaggttggccgctgagtaagatggacataggcgtaccattgctggccatcgggtgttatagccaggtgaatcctattaccttaacagcagccctactgctccttgttgctcactacgcaatcattggacccggcctgcaggccaaagcgactagggaagctcagaagcgggccgcagccggtatcatgaaaaacccaacggtggacgggattaccgtcatcgatttggaccccataccttatgatccgaagttcgagaagcaactgggccaggtgatgctcctggtcctttgcgtgacacaggttttaatgatgcgtactacctgggctctgtgtgaagccctcacattggcaaccggacccatttccactctgtgggagggcaatccagggagattttggaacacgacaatcgctgtgtctatggccaacatcttcaggggaagctacctagcgggcgccggtctgctcttttccattatgaaaaataccgcaaacactcgccgggggaccggaaatacaggcgagactcttggtgaaaagtggaaaaaccgactgaatgctttgggcaagtcagagttccagatatataaaaagtctgggatccaagaagtagacagaaccctggccaaagagggaattaagaggggcgagacagatcatcacgcagtgagtcgcgggtcggctaagctccggtggtttgtcgaaagaaacctggttacgcctgagggaaaagtggtcgacttaggctgcggtcgtgggggatggagctactattgtggcggtcttaagaatgtgaaagaagtaaagggcctgaccaaagggggacccggccatgaggaacctatcccaatgtccacttacgggtggaacctcgtgaggctacagtctggagttgatgtgttcttcacaccccctgagaagtgcgacaccctgttgtgtgatattggcgagtcaagcccaaatcccactgtcgaagccggtcggacactgcgcgtgctcaaccttgccgagaattggctgaacaataacacccagttttgcatcaaggtcttgaatccgtacatgccttccgtgatagagaagatggaggcgctgcaacgaaagtatgggggagctctcgttagaaacccattaagtaggaactctacgcacgaaatgtactgggtaagcaatgcatcaggcaacatcgtgtccagtgtcaatatgattagccggatgctgatcaaccgcttcaccatgagacacaaaaaggccacatatgagcccgacgtggatcttggctctgggactaggaatattggaatcgagtccgaaacccctaacctggacataattggtaaacgaatcgagaagatcaagcaggaacatgagacatcatggcactacgatcaggaccatccatataaaacttgggcttaccacggcagctatgaaaccaagcagacagggtcggcctctagtatggttaatggagtggtccggctactcaccaaaccctgggacgtgattccgatggtaactcaaatggcaatgacggatacaaccccttttggccagcagcgtgtgttcaaggagaaagttgacactagaacccaggagcccaaggaaggtacaaagaaactgatgaagataacggccgagtggttgtggaaagaactggggaagaaaaagaccccacgcatgtgtactagggaggagtttacacggaaagtcagatccaacgctgcgctcggagccatcttcaccgatgaaaataagtggaaaagcgcacgcgaggctgtggaagactcaggcttttgggagcttgtggataaagaaaggaacctgcacttagagggcaagtgcgagacttgtgtctacaatatgatggggaaacgagaaaagaaactgggagagttcggtaaggccaagggctcccgggcaatttggtacatgtggttgggggccagatttctcgagttcgaggctctgggatttctaaacgaagaccattggttctctagggagaatagccttagtggcgttgagggtgaagggctgcacaaactcggatatatcctgcgcgatgtgtccaagaaagagggcggcgccatgtacgcggacgatacagcagggtgggacacccgtattacattggaagatctgaagaacgaggaaatggtaactaatcatatggagggagagcacaaaaagctcgccgaagctatctttaaacttacctatcaaaacaaagtggtccgggtgcagagacctacgcccaggggtaccgttatggacataatcagccgccgagaccagcggggctctggacaggtggtcacatacggactgaacactttcaccaatatggaggcccaattaattagacagatggaaggcgagggtgtgttcaagtcaatccagcaactgacagtaaaagaggaaattgcagttaagaactggttgatcagggtggggcgcgagagactcagtcggatggctatttccggagatgactgcgtcgtgaaaccactggatgacaggtttgccagcgctctaactgcccttaatgatatgggcaaggtgcgtaaggacatacagcagtgggaaccctctcgaggctggaacgattggacccaggtccctttctgctcgcatcactttcacgagctgatcatgaaagacgggcgcgttctcgtggtaccatgtagaaatcaagatgaactgattggacgggcaaggatctcacagggtgcgggctggagcttgcgcgagacggcctgcttagggaagtcctatgctcagatgtggagtctgatgtacttccatagacgggacctcaggcttgccgcaaacgctatctgttctgccgtgccgagccactgggtccccacatcccgaaccacttggtcaattcatgcaacacacgagtggatgaccactgaagatatgctgaccgtgtggaatcgtgtttggatacaggagaacccttggatggaagacaaaacaccagtggagagttgggaagagatcccctatctaggaaagagagaggatcaatggtgcggctctctgattggtctcacgagccgcgccacctgggcgaaaaatatccagactgctattaaccaggtccggtccttgatcgggaatgaagagtacacagactacatgccttcaatgaagaggtttagacgcgaagaggaagaggccggagtgctgtggtga

SEQ ID NO: 14974 - RNA, 9876 nt, synthetic construct
  misc_feature 1..9876: note = derived and/or modified CDS sequence (opt3) from DENV-2__JN851113__SS-prME
  source 1..9876: mol_type = other RNA
accgccggaatcattataatgatgatccccacagtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgttgcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgaggtgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacaccctgcgacgctgcggaagtactgcgtggaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaaggtcgttcagcctgaaaacctagagtatacaatcgtgattaccccacactccggagaagagaatgccgtaggtaacgatactggcaaacatgggaaggagataaaagtgacgccgcagtcaagtatcacagaagcagagctcaccggatacggcactgtcaccatggaatgtagccccaggacaggtctggacttcaatgagatggtgcttctgcagatggaaaacaaggcttggttggttcaccggcaatggtttctcgatctgcctttaccatggctgcccggggccgacacccagggctctaactggattcagaaagagactctcgtgacattcaagaatcctcacgcgaagaaacaggatgtcgtggtacttggatcccaagagggcgccatgcatacggcactgaccggggctactgaaatccagatgtcaagcggaaacttgctatttacaggtcacctgaagtgccgtctccgcatggacaaactgcagcttaagggcatgagttattctatgtgtaccgggaaattcaaggttgtgaaggagatagccgaaacacaacatggaactattgtcatcagagtgcagtacgagggcgacggttccccatgcaaaatccccttcgagattatggatctggaaaagaggcacgtcttggggcggctcatcaccgtgaatccgattgttacggagaaagacagccctgtgaacatagaagctgagcccccatttggcgattcgtacatcattatcggagtagaacctggccagctgaagttatcttggttcaaaaaggggtcctcaatcggacagatgtttgagaccacaatgcgaggtgccaagcgcatggcaattctgggcgacactgcctgggatttcgggagtctaggaggcgtctttaccagcataggtaaagctctccatcaagtgttcggggcgatctatggcgcagccttttccggagtttcttggacaatgaagattctgatcggcgtggtcattacttggatcgggatgaatagcagatcaaccagtctttccgtgagcttggtactggtgggagttgtcacgctctacctgggcgtgatggtgcaggctgactctggttgtgtcgtttcatggaaaaacaaggagcttaaatgcgggagtggaatattcatcacagataatgtgcacacctggactgaacagtataagtttcagcccgagagcccatccaagctggcctctgcaattcaaaaagcccacgaagagggcatctgtggtattaggtcggtgacacggttggaaaacctcatgtggaagcagatcacccccgagctgaatcatatattaactgagaacgaagtaaaactgaccattatgacaggcgacatcaaggggattatgcaggctggaaaacgcagcctaagacctcagccaacggagctcaagtactcctggaaagcctggggcaaggcaaagatgctgtcaaccgaacttcacaatcatactttcttgatcgatgggccggagacagcggaatgccccaacaccaatagggcttggaacagtctggaggtcgaggactatggatttggcgtgttcacaactaatatatggctcaaactgaaggaacgtcaagatgtattttgtgactctaaattaatgagcgccgcaatcaaggacaaccgggccgtgcacgctgatatgggttactggattgagtccgccctgaacgacacctggaaaatcgaaaaggcatcattcattgaggtcaagagctgccactggcctaaatctcatacgctttggtccaatggggtgttggagagtgaaatgatcataccaaagaacttcgctggacccgttagccagcacaattatcgacctggctaccatacacagaccgccggtccatggcacctcggcagactggagatggattttgacttctgtgaagggactaccgtggtagtcacagaggattgcggaaacaggggcccctctctacgcactaccacagcgtccgggaaactgattacggaatggtgctgtcggtcatgcaccctcccgcctctgagatacaggggagaggacggctgttggtatggtatggagatccgcccacttaaggaaaaagaggaaaatttggtgaacagtctggtgactgccgggcatggacagatcgataattttagcttaggcgtcctcggtatggctctgttccttgaggaaatgctgcgaacacgggttggcaccaagcacgcaattttgctcgtggccgtatcgtttgtgactctgatcacagggaacatgtccttccgtgacctaggaagagtcatggtgatggttggcgctaccatgacggatgacattgggatgggagtgacttacctggccctcctggcagcgtttaaggtcaggcccaccttcgccgctggccttttgctgcgcaaattaacatctaaggagctcatgatgaccactataggtatcgtgctgcttagccaatcaacaattcctgagagtatcctggaactaaccgatgccctcgcactggggatgatggttttgaaaattgtgcggaatatggagaagtatcagctggctgtcacaatcatggccatattatgcgtacccaacgcagtgatcctccagaatgcctggaaagtttcctgtactaccctggctgtggtctctgtgagcccacttctgttgacgtcctcacaacagaaggcggactggattcctctcgccctgacaatcaagggactaaaccccaccgcaatttttctgactacccttagcagaacaagtaaaaagaggtcttggccactcaatgaagctatcatggccgtaggcatggtgtccatactggccagctcgttgctgaaaaacgatattccgatgactggccctttagtcgctgggggactcctgaccgtttgctacgtgcttacgggtcgatcagcagacctggagttggaacgcgccgcggacgtgcggtgggaggagcaggctgaaatctctggcagttcccccatcctcagcattacaatatctgaggatgggagcatgtccatcaagaatgaagaggaggaacagaccctgactattctaatcagaacaggactgcttgtcatttcaggcctcttcccagtgagtatccccataaccgccgcagcctggtatctgtgggaggttaaaaagcaaagggctggtgtattgtgggacgtgcctagcccaccccctgtcgggaaagcagaattagaggatggagcctaccgtatcaagcagaagggcattctgggctattctcagatcggggcgggagtgtacaaagaaggtacttttcacacaatgtggcatgttacccgcggcgctgtgctcatgcacaaggggaaacggattgagccgtcctgggccgacgtcaagaaagatctgatctcatacggaggcggttggaaacttgagggggaatggaaggagggagaagaggtgcaggtactggcattggaaccaggcaaaaaccccagagccgtccaaacgaagcctggcctattcaaaactaacaccgggacaataggagctgtgagtctggactttagcccaggtacctccggctctcccattgttgataagaaagggaaggtggtcggactctatggcaatggtgtggttacaaggtcggggacttacgtgagcgccatcgcacagaccgagaagtcaatcgaggacaaccctgaaattgaggatgacatcttcagaaagaaacggctgacgataatggatcttcatccgggagctggcaaaacaaagcgctatttacccgccattgtcagagaagcgatcaaaaggggcctgcggactctcattttggccccaacccgagtggtagcagctgagatggaagaggccctgagagggctccctatccgctaccagacacccgctataagggcagagcacaccggacgtgaaattgtggacctgatgtgtcatgccactttcaccatgcggcttctgtccccaatcagagttcctaattataacttgatcattatggatgaggcccactttacagaccccgctagtatcgcggcaaggggttacatttctacgcgcgtcgaaatgggcgaggccgctgggatattcatgactgccaccccaccgggaagccgagacccttttccccagtccaatgcaccaatcatggatgaggaaagagagattcccgaacggtcatggaactctggccacgagtgggtgacagacttcaagggtaagaccgtgtggtttgtccctagcatcaaagccgggaatgatatcgctgcgtgcctaaggaagaacggcaagaaggtaattcaactgagtcgcaaaactttcgactccgaatatataaagacacgtaccaatgattgggactttgtggttacgactgatatcagcgagatgggcgccaacttcaaggcagagagagtgattgacccacggaggtgtatgaaacccgtcatcctcacagatggcgaagaacgcgtgattttagctgggcctatgccggttacccattcttcagccgcacagcgaagaggacgggtgggtaggaatccaaagaacgaaaatgaccagtacatctacatgggcgagcccctggaaaacgatgaggactgcgcccactggaaagaggctaagatgcttctggacaatataaacacccctgaagggatcattccctccatgtttgagccagaacgcgagaaagtcgatgccatcgacggagaatatagactcaggggcgaggcgcggaagactttcgtggatttgatgcgtcgcggtgacctgcctgtatggctcgcataccgagtggccgctgaggggattaactatgccgatagaaggtggtgttttgacggcgttaaaaataaccaaatcctggaagagaatgtcgaagtggagatatggacaaaggagggagaacggaagaaacttaagccccgctggctagatgctagaatttacagtgacccactggcattgaaagagttcaaggagttcgccgctggcaggaagtcgttaaccctgaacctcatcacagagatggggcggctgcctacttttatgacgcagaaggccaagaatgcacttgataacctggcggtgctccataccgccgaagctggaggtcgagcctataatcacgcattgagcgagctgccggagacactagaaactctgctccttctgaccttattggctacagtcaccggcgggattttcctgtttctcatgtctggaaaaggcatcggtaagatgactctggggatgtgctgcataatcacggcctccattcttctgtggtacgcacagatccagccccactggattgccgctagcatcatactcgagttctttttgattgttctgttaatcccagaacctgagaaacaaagaacaccccaggacaaccagctaacatatgtggtaatcgcgattctgactgtggtcgccgcaaccatggctaatgaaatgggcttcctcgagaagaccaagaaggattttggacttggctcaatcaccactcagcaaccagagagtaacatactggacattgatttgcgccctgcctctgcctggacactgtacgcagtggctacgaccttcatcactcccatgctcaggcattccattgaaaatagctcagttaacgtgagtctgacagccatcgcgaatcaggctaccgtccttatggggctcggaaagggttggccgctgagcaaaatggacataggcgtaccattgctggccatcgggtgttactcccaggtgaaccctattaccttaacagcagccctactgctccttgttgctcactatgcaatcattggacccggcctgcaggccaaggcgactcgggaggctcaaaaacgtgccgcagccggtatcatgaagaatccaacggtggacgggatgaccgtcattgatttggaccccatcccttacgatccgaaatttgaaaagcagctgggccaggtgatgctcctggtcctttgcgtgacacaggttttaatgatgagaactacctgggctctgtgtgaggccctcacattggcaaccggacccatatctactctgtgggaaggcaacccagggaggttctggaatacgacaattgctgtgagcatggccaacatctttcgcggatcctatctagcgggcgccggtctactcttctcaatcatgaagaacaccgcaaatactcggcgagggaccggaaacacaggcgagactcttggtgagaaatggaagaatagactgaacgctttgggcaaatctgaatttcaaatttacaagaaaagtgggatacaggaggtagacaggaccctggccaaggaaggaatcaaacgcggcgagacagatcatcacgcagtgtcgcgggggagcgctaagctcagatggttcgtcgagcgtaatctggttacgcctgaaggaaaggtggtcgacttaggctgcggtagagggggatggtcctattactgtggcggtcttaaaaacgtgaaggaggtaaaaggcctgaccaaagggggacccggccatgaagaacctattccaatgtctacttatgggtggaatctcgtgcggctacagtcaggagttgatgtgttctttacaccccctgaaaaatgcgacaccctgttgtgtgatatcggcgagagctccccaaaccccactgtcgaggccggtcgcacactgcgagtgctcaatcttgtcgaaaactggctgaataacaatacccaattctgcattaaggtgttgaacccgtacatgcctagtgttatcgagaagatggaagccctgcagagaaaatacgggggagcgctcgtaaggaatccattatctcggaacagcacgcacgagatgtattgggtgtcaaacgcttccggcaatatagtcagtagcgtgaacatgatctctcgcatgctgattaatagatttaccatgaggcacaagaaagcaacatacgaacccgacgttgatcttggctccgggactcgaaacatcggaattgagtcagagacccctaatctggacatcataggtaagcggattgagaaaatcaagcaggagcatgaaacaagctggcactatgatcaggaccatccatacaagacttgggcctatcacggctcgtacgagaccaaacaaacagggtctgctagttccatggtgaacggagtcgtgcgtctactcaccaagccctgggacgtaatcccgatggtgactcagatggccatgacggatacaacccctttcggccagcagagagtttttaaagaaaaggtcgacactcgcacccaagagcccaaagagggtacaaagaagctgatgaaaattacggcagaatggttgtggaaggagctggggaaaaagaaaaccccaaggatgtgtactcgggaagagttcacaagaaaggtgcgcagcaatgccgctctcggagcgatatttaccgatgagaacaaatggaagtcagccagggaagcagtggaggactccggcttctgggaacttgtcgataaggagcgaaatctgcacttagaaggcaaatgcgagacttgtgtttataacatgatggggaagcgggagaaaaagctgggagaatttggtaaagctaagggctctagagccatctggtacatgtggttgggggcaaggttcctcgagtttgaagccctgggattcctaaatgaggaccattggtttagccgcgaaaacagtctttccggcgtggagggtgaggggctgcacaagctcggatacattctgcgtgatgtaagcaaaaaggaaggcggcgctatgtatgccgacgatacagcggggtgggacacccggatcacattggaggatctgaaaaatgaagagatggtgactaaccatatggaaggagagcacaagaaactcgcagaggccattttcaaacttacctaccagaataaggtcgtgagagttcagaggcctacgccccgcggtaccgtgatggacatcatatctcgacgggaccagagaggctcagggcaagtcgtgacatatggactgaacactttcaccaacatggaagctcagttaatcaggcagatggagggcgaaggtgtatttaaaagtattcaacagctgacagttaaggaggagatcgccgtgaaaaattggttgattcgcgtcgggagagaacggctctccaggatggcaatcagcggagatgactgcgtggtgaagccactggatgaccgtttcgcttctgccctaactgctcttaacgatatgggcaaagtccgaaaggacattcagcagtgggagccctcgcgcggctggaatgattggacccaagttcctttttgctcacatcacttccacgaactgataatgaaggacgggagagtgctcgtagtgccatgtcggaaccaggatgagctgatcggaagggcccgcattagccagggtgcaggctggtccttgagagaaacggcgtgcttagggaaaagttacgcccagatgtggtctctgatgtattttcatcggagggacctccgacttgctgccaatgcaatctgtagcgctgtcccgtcccactgggtgcccacatcacgtaccacttggagtatccatgccacacacgagtggatgaccactgaggatatgctgaccgtttggaacagagtgtggattcaagaaaatccttggatggaggacaagacaccagtcgaatcttgggaggaaataccctacctaggaaaacgcgaggatcagtggtgcggcagcctgatcggtctcacgtcccgggcaacctgggccaagaacattcagactgcgatcaatcaggtgaggtcattgattgggaacgaggaatatacagactacatgcctagcatgaaaagattccgccgggaggaagaggaagctggagtactgtggtga

SEQ ID NO: 14975 - RNA, 9876 nt, synthetic construct
  misc_feature 1..9876: note = derived and/or modified CDS sequence (opt3) from DENV-2__GU370050__SS-prME
  source 1..9876: mol_type = other RNA
accgccggaatcattataatgatgatccccacagtgatggctttccacctgactacgcgaaacggggaacctcatatgattgtcagcaggcaggaaaagggaaaatccctcctttttaagaccgagaatggtgttaacatgtgcacactgatggcaatggacttgggcgaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgttgcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgaggtgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacaccctgcgacgctgcggaagtactgcgtggaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaaggtcgttcagcctgaaaacctagagtatacaatcgtgattaccccacactccggagaagagaatgccgtaggtaacgatactggcaaacatgggaaggagataaaagtgacgccgcagtcaagtatcacagaagcagagctcaccggatacggcactgtcaccatggaatgtagccccaggacaggtctggacttcaatgagatggtgcttctgcagatggaaaacaaggcttggttggttcaccggcaatggtttctcgatctgcctttaccatggctgcccggggccgacacccagggctctaactggattcagaaagagactctcgtgacattcaagaatcctcacgcgaagaaacaggatgtcgtggtacttggatcccaagagggcgccatgcatacggcactgaccggggctactgaaatccagatgtcaagcggaaacttgctatttacaggtcacctgaagtgccgtctccgcatggacaaactgcagcttaagggcatgagttattctatgtgtaccgggaaattcaaggttgtgaaggagatagccgaaacacaacatggaactattgtcatcagagtgcagtacgagggcgacggttccccatgcaaaatccccttcgagattatggatctggaaaagaggcacgtcttggggcggctcatcaccgtgaatccgattgttacggagaaagacagccctgtgaacatagaagctgagcccccatttggcgattcgtacatcattatcggagtagaacctggccagctgaagttatcttggttcaaaaaggggtcctcaatcggacagatgtttgagaccacaatgcgaggtgccaagcgcatggcaattctgggcgacactgcctgggatttcgggagtctaggaggcgtctttaccagcataggtaaagctctccatcaagtgttcggggcgatctatggcgcagccttttccggagtttcttggacaatgaagattctgatcggcgtggtcattacttggatcgggatgaatagcagatcaaccagtctttccgtgagcttggtactggtgggagttgtcacgctctacctgggcgtgatggtgcaggctgactctggttgtgtcgtttcatggaaaaacaaggagcttaaatgcgggagtggaatattcatcacagataatgtgcacacctggactgaacagtataagtttcagcccgagagcccatccaagctggcctctgcaattcaaaaagcccacgaagagggcatctgtggtattaggtcggtgacacggttggaaaacctcatgtggaagcagatcacccccgagctgaatcatatattaactgagaacgaagtaaaactgaccattatgacaggcgacatcaaggggattatgcaggctggaaaacgcagcctaagacctcagccaacggagctcaagtactcctggaaagcctggggcaaggcaaagatgctgtcaaccgaacttcacaatcatactttcttgatcgatgggccggagacagcggaatgccccaacaccaatagggcttggaacagtctggaggtcgaggactatggatttggcgtgttcacaactaatatatggctcaaactgaaggaacgtcaagatgtattttgtgactctaaattaatgagcgccgcaatcaaggacaaccgggccgtgcacgctgatatgggttactggattgagtccgccctgaacgacacctggaaaatcgaaaaggcatcattcattgaggtcaagagctgccactggcctaaatctcatacgctttggtccaatggggtgttggagagtgaaatgatcataccaaagaacttcgctggacccgttagccagcacaattatcgacctggctaccatacacagaccgccggtccatggcacctcggcagactggagatggattttgacttctgtgaagggactaccgtggtagtcacagaggattgcggaaacaggggcccctctctacgcactaccacagcgtccgggaaactgattacggaatggtgctgtcggtcatgcaccctcccgcctctgagatacaggggagaggacggctgttggtatggtatggagatccgcccacttaaggaaaaagaggaaaatttggtgaacagtctggtgactgccgggcatggacagatcgataattttagcttaggcgtcctcggtatggctctgttccttgaggaaatgctgcgaacacgggttggcaccaagcacgcaattttgctcgtggccgtatcgtttgtgactctgatcacagggaacatgtccttccgtgacctaggaagagtcatggtgatggttggcgctaccatgacggatgacattgggatgggagtgacttacctggccctcctggcagcgtttaaggtcaggcccaccttcgccgctggccttttgctgcgcaaattaacatctaaggagctcatgatgaccactataggtatcgtgctgcttagccaatcaacaattcctgagagtatcctggaactaaccgatgccctcgcactggggatgatggttttgaaaattgtgcggaatatggagaagtatcagctggctgtcacaatcatggccatattatgcgtacccaacgcagtgatcctccagaatgcctggaaagtttcctgtactaccctggctgtggtctctgtgagcccacttctgttgacgtcctcacaacagaaggcggactggattcctctcgccctgacaatcaagggactaaaccccaccgcaatttttctgactacccttagcagaacaagtaaaaagaggtcttggccactcaatgaagctatcatggccgtaggcatggtgtccatactggccagctcgttgctgaaaaacgatattccgatgactggccctttagtcgctgggggactcctgaccgtttgctacgtgcttacgggtcgatcagcagacctggagttggaacgcgccgcggacgtgcggtgggaggagcaggctgaaatctctggcagttcccccatcctcagcattacaatatctgaggatgggagcatgtccatcaagaatgaagaggaggaacagaccctgactattctaatcagaacaggactgcttgtcatttcaggcctcttcccagtgagtatccccataaccgccgcagcctggtatctgtgggaggttaaaaagcaaagggctggtgtattgtgggacgtgcctagcccaccccctgtcgggaaagcagaattagaggatggagcctaccgtatcaagcagaagggcattctgggctattctcagatcggggcgggagtgtacaaagaaggtacttttcacacaatgtggcatgttacccgcggcgctgtgctcatgcacaaggggaaacggattgagccgtcctgggccgacgtcaagaaagatctgatctcatacggaggcggttggaaacttgagggggaatggaaggagggagaagaggtgcaggtactggcattggaaccaggcaaaaaccccagagccgtccaaacgaagcctggcctattcaaaactaacaccgggacaataggagctgtgagtctggactttagcccaggtacctccggctctcccattgttgataagaaagggaaggtggtcggactctatggcaatggtgtggttacaaggtcggggacttacgtgagcgccatcgcacagaccgagaagtcaatcgaggacaaccctgaaattgaggatgacatcttcagaaagaaacggctgacgataatggatcttcatccgggagctggcaaaacaaagcgctatttacccgccattgtcagagaagcgatcaaaaggggcctgcggactctcattttggccccaacccgagtggtagcagctgagatggaagaggccctgagagggctccctatccgctaccagacacccgctataagggcagagcacaccggacgtgaaattgtggacctgatgtgtcatgccactttcaccatgcggcttctgtccccaatcagagttcctaattataacttgatcattatggatgaggcccactttacagaccccgctagtatcgcggcaaggggttacatttctacgcgcgtcgaaatgggcgaggccgctgggatattcatgactgccaccccaccgggaagccgagacccttttccccagtccaatgcaccaatcatggatgaggaaagagagattcccgaacggtcatggaactctggccacgagtgggtgacagacttcaagggtaagaccgtgtggtttgtccctagcatcaaagccgggaatgatatcgctgcgtgcctaaggaagaacggcaagaaggtaattcaactgagtcgcaaaactttcgactccgaatatataaagacacgtaccaatgattgggactttgtggttacgactgatatcagcgagatgggcgccaacttcaaggcagagagagtgattgacccacggaggtgtatgaaacccgtcatcctcacagatggcgaagaacgcgtgattttagctgggcctatgccggttacccattcttcagccgcacagcgaagaggacgggtgggtaggaatccaaagaacgaaaatgaccagtacatctacatgggcgagcccctggaaaacgatgaggactgcgcccactggaaagaggctaagatgcttctggacaatataaacacccctgaagggatcattccctccatgtttgagccagaacgcgagaaagtcgatgccatcgacggagaatatagactcaggggcgaggcgcggaagactttcgtggatttgatgcgtcgcggtgacctgcctgtatggctcgcataccgagtggccgctgaggggattaactatgccgatagaaggtggtgttttgacggcgttaaaaataaccaaatcctggaagagaatgtcgaagtggagatatggacaaaggagggagaacggaagaaacttaagccccgctggctagatgctagaatttacagtgacccactggcattgaaagagttcaaggagttcgccgctggcaggaagtcgttaaccctgaacctcatcacagagatggggcggctgcctacttttatgacgcagaaggccaagaatgcacttgataacctggcggtgctccataccgccgaagctggaggtcgagcctataatcacgcattgagcgagctgccggagacactagaaactctgctccttctgaccttattggctacagtcaccggcgggattttcctgtttctcatgtctggaaaaggcatcggtaagatgactctggggatgtgctgcataatcacggcctccattcttctgtggtacgcacagatccagccccactggattgccgctagcatcatactcgagttctttttgattgttctgttaatcccagaacctgagaaacaaagaacaccccaggacaaccagctaacatatgtggtaatcgcgattctgactgtggtcgccgcaaccatggctaatgaaatgggcttcctcgagaagaccaaaaaggattttggacttggctcaatcaccactcagcaaccagagagtaacatactggacattgatttgcgccctgcctctgcctggacactgtacgcagtggctacgaccttcatcactcccattctcaggcattccatcgaaaatagctcagttaacgtgagtctgacagccatagcgaatcaggctaccgtccttatggggctcggaaagggttggccgctgagcaaaatggacatcggcgtaccattgctggccattgggtgttactcccaggtgaaccctatcaccttaacagcagccctactgctccttgttgctcactatgcaattatcggacccggcctgcaggccaaggcgactcgggaggctcaaaaacgtgccgcagccggtattatgaagaatccaacggtggacgggatgaccgtcatcgatttggaccccataccttacgatccgaaatttgaaaagcagctgggccaggtgatgctcctggtcctttgcgtgacacaggttttaatgatgagaactacctgggctctgtgtgaggccctcacattggcaaccggacccatttctactctgtgggaaggcaacccagggaggttctggaatacgacaatcgctgtgagcatggccaacatctttcgcggatcctatctagcgggcgccggtctactcttctcaattatgaagaacaccgcaaatactcggcgagggaccggaaacacaggcgagactcttggtgagaaatggaagaatagactgaacgctttgggcaaatctgaatttcaaatatacaagaaaagtgggatccaggaggtagacaggaccctggccaaggaaggaattaaacgcggcgagacagatcatcacgcagtgtcgcgggggagcgctaagctcagatggttcgtcgagcgtaatctggttacgcctgaaggaaaggtggtcgacttaggctgcggtagagggggatggtcctattactgtggcggtcttaaaaacgtgaaggaggtaaaaggcctgaccaaagggggacccggccatgaagaacctatcccaatgtctacttatgggtggaatctcgtgcggctacagtcaggagttgatgtgttctttacaccccctgaaaaatgcgacaccctgttgtgtgatattggcgagagctccccaaaccccactgtcgaggccggtcgcacactgcgagtgctcaatcttgtcgaaaactggctgaataacaatacccaattctgcatcaaggtgttgaacccgtacatgcctagtgttatagagaagatggaagccctgcagagaaaatacgggggagcgctcgtaaggaatccattatctcggaacagcacgcacgagatgtattgggtgtcaaacgcttccggcaatatcgtcagtagcgtgaacatgatttctcgcatgctgatcaatagatttaccatgaggcacaagaaagcaacatacgaacccgacgttgatcttggctccgggactcgaaacattggaatcgagtcagagacccctaatctggacataattggtaagcggatcgagaaaatcaagcaggagcataagacaagctggcactatgatcaggaccatccatacaaaacttgggcctatcacggctcgtacgaaaccaagcaaacagggtctgctagttccatggtgaacggagtcgtgcgtctactcaccaaaccctgggacgtaattccgatggtgactcagatggccatgacggatacaacccctttcggccagcagagagtttttaaggagaaagtcgacactcgcacccaagaacccaaggagggtacaaagaaactgatgaagataacggcagagtggttgtggaaagaactggggaagaaaaagaccccaaggatgtgtactcgggaggagttcacaagaaaagtgcgcagcaatgccgctctcggagcgatctttaccgatgagaacaagtggaagtcagccagggaggcagtggaagactccggcttctgggagcttgtcgataaagaacgaaatctgcacttagagggcaagtgcgaaacttgtgtttataacatgatggggaaacgggagaagaaactgggagagtttggtaaggctaagggctctagagccatttggtacatgtggttgggggcaaggttcctcgaatttgaggccctgggattcctaaatgaagaccattggtttagccgcgagaacagtctttccggcgtggaaggtgaggggctgcacaaactcggatacatcctgcgtgatgtaagcaagaaagagggcggcgctatgtatgccgacgatacagcggggtgggacacccggattacattggaagatctgaagaatgaggaaatggtgactaaccatatggagggagaacacaaaaagctcgcagaggccatcttcagacttacctaccagaataaggtcgtgagggttcagcgccctacgccccgaggtaccgtgatggacataatctctcggagagaccagaggggctcagggcaagtcgtgacatatggactgaacactttcaccaacatggaggctcagttaattcgccagatggaaggcgagggtgtatttaaaagtatccaacagctgacagttaaggaagagattgccgtgaaaaattggttgatcagagtcgggcgggagaggctctcccgtatggcaattagcggagatgactgcgtggtgaagccactggatgaccgattcgcttctgccctaactgctcttaacgatatgggcaaagtccgcaaggacatacagcagtgggaaccctcgagaggctggaatgattggacccaagttcctttttgctcacatcacttccacgagctgatcatgaaggacgggcgggtgctcgtagtgccatgtaggaaccaggatgaactgattggacgcgccagaatcagccagggtgcaggctggtccttgcgggagacggcgtgcttagggaaaagttacgcccagatgtggtctctgatgtattttcataggcgagacctccgtcttgctgccaatgcaatctgtagcgctgtcccgtcccactgggtgcccacatcaagaaccacttggagtattcatgccacacacgaatggatgaccactgaggatatgctgaccgtttggaaccgcgtgtggatacaagagaatccttggatggaagacaagacaccagtcgagtcttgggaagagatcccctacctaggaaaacgggaagatcagtggtgcggcagcctgattggtctcacgtccagggcaacctgggccaagaacatccagactgcgattaatcaggtgagatcattgatcgggaacgaggagtatacagactacatgcctagcatgaaacgcttccggagggaagaggaagaggctggagtactgtggtga

SEQ ID NO: 14976 - RNA, 9876 nt, synthetic construct
  misc_feature 1..9876: note = derived and/or modified CDS sequence (opt3) from DENV-2__JN851129__SS-prME
  source 1..9876: mol_type = other RNA
accgccggaatcattataatgatgatccccacagtgatggctttccacctgactacgcgaaacggggagcctcatatgattgtaagcaggcaggaaaagggaaaatccctcctttttaagaccgagaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtggccccatctatgacaatgcggtgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaacaccctgcgacgctgcggaagtactgcattgaagcaaaacttaccaacacaactaccgcctcccgctgtccaacacagggggagccctctttgagcgaggaacaagataagcgatttgtctgcaaacattccatggtggacagaggatggggcaatggttgtgggctgttcggaaagggcggcatcgtgacttgcgctatgtttacctgcaagaaaaacatggaggggaaggtcgttcagcctgaaaatctagagtatacaatcgtgattaccccacactcaggagaagagaacgccgtaggtaatgatactggcaaacatgggaaggagataaaagtgacgccgcagagtagcatcacagaagcagagctcaccggatacggcactgtcaccatggaatgttctcccaggacaggtctggacttcaacgagatggtgcttctgcagatggaaaataaggcttggttggttcaccggcaatggtttctcgatctgcctttaccatggctgcccggggccgacacccagggctccaactggattcagaaagagactctcgtgacattcaagaaccctcacgcgaagaaacaggatgtcgtggtacttggatcacaagagggcgccatgcatacggcactgaccggggctactgaaatccagatgagcagtggaaatttgctatttacaggtcacctgaagtgccgtctccgcatggacaaactgcagcttaagggcatgtcttattccatgtgtaccgggaaattcaaggttgtgaaggagatagccgaaacacaacatggaactattgtcatcagagtgcagtacgagggcgacggtagcccatgcaaaatccccttcgagattatggatctggaaaagaggcacgtcttggggcggctcatcaccgtgaacccgattgttacggagaaagactcgcctgtgaatatagaagctgagcccccatttggcgattcttacatcattatcggagtagaacctggccagctgaagttatcctggttcaaaaaggggtcaagtatcggacagatgtttgagaccacaatgcgaggtgccaagcgcatggcaattctgggcgacactgcctgggatttcgggagcctaggaggcgtctttacctccataggtaaagctctccatcaagtgttcggggcgatctatggcgcagccttttctggagttagctggacaatgaagattctgatcggcgtggtcattacttggatcgggatgaactcaagaagtacctcccttagcgtgtctttggtactggtgggagttgtcacgctctacctgggcgtgatggtgcaggctgactcaggttgtgtcgttagttggaaaaataaggagcttaaatgcgggagcggaatattcatcacagataacgtgcacacctggactgaacagtataagtttcagcccgagtccccatctaagctggcctcggcaattcaaaaagcccacgaagagggcatctgtggtattaggagcgtgacacggttggaaaatctcatgtggaagcagatcacccccgagctgaaccatatattatccgagaatgaagtaaaactgactattatgaccggcgacatcaaggggattatgcaggctggaaaacgctcactaagacctcagccaacagagctcaagtacagttggaaagcctggggcaaggcaaagatgctgtctacggaacttcacaaccataccttcttgatcgatgggccggagactgcggaatgccccaatacaaacagggcttggaatagcctggaggtcgaggactatggatttggcgtgttcaccacaaacctctggctgaaattaaaggaacgtcaagatgtattttgtgactccaaactgatgtcagccgcaataaaggacaatcgggccgtgcacgctgatatgggttactggatcgagagcgcccttaacgacacttggaaaattgaaaaggcatctttcatcgaggtcaagtcctgccactggcctaaaagtcataccttgtggagcaacggggtgctcgagtctgaaatgattatcccaaagtccttcgctggacccgtttcacagcacaattatcgacctggctaccatacgcagacagccggtccatggcacctgggcagactagagatggattttgacttctgtgaagggaccactgtggtagtcaccgaggattgcggaaacaggggccccagtctgcgcacaactaccgcgagcgggaaactcataacagaatggtgctgtcggtcgtgcacgctgccgcctcttagatacaggggagaggacggctgttggtatggtatggagattcgcccattgaaggaaaaagaggaaaatctggtgaactccttagtgaccgccgggcatggacagatcgataatttttctctcggcgtcctgggtatggctcttttcctggaggaaatgttgcgaactcgggttggcacaaagcacgcaatcctcctggtggccgttagctttgtgaccctaattactgggaacatgtcattccgtgacctgggaagagtcatggtgatggttggcgctacaatgaccgatgacatcgggatgggagtgacgtacctcgccctgcttgcagcgtttaaggtcaggcccactttcgccgctggcttgctgttacgcaaactcaccagtaaggagctgatgatgacaaccattggtatagtgcttctgtcccaatctactatccctgagacaattctagaactcaccgatgccctggcattggggatgatggttctgaaaatcgtgcggaatatggagaagtatcagttagctgtcacaattatggccatcctctgcgtacccaacgcagtgatactgcagaatgcctggaaagttagctgtactacccttgctgtggtctccgtgtcaccactgttgctcacgagcagtcaacagaaggcggactggatccctctggccctaacaattaagggactgaaccccaccgcaatctttcttactaccctctctagaacatccaaaaagaggagctggccactgaatgaagctattatggccgtaggcatggtgtcgatcttggcctcatctctgctaaagaacgatataccgatgactggccctctcgtcgctgggggactgcttaccgtttgctacgtgctgacgggtcgaagtgcagacttggagctcgaacgcgccgcggacgtgcggtgggaggagcaggctgaaatttccggcagctctcccatcctgagcatcacaatttccgaggatgggtcaatgagtataaagaatgaagaggaggaacagaccctaactatcctgattagaacaggacttctcgtcatcagcggcctgttcccagtgtctattcccatcaccgccgcagcctggtatttgtgggaggttaaaaagcaaagggctggtgtattatgggacgtgccttccccaccccctgtcgggaaagcagaactggaggatggagcctaccgtataaagcagaagggcatcctcggctattcacagattggggcgggagtgtacaaagaaggtacttttcacacaatgtggcatgttacccgcggcgctgtgctgatgcacaaggggaaacggatcgagccgagttgggccgacgtcaagaaagatcttattagctacggaggcggttggaagctggagggggaatggaaggagggagaagaggtgcaggtattggcactagaaccaggcaaaaaccccagagccgtccaaacgaagcctggcctgttcaaaactaataccgggacaatcggagctgtgtccctcgacttttctccaggtacctcgggcagccccatagttgataagaaagggaaggtggtcggactgtatggcaacggtgtggttacaaggtcagggacttacgtgtccgccattgcacagaccgagaagagtatcgaggacaaccctgaaatcgaggatgacattttccggaaaaagagacttacgatcatggatttacatccgggagctggcaaaacaaagcgctatctgcccgccatagtcagagaagcgattaaaaggggcctccggactttgatcctggccccaacccgagtggtagcagctgagatggaagaggccctcagagggctgcctattcgctaccagacacccgctatcagggcagagcacaccggacgtgaaatagtggaccttatgtgtcatgccactttcaccatgcggctgttgtctccaattagagttcctaattataacctaatcatcatggatgaggcccactttacagaccccgctagcattgcggcaaggggttacatctccacgcgcgtcgaaatgggcgaggccgctgggattttcatgactgccaccccaccgggatcacgagacccttttccccagtctaatgcaccaataatggatgaggaaagagagatccccgaacggagctggaacagtggccacgagtgggtgacagacttcaagggtaagaccgtgtggtttgtcccttccattaaagccgggaatgatatcgctgcgtgcctgaggaagaacggcaaaaaggtaatccaactcagccgcaaaactttcgactctgaatatattaagacacgtaccaatgattgggactttgtggttacgactgatatatcagagatgggcgccaacttcaaggcagagagagtgatcgacccacggaggtgtatgaaacccgtcattttaacagatggcgaagaacgcgtgatcctggctgggcctatgccggttacccattccagtgccgcacagcgaagaggacgggtgggtaggaatccaaagaacgaaaatgaccagtacatttacatgggcgagccccttgaaaacgatgaggactgcgcccactggaaagaggctaagatgctgctcgacaatatcaacacccctgaagggataatccccagcatgtttgagccagaacgcgagaaagtcgatgccattgacggagaatatagattgaggggcgaggcgcggaagactttcgtggatctgatgcgtcgcggtgacctccctgtatggctggcataccgagtggccgctgaggggatcaattatgccgatagaaggtggtgttttgacggcattaaaaacaaccaaatccttgaagagaatgttgaagtcgagatatggacaaaggagggagaacggaagaaactaaagccccgctggctggatgctagaatttactcggacccattggcattaaaagagttcaaggagttcgccgctggcaggaaatctctgaccctcaacctgatcacagagatggggcggcttcctacttttatgacgcagaaggcccgaaatgcactggataacctcgcggtgttgcataccgccgaagctggaggtagagcctataatcacgcactgtccgagctaccggagacactggaaactctccttctgttaaccttgctggctacagtgaccggcgggattttcctctttctgatgagcggaaagggcatcggtaaaatgactcttgggatgtgctgcataatcacggcctcaattctgctctggtacgcacagatccagccccactggattgccgctagtatcatattggagttctttctgattgtcttactaatcccagaacctgagaagcaacgcacaccccaggacaaccagctgacatatgttgtgatcgcgattctcactgtagtggccgcaaccatggctaatgaaatgggcttccttgagaaaacaaagaaagattttggactgggctctatcaccactcagcaaccagagtccaacatattggacattgatctgaggcctgccagcgcctggacactctacgcagtcgctacgaccttcatcactcccatgctgcggcattcaattgaaaatagtagcgtgaacgtttcccttacagccatcgcgaatcaggctaccgtgctcatggggctgggaaagggttggccgttgtctaagatggacataggcgtcccactgttagccatcgggtgttacagccaggtaaaccctattaccctaacagcagccctgctccttctggtggctcactatgcaatcattggacccggcttgcaggccaaagcgactcgtgaggctcaaaagagagccgcagccggtatcatgaaaaatccaacggttgacgggattaccgtgatcgatctggaccccataccttacgatccgaagtttgaaaaacagctcggccaggtcatgctgcttgtgttatgcgtcacacaggtgctgatgatgaggactacctgggctctctgtgaggccttgacactggcaaccggacccatttccactctatgggaaggcaacccagggcgcttctggaatacgacaatcgctgtttcaatggccaacatctttcggggatcttatctggcgggcgccggtctccttttcagtattatgaagaataccgcaaacactcgaagagggaccggaaacacaggcgagactctgggtgagaagtggaaaaataggttgaacgctctgggcaagtcggaatttcaaatatacaaaaagagcgggatccaggaggtggaccgcaccctcgccaaagaaggaattaagcggggcgagacagatcatcacgcagtatccagagggtctgctaaactgcgttggttcgtggagaggaatttagtcacgcctgaaggaaaggttgtggaccttggctgcggtagaggcgggtggtcatattactgtgggggtctgaagaacgtcaaagaggtgaagggcctcaccaaagggggacccggccatgaggaacctatcccaatgagcacttatgggtggaatctagtacgcctgcagtccggagtggatgttttctttacaccccctgaaaagtgcgacaccttgctgtgtgatattggcgagagttctccaaaccccactgtggaggccggtcgaacactcagagtccttaatctggtggaaaactggttgaataacaatacccaattctgcatcaaagtcctgaacccgtacatgcctagcgtgatagagaagatggaagccctccagaggaagtacgggggagcgttagttcggaatccactgtcacgcaactccacgcacgagatgtattgggtaagtaatgctagcggcaacatcgtgtcttccgtcaacatgatttcaagaatgcttatcaataggtttaccatgcgacacaaaaaggcaacatacgaacccgacgtggatctgggcagcgggactcggaacattggaatcgagtcggagacccctaatctagacataattggtaaacgtatcgaaaagatcaaacaggagcatgaaacatcttggcactatgatcaggaccatccatacaagacttgggcctatcacggcagttacgagaccaagcaaacagggtccgctagctcaatggttaacggagtggtcagactcctgaccaaaccctgggacattataccgatggtgactcagatggccatgacggatacaacccctttcggccagcagcgcgtatttaaggaaaaagtggacactaggacccaagagcccaaggagggtaccaaaaagttgatgaagatcacggcagaatggctgtggaaagagctcgggaagaaaaagaccccacggatgtgtactagagaagagttcacacgcaaagttaggtccaatgccgctcttggagcgatttttaccgatgagaacaagtggaaatctgcccgagaagcagtcgaggacagcggcttctgggaactggtggataaggagcggaatttacacctggaaggcaagtgcgagacttgtgtgtataacatgatggggaaaagagagaagaaattgggagaatttggtaaggctaaaggcagtagggccatctggtacatgtggctcggggcacgcttcctggagtttgaagccctaggattccttaatgaggaccattggttttcccgtgaaaacagcctgtctggcgtcgagggtgaggggctccacaagctgggatacattttgcgggatgtttcaaagaaagaaggcggcgctatgtatgccgacgatacagcggggtgggacaccagaatcacactggaggatctcaagaatgaagagatggtgactaaccatatggaaggagagcacaagaaacttgcagaggccatattcaaactgacctaccagaataaagtagtgagggtccagcgccctacgccccgaggtaccgtgatggacatcattagtcggagagaccagaggggctccgggcaagttgtgacatatggattaaacactttcaccaatatggaagctcagctgatccgccagatggagggcgaaggtgtctttaagagcattcaacagttgacagtgactgaggagatcgccgtcaaaaactggctcgttagagtggggcgggaaaggctgtctcgtatggcaatttcgggagatgactgcgtcgtgaagccactagatgaccgattcgcttcagcccttaccgctctgaacgatatgggcaaagtgcgcaaggacatacagcagtgggagcccagcagaggctggaatgattggacgcaagtccctttttgctcccatcacttccacgaactcatcatgaaagacgggcgggttctggtggtaccatgtaggaaccaggatgagttgattggacgcgccagaatcagtcagggtgcaggctggtctttacgggaaacagcgtgcctgggaaagagctacgcccagatgtggtccctcatgtattttcataggcgagaccttcgtctggctgccaatgcaatctgttcagctgtgccgagtcactgggtccccacctctagaactacatggagcattcatgccacccacgagtggatgactaccgaggatatgctaacagtgtggaaccgcgtttggatacaagaaaatccttggatggaggacaagacgctggtggaatcctgggaggaaatcccatacctcggaaaacgggaggatcagtggtgcggctcattgattggtctgaccagcagggcaacttgggccaagaacatccagacagcgattaatcaggtcagatctcttatcgggaacgaggaatataccgactacatgccctccatgaaacgcttccggagggaggaagaggaagctggagtgctgtggtga

SEQ ID NO: 14977 - RNA, 9876 nt, synthetic construct
  misc_feature 1..9876: note = derived and/or modified CDS sequence (opt3) from DENV-2__JN851128__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtggccccatctatgacaatgagatgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaccaccctgcgacgctgcggaaatactgcattgaagcaaagcttaccaatacaactaccgcctcccgctgtccaacacagggggagccctctttgagcgaggaacaagataaacgatttgtctgcaagcattccatggtggacagaggatggggcaacggttgtgggctgttcggaaaaggcggcatcgtgacttgcgctatgtttacctgcaagaagaatatggaggggaaagtcgttcagcctgaaaacctagagtatacaatcgtgattaccccacactcaggagaagagaatgccgtaggtaacgatactggcaagcatgggaaagagataaaggtgacgccgcagagtagcatcacagaagcagagctcaccggatacggcactgtcaccatggaatgttctcccaggacaggtctggacttcaatgagatggtgcttctgcagatggaaaacaaagcttggttggttcaccggcaatggtttctcgatctgcctttaccatggctgcccggggccgacacccagggctccaactggattcagaaggagactctcgtgacattcaaaaatcctcacgcgaagaagcaggatgtcgtggtacttggatcacaagagggcgccatgcatacggcactgaccggggctactgaaatccagatgagcagtggaaacttgctatttacaggtcacctgaaatgccgtctccgcatggacaagctgcagcttaaaggcatgtcttattccatgtgtaccgggaagttcaaagttgtgaaggagatagccgaaacacaacatggaactattgtcatcagagtgcagtacgagggcgacggtagcccatgcaagatccccttcgagattatggatctggaaaaaaggcacgtcttggggcggctcatcaccgtgaatccgattgttacggagaaggactcgcctgtgaacatagaagctgagcccccatttggcgattcttacatcattatcggagtagaacctggccagctgaaattatcctggttcaagaaagggtcaagtatcggacagatgtttgagaccacaatgcgaggtgccaagcgcatggcaattctgggcgacactgcctgggatttcgggagcctaggaggcgtctttacctccataggtaaggctctccatcaagtgttcggggcgatctatggcgcagccttttctggagttagctggacaatgaaaattctgatcggcgtggtcattacttggatcgggatgaattcaagaagtacctcccttagcgtgtctttggtactggtgggagttgtcacgctctacctgggcgtgatggtgcaggctgactcaggttgtgtcgttagttggaagaacaaagagcttaagtgcgggagcggaatattcatcacagataatgtgcacacctggactgaacagtataaatttcagcccgagtccccatctaagctggcctcggcaattcaaaaggcccacgaagagggcatctgtggtattaggagcgtgacacggttggaaaacctcatgtggaaacagatcacccccgagctgaatcatatattatccgagaacgaagtaaagctgactattatgaccggcgacatcaaagggattatgcaggctggaaagcgctcactaagacctcagccaacagagctcaaatacagttggaaggcctggggcaaagcaaagatgctgtctacggaacttcacaatcataccttcttgatcgatgggccggagactgcggaatgccccaacacaaatagggcttggaacagcctggaggtcgaggactatggatttggcgtgttcaccacaaatctctggctgaagttaaaagaacgtcaagatgttttttgtgactccaagctgatgtcagccgcaataaaagacaaccgggccgtgcacgctgatatgggttactggatcgagagcgccattaacgacacttggaagatcgaaaaagcatctttcattgaggtcaagtcctgccactggcctaagagtcataccctttggagcaatggggtgttggagtctgaaatgatcataccaaaaaacttcgctggacccgtttcccagcacaattatcgacctggctaccatacgcagacagccggtccatggcacctcggcagactggagatggattttgacttctgtgaagggaccactgtggtagtcaccgaggattgcggaaacaggggcccctcactacgcacaactaccgcgagtgggaagctgattacagaatggtgctgtcggagctgcacgctcccgcctctgagatacaggggagaggacggctgttggtatggtatggagatccgcccacttaaagaaaaggaggaaaatttggtgaactcgctggtgaccgccgggcatggacagatcgataatttttccttaggcgtcctcggtatggctctgttccttgaggaaatgctgcgaactcgggttggcacaaaacacgcaattttgctcgtggccgtatcttttgtgaccctgatcactgggaacatgagcttccgtgacctaggaagagtcatggtgatggttggcgctacaatgaccgatgacattgggatgggagtgacgtacctggccctcctggcagcgtttaaggtcaggcccactttcgccgctggccttttgctgcgcaagttaacctcaaaagagctcatgatgacaaccataggtatcgtgctgcttagtcaatccactattcctgagacaatcctggaactaaccgatgccctcgcactggggatgatgattttgaagatcgttcggaatatggagaaatatcagctggctgtgacaataatggccatcttatgcgtccccaacgcagtaattctccagaatgcctggaaggtgtcttgtactaccctggctgttgtgagcgtctccccacttctgttgacgtcaagccaacagaaagcggactggatccctctcgccctgacaattaagggactaaaccccaccgcaatctttctgactacccttagtagaacatctaagaaaaggtcctggccactcaatgaagctataatggccgtgggcatggtaagcattctggcctcgtcattgctgaagaacgatatcccgatgactggccctttagtggctgggggactcctgaccgtctgctacgttcttacgggtcgatctgcagacctggagttggaacgcgccgcggacgtgcggtgggaggagcaggctgaaatcagtggctccagccccattctctctataacaatcagcgaggatgggtccatgtcaattaaaaatgaagaggaggaacagaccctgactatcctaattagaacaggactgcttgtgatcagtggcctcttcccagtcagcatacccatcaccgccgcagcctggtatctgtgggaggtgaagaaacaaagggctggtgttttgtgggacgtaccttctccaccccctgtggggaaggcagaattagaggatggagcctaccgtattaaacagaagggcatcctgggctattcccagattggggcgggagtctacaaggaaggtacttttcacacaatgtggcatgtgacccgcggcgctgttctcatgcacaaagggaagcggatcgagccgtcatgggccgacgtgaaaaaggatctgataagttacggaggcggttggaaacttgagggggaatggaaggagggagaagaggtccaggtgctggcattggaaccaggcaagaaccccagagccgtacaaacgaaacctggcctattcaagactaacaccgggacaattggagctgtcagcctggacttttccccaggtacctctggctcgcccatcgtggataaaaaggggaaagttgtgggactctatggcaatggtgtcgtgacaaggagcgggacttacgtttcagccatcgcacagaccgagaagtccattgaggacaaccctgaaatcgaggatgacatattccgaaagaaacggctgacgattatggatcttcatccgggagctggcaagacaaaacgctatttacccgccatcgtgagagaagcgattaagaggggcctgcggactctcatcttggccccaacccgagtcgtggcagctgagatggaagaggccctgagagggctccctatacgctaccagacacccgctattagggcagagcacaccggacgtgaaatcgtagacctgatgtgtcatgccactttcaccatgcggcttctgagtccaatcagagtgcctaattataacttgattatcatggatgaggcccactttacagaccccgcttctattgcggcaaggggttacataagcacgcgcgttgaaatgggcgaggccgctgggatcttcatgactgccaccccaccgggatcccgagacccttttccccagtcaaatgcaccaattatggatgaggaaagagagatccccgaacggtcttggaacagcggccacgagtgggtcacagacttcaaaggtaagaccgtgtggtttgtgcctagtatcaaggccgggaatgatattgctgcgtgcctaaggaaaaacggaaagaaagtcatacaactgtcccgcaagactttcgacagcgaatatatcaaaacacgtaccaatgattgggactttgtagtgacgactgatatttctgagatgggcgccaacttcaaggcagagagagttatcgacccacggaggtgtatgaagcccgtgattctcacagatggcgaagagcgcgtcatcttagctgggcctatgccggtgacccattcatccgccgcacagcgaagaggacgggttggtaggaatccaaaaaacgaaaatgaccagtacatatacatgggcgagcccctggaaaacgatgaggactgcgcccactggaaggaggctaaaatgcttctggacaatatcaacacccctgaagggattatccccagtatgtttgagccagaacgcgagaaggtggatgccattgacggagaatatagactcaggggcgaggcgcggaaaactttcgtcgatttgatgcgtcgcggtgacctgcctgtgtggctcgcataccgagtagccgctgaggggatcaactatgccgatagaaggtggtgttttgacggcgtgaagaataaccaaatactggaagagaatgttgaagtcgagatttggacaaaagagggagaacggaagaagcttaaaccccgctggctagatgctagaatctacagcgacccactggcattgaaggagttcaaagaattcgccgctggcaggaagtcgttaaccctgaacctcattacagagatggggcggctgcctacttttatgacgcagaaagcccgaaatgcacttgataacctggcggtgctccataccgccgaagctggaggtagagcctataatcacgcattgtctgagctgccggagacactagaaactctgctccttctgaccttattggctacagtgaccggcgggatcttcctgtttctcatgtccggaaagggcataggtaagatgactctggggatgtgctgcatcattacggccagcatccttctgtggtacgcacagattcagccccactggatcgccgcttcaataattctcgagttctttttgatcgtcctgttaatcccagaacctgagaaacaacgcaccccccaggacaaccagctaacatatgttgtgattgcgatcctgactgtagtggccgcaaccatggctaatgaaatgggcttcctcgagaagacaaaaaaggattttggacttggcagtataaccactcagcaaccagagtctaacattctggacatcgatttgaggcctgcctccgcctggacactgtacgcagtcgctacgaccttcattactcccatgctccggcatagcatcgaaaattcaagtgtgaacgttagcctgacagccatagcgaatcaggctaccgtgcttatggggctcggaaaaggttggccgctgtccaagatggacatcggcgtcccattgctggccattgggtgttactctcaggtaaaccctatcaccttaacagcagccctactgctccttgtggctcactatgcaattatcggacccggcctgcaggccaaggcgactcgtgaggctcaaaaaagagccgcagccggtattatgaagaatccaacggttgacgggatcaccgtgatagatttggaccccattccttacgatccgaaatttgaaaagcagctgggccaggtcatgctcctggtgctttgcgtcacacaggtgttaatgatgaggactacctgggctctgtgtgaggccctcacattggcaaccggacccatcagcactctgtgggaaggcaacccagggcgcttctggaatacgacaatcgctgtttccatggccaacatttttcggggatcatatctagcgggcgccggtctgctcttctctataatgaaaaacaccgcaaatactcgaagagggaccggaaacacaggcgagactcttggtgagaagtggaagaataggctgaacgctttgggcaaaagtgaatttcaaatctacaagaaatcggggattcaggaggtggaccgcaccctggccaaggaaggaatcaaacggggcgagacagatcatcacgcagtaagcagagggtccgctaagctccgttggttcgtggagaggaatctggtcacgcctgaaggaaaagttgtggacttaggctgcggtcgggggggatggtcttattactgtggcggtcttaagaacgtcaaggaggtgaaaggcctgaccaaggggggacccggccatgaagagcctattccaatgtcaacttatgggtggaatctcgtacgcctacagagcggagtggatgttttctttacaccccctgaaaaatgcgacaccctgttgtgtgatatcggcgagtccagtccaaaccccactgtggaggccggtcgaacactgagagtcctcaatcttgtggaaaactggctgaataacaatacccaattctgcataaaggtcttgaacccgtacatgccttctgtgatcgagaaaatggaagccctgcagaggaagtacgggggagcgctcgttcggaatccattaagccgcaactcaacgcacgagatgtattgggtatccaacgctagtggcaatattgtgagctctgtcaacatgatctccagaatgctgattaataggtttaccatgcgacacaagaaagcaacatacgaacccgacgtggatcttggctcagggactcggaacatcggaatagagagcgagacccctaatctggacattatcggtaagcgtatcgaaaaaattaagcaggagcatgaaacatcgtggcactatgatcaggaccatccatacaaaacttgggcctatcacggctcttacgagaccaagcaaacagggagtgcttccagcatggttaacggagtggtcagactactcaccaagccctgggacataatcccgatggtgactcagatggccatgacggatacaacccctttcggccagcagcgcgtatttaaagaaaaggtggacactaggacccaagagcccaaagagggtacaaagaaactgatgaagattacggcagaatggttgtggaaggagctggggaaaaagaaaaccccacggatgtgtactagagaagagttcacacgcaaggttaggtcaaatgccgctctcggagcgatctttaccgatgagaacaaatggaagtccgcccgagaagcagtcgaggactctggcttctgggaacttgtggataaagagcggaatctgcacttagaaggcaagtgcgagacttgtgtgtataacatgatggggaagagagagaaaaagctgggagaatttggtaaagctaagggcagcagggccatttggtacatgtggttgggggcacgcttcctcgagtttgaagccctgggattcctaaatgaggaccattggtttagtcgtgaaaactcccttagcggcgtcgagggtgaggggctgcacaaactcggatacatcctgcgggatgtttctaagaaggaaggcggcgctatgtatgccgacgatacagcggggtgggacaccagaataacattggaggatctgaaaaatgaagagatggtgactaaccatatggaaggagagcacaagaaactcgcagaggccatcttcaagcttacctaccagaataaagtagtgagggtccagcgccctacgccccgaggtaccgtgatggacattatctcacggagagaccagaggggcagtgggcaagttgtgacatatggactgaacactttcaccaacatggaagctcagttaattcgccagatggagggcgaaggtgtctttaagtccatccaacagctgacagtgactgaggagattgccgtaaagaattggttggttagagtggggcgggaaaggctcagccgtatggcaatatctggagatgactgcgtcgtgaaaccactggatgaccgattcgcttcggccctaaccgctcttaacgatatgggcaaggtgcgcaaagacatccagcagtgggagccctcaagaggctggaatgattggacgcaagtccctttttgcagccatcacttccacgaactgattatgaaggacgggcgggttctcgtggtaccatgtaggaaccaggatgagctgatcggacgcgccagaatctcccagggtgcaggctggagtttgcgggaaacagcgtgcttagggaaatcttacgcccagatgtggagcctgatgtattttcataggcgagacctccgtcttgctgccaatgcaatttgttccgctgtgccgtcacactgggtccccaccagtagaactacatggtctatacatgccacccacgagtggatgactaccgaggatatgctgacagtgtggaaccgcgtttggatccaagaaaatccttggatggaggacaagacgctagtggaaagctgggaggaaattccatacctgggaaagcgggaggatcagtggtgcggctccctcatcggtttgacctcaagggcaacttgggccaaaaacattcagacagcgatcaatcaggtcagaagcctgatagggaacgaggaatataccgactacatgccctctatgaagcgcttccggagggaggaagaggaagctggagtgctttggtga

SEQ ID NO: 14978 - RNA, 9876 nt, synthetic construct
  misc_feature 1..9876: note = derived and/or modified CDS sequence (opt3) from DENV-2__JN851130__SS-prME
  source 1..9876: mol_type = other RNA
accgccggaatcattataatgatgatccccacagtgatggctttccacctgactacgcgaaacggggagcctcatatgattgtaagcaggcaggaaaagggaaaatccctcctttttaagaccgagaatggtgttaacatgtgcaccctgatggcaatggacttgggcgaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgtagcgctcgtgccccatgtaggcatgggtctggagactagaaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtggccccatctatgacaatgcggtgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaacaccctgcgacgctgcggaagtactgcattgaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaagatcgtccagcctgaaaacctagagtatacaattgttataaccccacactccggagaagagaatgccgtgggtaacgatactggcaaacatgggaaggagatcaaagtaacgccgcagtcaagtattacagaagcagagctcaccggatacggcactgtgaccatggaatgtagccccaggacaggtctggacttcaatgagatggtccttctgcagatggaaaacaaggcttggttggtgcaccggcaatggtttctcgatctgcctttaccatggctgcccggggccgacacccagggctctaactggatccagaaagagactctcgttacattcaagaatcctcacgcgaagaaacaggatgtggtcgtgcttggatcccaagagggcgccatgcatacggcactgaccggggctactgaaatacagatgtcaagcggaaacttgctatttacaggtcacctgaagtgccgtctccgcatggacaaactgcagcttaagggcatgagttattctatgtgtaccgggaaattcaaggtagttaaggagattgccgaaacacaacatggaactatcgtgatcagagtccagtacgagggcgacggttccccatgcaaaattcccttcgagatcatggatctggaaaagaggcacgtgttggggcggctcattaccgtcaatccgatagtgacggagaaagacagccctgttaacatcgaagctgagcccccatttggcgattcgtacattatcatcggagtggaacctggccagctgaagttatcttggttcaaaaaggggtcctcaattggacagatgtttgagaccacaatgcgaggtgccaagcgcatggcaatactgggcgacactgcctgggatttcgggagtctaggaggcgtatttaccagcatcggtaaagctctccatcaagtcttcggggcgatttatggcgcagccttttccggagtgtcttggacaatgaagatcctgattggcgttgtgatcacttggatagggatgaatagcagatcaaccagtctttccgtcagcttggtgctggtaggagtggttacgctctacctgggcgtcatggtgcaggctgactctggttgtgtggtctcatggaaaaacaaggagcttaaatgcgggagtggaatcttcattacagataatgttcacacctggactgaacagtataagtttcagcccgagagcccatccaagctggcctctgcaatccaaaaagcccacgaagagggcatttgtggtatcaggtcggtgacacggttggaaaacctcatgtggaagcagataacccccgagctgaatcatattttaagcgagaacgaagtgaaactgactatcatgaccggcgacattaaggggatcatgcaggctggaaaacgctccctaagacctcagccaacagagctcaagtactcatggaaaacgtggggcaaggccaagatgctgagtaccgaacttcacaatcatactttcttgatagatgggccggagacagcagaatgccccaacaccaatagggcgtggaactctctggaggtagaggactatggatttggcgtcttcacaactaatatctggctcaaactgaaggaacgtcaagatgtgttttgtgacagcaaattaatgtccgctgccattaaggacaaccgggcagttcacgccgatatgggttactggatcgagtcagctctgaacgacacctggaaaattgaaaaggccagcttcatcgaggtgaagtcttgctattggcctaaatcccacacgctttggagtaatggggtcttggagagcgaaatgataattccaaagaacttcgcaggacccgtgtctcagcataattaccgacctggctaccacacacagaccgctggtccatggcatctcggcagactggagatggattttgacttctgtgaagggactaccgttgtggtaacagaggattgcggaaacaggggcccctccctacgcactaccacagcctcagggaaactgatcacggaatggtgctgtcggagttgcaccctcccgcctctgagatataggggagaggacggctgttggtacggtatggagatccgcccacttaaggaaaaagaggaaaatttggtcaacagcctggtgactgcggggcacggacagattgataatttttcgttaggcgtgctcggtatggccctgttccttgaggaaatgctgcgaacacgggtcggcaccaagcatgctatcttgctcgttgcagtgtcctttgtaactctgattacagggaacatgtctttccgtgacctaggaagagtgatggtcatggtgggcgccaccatgacggatgacatagggatgggagttacttatctggctctcctggccgcatttaaggtgaggcccaccttcgcggccggccttttgctgcgcaaattaacaagcaaggagctcatgatgaccactatcggtattgtcctgctttcacaaagtacaatccctgagaccattctggaactaacagatgctctcgccctggggatgatggcattgaaaatcgtgcggaatatggagaagtaccagctggctgttactataatggccatcttatgcgtgcccaacgcagtcattctccagaatgcctggaaagtatcctgtaccacgctggctgtggtttctgtgagcccacttctgttgacatcctcacaacagaaggcggactggatccctctcgccctgaccattaagggactaaaccccactgcaatctttctgaccacacttagcagaacaagtaaaaagaggtcttggccactcaatgaagctataatggccgtcggcatggtgtccattctggccagctcgttgctgaaaaacgatatcccgatgaccggccctttagtagctgggggactcctgacggtgtgctatgtccttacaggtcgatcagcagacctggagttggaacgcgccgcggacgttcggtgggaggagcaggctgaaatctctggcagttcccccattctcagcataaccatctctgaggatgggagcatgtccattaagaatgaagaggaggaacagactctgacaatcctaattagaaccggactgcttgtgatctcaggcctcttcccagtgagtatacccatcactgccgcagcctggtacctgtgggaggtcaaaaagcaaagggctggtgtgttgtgggacgttcctagcccaccccctgtagggaaagcagaattagaggatggagcctatcgtattaagcagaagggcatcctgggctactctcagattggggcgggagtgtacaaagaaggtacatttcacaccatgtggcacgtcacgcgcggcgctgtgctcatgcataaggggaaacggatcgagccgtcctgggccgacgttaagaaagatctgatatcatatggaggcggttggaaacttgagggggaatggaaggagggagaagaggtgcaggtcctggcattggaaccaggcaaaaaccccagagccgtgcaaactaagcctggcctattcaaaaccaacacagggaccattggagctgtaagtctggactttagcccaggtacatccggctctcccatcgtcgataagaaagggaaggtggttggactctacggcaatggtgtggtcactaggtcggggacctatgtgagcgccatcgcacagacggagaagtcaattgaggacaaccctgaaatcgaggatgacatattcagaaagaaacggctgacaattatggatcttcacccgggagctggcaaaactaagcgctacttacccgccatcgttagagaagcgattaaaaggggcctgcggaccctcatcttggccccaacacgagtggtcgcagctgagatggaagaggccctgagagggctccctatacgctatcagacccccgctattagggcagagcatactggacgtgaaatcgtggacctgatgtgtcacgccaccttcacaatgcggcttctgtccccaatcagagtacctaattacaacttgattatcatggatgaggcccattttacggaccccgctagtattgcggcaaggggttatatatctactcgcgtggaaatgggcgaggccgctgggatcttcatgaccgccacaccaccgggaagccgagacccttttccccagtccaatgcaccaattatggatgaggaaagagagatccccgaacggtcatggaactctggccacgagtgggttaccgacttcaagggtaagactgtctggtttgtgcctagcatcaaagccgggaatgatattgctgcgtgcctaaggaagaacggcaaaaaggtgatacaactgagtcgcaaaacattcgactccgaatacatcaagacccgtacgaatgattgggactttgtcgtaactacagatattagcgagatgggcgccaacttcaaggcagagagagtgatcgacccacggaggtgtatgaaacccgttattctcaccgatggcgaagaacgcgtgatcttagctgggcctatgccggtcacccactcttcagccgcacagcgaagaggacgggtgggtaggaatccaaagaacgaaaatgaccagtacatatatatgggcgagcccctggaaaacgatgaggactgcgcccattggaaagaggctaagatgcttctggacaatatcaacactcctgaagggattatcccctccatgtttgagccagaacgcgagaaagttgatgccattgacggagaatacagactcaggggcgaggcgcggaagacattcgtggatttgatgcgtcgcggtgacctgcctgtctggctcgcatatcgagtggccgctgaggggatcaactacgccgatagaaggtggtgttttgacggcgtcaaaaataaccaaatactggaagagaatgtggaagttgagatttggaccaaggagggagaacggaagaaacttaagccccgctggctagatgctagaatctatagtgacccactggcattgaaagagttcaaggagttcgccgctggcaggaagtcgttaacactgaacctcattactgagatggggcggctgcctacgtttatgacccagaaggcccgaaatgcacttgataacctggcggtcctccacacagccgaagctggaggtagagcctacaatcatgcattgagcgagctgccggagactctagaaaccctgctccttctgacattattggctaccgtgactggcgggatcttcctgtttctcatgtctggaaagggcataggtaaaatgacgctggggatgtgctgcatcattaccgcctccatccttctgtggtatgcacagattcagccccactggatcgccgctagcataattctcgagttctttttgatcgtgctgttaatcccagaacctgagaagcaacgcacaccccaggacaaccagctaacttacgtcgttattgcgatcctgaccgtggtagccgcaacaatggctaatgaaatgggcttcctcgagaaaaccaagaaagattttggacttggctcaataactacacagcaaccagagagtaacattctggacatcgatttgaggcctgcctctgcctggacgctgtacgcagtggctaccactttcattacacccatgctccggcactccatcgaaaatagctcagtcaacgtgagtctgaccgccatagcgaatcaggctaccgttcttatggggctcggaaagggttggccgctgagcaagatggacatcggcgtgccattgctggccattgggtgttattcccaggtcaaccctatcacattaactgcagccctactgctccttgtagctcattacgcaattatcggacccggcctgcaggccaaagcgacgcgtgaggctcaaaagagagccgcagccggtattatgaaaaatccaaccgtggacgggatcacagttatagatttggaccccattccttatgatccgaagtttgaaaaacagctgggccaggtgatgctcctggtcctttgcgtgactcaggtcttaatgatgaggaccacatgggctctgtgtgaggccctcaccttggcaactggacccatctctacgctgtgggaaggcaacccagggcgcttctggaatacaaccatcgctgtgagcatggccaacatttttcggggatcctacctagcgggcgccggtctactcttctcaataatgaagaacactgcaaatacccgaagagggacaggaaacactggcgagacccttggtgagaagtggaaaaataggctgaacgctttgggcaagtctgaatttcaaatctataaaaagagtgggattcaggaggttgaccgcacactggccaaagaaggaatcaagcggggcgagacggatcaccatgcagtgtcgagagggagcgctaaactccgttggttcgtagagaggaatctggtgacccctgaaggaaaggtcgttgacttaggctgcggtagagggggatggtcctactattgtggcggtcttaagaacgtgaaagaggtcaagggcctgactaaagggggacccggccacgaggaacctattccaatgtctacatacgggtggaatctcgtgcgcctacagtcaggagtagatgtgttctttacaccccctgaaaagtgcgacactctgttgtgtgatatcggcgagagctccccaaaccccacagttgaggccggtcgaaccctgagagtgctcaatcttgtcgaaaactggctgaataacaatacgcaattctgcataaaagtgttgaacccgtacatgcctagtgtcatcgagaagatggaagccctgcagaggaagtatgggggagcgctcgtgcggaatccattatctcgcaacagcacccatgagatgtactgggtttcaaacgcttccggcaatattgtaagtagcgtgaacatgatctctagaatgctgattaataggtttacaatgcgacacaaaaaggcaacttatgaacccgacgtcgatcttggctccgggacccggaacatcggaatagagtcagagattcctaatctggacatcatcggtaaacgtattgaaaagataaaacaggagcacgaaacaagctggcattacgatcaggaccacccatataagacttgggcctaccatggctcgtatgagaccaagcaaacagggtctgctagttccatggtgaacggagttgtgagactactcaccaaaccctgggacgtcatcccgatggtgactcagatggccatgacggatacaacccctttcggccagcagcgcgtatttaaggaaaaagtggacactaggacccaagagcccaaggagggtactaaaaagctgatgaagattacggcagaatggttgtggaaagagctggggaagaaaaagaccccacggatgtgtactagagaagagttcacacgcaaagttaggagcaatgccgctctcggagcgatctttaccgatgagaacaagtggaaatcagcccgagaagcagtcgaggactccggcttctgggaacttgtggataaggagcggaatctgcacttagaaggcaagtgcgagacttgtgtgtacaacatgatggggaaaagagagaagaaactgggagaatttggtaaggctaaaggctctagggccatttggtacatgtggttgggggcacgcttcctcgagtttgaagccctgggattcctaaatgaggaccactggtttagccgtgaaaacagtctttccggcgtcgagggtgaggggctgcataagctcggatatatcctgcgggatgttagcaagaaagaaggcggcgctatgtacgccgacgatacagcggggtgggacaccagaataacattggaggatctgaagaatgaagagatggtgactaaccacatggaaggagagcataaaaagctcgcagaggccatcttcaaacttacctatcagaataaggtagtgagggtccagcgccctacgccccgaggtaccgtgatggacattatctctcggagagaccagaggggctcagggcaagttgtgacatacggactgaacactttcaccaacatggaagctcagttaattcgccagatggagggcgaaggtgtctttaagagtatccaacagctgacagtgactgaggagattgccgtcaaaaattggttggttagagtggggcgggaaaggctctcccgtatggcaataagcggagatgactgcgtcgtgaagccactggatgaccgattcgcttctgccctaaccgctcttaacgatatgggcaaagtgcgcaaggacatccagcagtgggagccctcgagaggctggaatgattggacgcaagtccctttttgctcacaccatttccacgaactgattatgaaagacgggcgggttctcgtggtaccatgtaggaaccaggatgagctgatcggacgcgccagaatcagccagggtgcaggctggtccttgcgggaaacagcgtgcttagggaagagttatgcccagatgtggtctctgatgtactttcacaggcgagacctccgtcttgctgccaatgcaatttgtagcgctgtgccgtcccattgggtccccacctcaagaactacatggagtatacacgccacccatgagtggatgactaccgaggatatgctgacagtgtggaaccgcgtttggatccaagaaaatccttggatggaggacaagacgccagtggaatcttgggaggaaattccctatctaggaaaacgggaggatcagtggtgcggcagcctgatcggtctcacctccagggcaacttgggccaagaacattcagacagcgatcaatcaggtcagatcattgatagggaacgaggaatacaccgactacatgcctagcatgaaacgcttccggagggaggaagaggaagctggagtgctgtggtga

SEQ ID NO: 14979 - RNA, 9876 nt, synthetic construct
  misc_feature 1..9876: note = derived and/or modified CDS sequence (opt3) from DENV-2__JN851125__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctaaaacaaaacgaaccggaggacattgattgttggtgcaattctacatcaacctgggtgacttatgggacatgtaccgccacgggagagcaccggcgcgaaaagcgaagtgtagcgctcgtgccccatgtcggcatgggtctggagactcgtaccgaaacatggatgagctccgagggggcttggaaacacgcccagagaatcgagacttgggtgcttaggcatcctggattcaccgttatggcagccatactggcttacacaatcggcaccacgtattttcagcgggtgttgattttcatcctcctgactgcagtcgccccatctatgacaatgcgctgcattggcatctcgaacagagactttgtggaaggggtatcaggaggtagctgggttgatatagtgctggagcacggcagttgtgtcaccactatggctaagaataagcccacactcgacttcgaattaattaaaaccgaggccaagcaccctgcgacgctgaggaaatactgcatcgaagcaaagcttaccaacacaactaccgcctcccggtgtccaacacagggggagccctctttgaatgaggaacaagataaacgctttgtgtgcaagcatagcatggtggaccgaggatggggcaacggttgtgggctgttcggaaagggcggcattgtcacttgcgctatgtttacctgcaaaaagaatatggaggggaaagttgtgcagcctgaaaacctagagtatacaatcgtaatcaccccacactccggagaagagaatgccgtgggtaacgatactggcaagcatgggaaagagattaaggtcacgccgcagtcaagtataacagaagcagagctcaccggatacggcactgtgaccatggaatgtagccccagaacaggtctggacttcaatgagatggttcttctgcagatggaaaacaaagcttggttggtgcacaggcaatggtttctcgatctgcctttaccatggctgcccggggccgacacccagggctctaactggatccagaaggagactctcgtcacattcaagaatcctcacgcgaaaaagcaggatgtggtagttcttggatcccaagagggcgccatgcatacggcactgaccggggctactgaaattcagatgtcaagcggaaacttgctatttacaggtcacctgaaatgccggctccgtatggacaagctgcagcttaaaggcatgagttattctatgtgtaccgggaagttcaaggtggtcaaagagatcgccgaaacacaacatggaactatagtgattcgcgtccagtacgagggcgacggttccccatgcaagatccccttcgagatcatggatctggaaaaaagacacgtgttggggaggctcattaccgttaatccgatcgtgacggagaaggacagccctgtaaacattgaagctgagcccccatttggcgattcgtacataatcattggagtcgaacctggccagctgaaattatcttggttcaagaaggggtcctcaatcggacagatgtttgagaccacaatgcggggtgccaaacgaatggcaatcctgggcgacactgcctgggatttcgggagtctaggaggcgtgtttaccagcattggtaaggctctccatcaagttttcggggcgatatatggcgcagccttttccggagtgtcttggacaatgaaaatcctgattggcgtcgtgatcacttggattgggatgaatagccgctcaaccagtctttccgtaagcttggtgctggttggagtcgtgacgctctacctgggcgtgatggtccaggctgactctggttgtgttgtgtcatggaagaacaaagagcttaagtgcgggagtggaatcttcataacagataatgtgcacacctggactgaacagtataagtttcagcccgagagcccatccaaactggcctctgcaatccaaaaggcccacgaagagggcatttgtggtatcagatcggtaacaaggttggaaaacctcatgtggaaacagattacccccgagctgaatcatatcttaagcgagaacgaagtcaagatgactataatgaccggcgacattaaagggatcatgcaggctggaaagcggtccctgcgccctcagccaacagagctaaaatactcatggaaggcctggggcaaggcaaaaatgctcagtacggaactgcacaatcataccttccttattgatgggccggagactgcggaatgccccaacacaaatagagcttggaactctttggaggtggaggactatggatttggcgttttcaccacaaatatctggctgaagctcaaagaaaggcaagatgtgagctgtgactccaagctgatgtcagccgcaataaaagacaaccgtgccgtccacgctgatatgggttactggatcgagagcgccttaaacgacacttggaagattgaaaaggcatcttttatcgaggtgaaatcctgccactggcctaagagtcataccctgtggagcaatggggttcttgagtctgaaatgattatcccaaaaaacttcgctggacccgtgtcccagcacaattatcggcctggctaccatacgcagacagccggtccatggcacttgggccgactcgagatggatttcgacttttgtgaagggaccactgtagtcgtgaccgaggattgcggaaacagaggcccctcactgaggacaactaccgcgagtgggaagctaataacagaatggtgctgtcgcagctgcacgctgccgcctctccggtacagaggagaggacggctgttggtatggtatggagattaggccactgaaagaaaaggaggaaaatcttgtgaactcgttggtcaccgccgggcatggacagatcgataatttctccctgggcgttttaggtatggctctctttctggaggaaatgcttcgcactcgagtgggcacaaagcacgcaatcctgttggtagccgtgtctttcgtcaccctcattactgggaacatgagctttcgggacctgggacgtgtgatggttatggtgggcgctacaatgaccgatgacatcgggatgggagtcacgtacctagccctgctcgcagcgttcaaagtgagacccacttttgccgctggcctgcttttgaggaagctgacctcaaaagagttaatgatgacaaccattggtatagttctcctgagtcaatccactatccctgagacaattcttgaactgaccgatgccctagcactcgggatgatggtgctgaaggtcgtacgcaatatggagaaatatcagttggctgtgacaatcatggccattctgtgcgttcccaacgcagtgatcttacagaatgcctggaaggtctcttgtactaccctcgctgtggtaagcgtgttcccactgcttctgacgtcctcacaacagaaggcggactggatacctttggccctcacaatcaaaggactgaaccccaccgcaatttttctaactaccctgagccggacaagtaagaaaagatcttggccacttaatgaagctatcatggccgtcggcatggtttccattctcgccagctcgctgttgaagaacgatatcccgatgactggccctctggtggctgggggattactcaccgtgtgctacgtcctgacgggtaggtcagcagaccttgagctggaacgagccgcggacgtgcgctgggaggagcaggctgaaatatctggcagttcccccattttgagcatcacaatctctgaggatgggagcatgtccattaaaaatgaagaggaggaacagaccctcactatactgatccggacaggactactggttatttcaggccttttcccagtaagtatccccattaccgccgcagcctggtatctctgggaggtgaagaaacaaagagctggtgtcctgtgggacgtgcctagcccaccccctgttgggaaggcagaattggaggatggagcctacaggatcaagcagaaaggcatattaggctattctcagatcggggcgggagtgtacaaggaaggtacttttcacacaatgtggcatgtcacccgtggcgctgtgctgatgcacaaagggaagcgcattgagccgtcctgggccgacgtaaaaaaggatctcatctcatacggaggcggttggaagctggagggggaatggaaagagggagaagaggtccaggtgcttgcactggaaccaggcaagaacccccgggccgttcaaacgaaacctggcttgttcaagactaacaccgggacaattggagctgtgagtctagactttagcccaggtacctccggctctcccatcgtcgataaaaaggggaaggtggttggactgtatggcaatggtgtggtcacaagatcggggacttacgtgagcgccatagcacagaccgagaaatcaattgaggacaaccctgaaatcgaggatgacatcttcaggaagaaacgactcacgattatggatctgcatccgggagctggcaagacaaaacggtatcttcccgccatcgtacgcgaagcgataaagagaggcttaaggactctgattctcgccccaacccgggtggttgcagctgagatggaagaggccttgcgagggctgcctatcagataccagacacccgctattcgcgcagagcacaccggaagggaaatcgtcgacctcatgtgtcatgccactttcaccatgcgtctgctttccccaatacgggtgcctaattataacctgattatcatggatgaggcccactttacagaccccgctagtatcgcggcaagaggttacatttctacgagggtggaaatgggcgaggccgctgggatcttcatgactgccaccccaccgggaagccgcgacccttttccccagtccaatgcaccaattatggatgaggaacgagagatacccgaaagatcatggaactctggccacgagtgggtcacagacttcaagggtaaaaccgtatggtttgtgcctagcatcaaggccgggaatgatattgctgcgtgcttgcggaaaaacggaaagaaagttatccaactaagtaggaagactttcgactccgaatatatcaagacacgcaccaatgattgggactttgtggtcacgactgatattagcgagatgggcgccaacttcaaagcagagcgtgtgatagacccaagacggtgtatgaagcccgttatcctgacagatggcgaagagagggtgattctcgctgggcctatgccggtcacccattcttcagccgcacagcgccgaggaagagtgggtcggaatccaaaaaacgaatccgaccagtacatctacatgggcgagcccttagaaaatgatgaggactgcgcccactggaaggaggctaaaatgctgcttgacaacattaatacccctgaagggatcatacccagtatgtttgagccagaaagggagaaggtagatgccatcgacggagaatatcgcctgagaggcgaggcgaggaaaactttcgtggatctcatgcggcgtggtgacttgcctgtttggctggcataccgcgtcgccgctgaggggattaactatgccgatcgaagatggtgttttgacggcgtgaagaacaatcaaatcctcgaagagaacgtggaagtcgagatttggacaaaggagggagaaaggaaaaagctgaaaccccggtggcttgatgctcgcatctacagcgacccactagcactgaaggagttcaaagaattcgccgctggcagaaagtcgttgaccttaaatctgataacagagatggggaggctccctacttttatgacgcagaaggcccggaacgcactggataatcttgcggttctgcataccgccgaagctggaggtcgagcctataaccacgcactctctgagttgccggagacactggaaactctactgctccttaccctgttagctacagtgaccggcgggattttcttgtttctgatgtccggaaaaggcatcggtaagatgactctcgggatgtgctgcattatcacggccagcatactgctttggtacgcacagatccagccccactggattgccgcttcaatcattctggagttctttctcatcgtattgctgataccagaacctgagaaacaaagaaccccccaggacaatcagttaacatatgtggtcattgcgatcctaactgtggttgccgcaaccatggctaacgaaatgggcttcctggagaagacaaaaaaggattttggactcggcagttctaccactcagcaacatgagtccaatatccttgacattgatctgcgcccagccagcgcctggacattgtacgcagtggctacgaccttcatcactcctatgctgaggcactcaatagaaaacagtagcgtcaatgtatccctcacagccattgcgaaccaggctaccgtgctgatggggcttggaaagggttggcccctctctaaaatggacatcggcgttccgctgttggccattgggtgttacagccaggtgaatccaatcaccctgacagcagccttactatccctggtcgctcattatgcaataatcggacctggcctccaggccaaggcgactcgggaggctcaaaaacgtgccgcagccggtattatgaagaaccccacggtggacgggatcaccgtcattgatcttgacccaatcccctacgatcctaaatttgaaaagcagctgggccaggtgatgttgctggttctctgcgtgacacaggtactgatgatgagaactacctgggctctttgtgaggccttaacactggcaaccggaccgatttcaactctctgggaaggcaatcccgggaggttctggaacacgacaatcgctgtgtctatggccaatatatttcgcggaagttatttggcgggcgccggtctgctattctcgattatgaagaacaccgcaaacactcggcgagggaccggaaatacaggcgagactctgggtgagaaatggaagaacagactcaatgctcttggcaaaagcgaatttcaaatctacaagaaatccgggatccaggaggtcgacaggaccctggccaaggaaggaattaaacgcggcgagacagatcaccatgcagtttctcgggggtcagctaagttgagatggttcgtggagcgtaacctggtcacgccagaaggaaaggtggtagacctcggctgcggtagggggggatggagctattactgtggcggtctgaaaaatgtgaaggaggttaaaggcttaaccaaggggggacctggccacgaagagcccatacctatgtccacttatgggtggaaccttgtgcggctgcagagtggagtcgatgtgttctttacaccacccgaaaaatgcgacaccctcctatgtgatatcggcgagtctagccctaatccaactgtcgaggccggtcgcacactgcgagtgttgaacctggttgaaaattggctcaacaataacacccaattctgcattaaggtacttaatccctacatgccgtcagtgatcgagaagatggaagccctgcagagaaaatacgggggagcgttggtcaggaaccctctgtcccggaatagtacgcacgagatgtattgggtgagcaacgcttctggcaacattgtttcctcagtgaatatgatcagccgcatgctcataaacagatttaccatgaggcataagaaagcaacatacgaaccagacgtcgatttaggctcggggactcgaaatatcggaattgagtctgagacccccaacctggacatcattggtaagcggatcgaaaaaataaagcaggagcacgaaacaagttggcattatgatcaggaccacccttacaagacttgggcctatcacggctcctacgagaccaaacaaacagggagcgcttcatccatggtgaatggagtagtgcgtcttctgaccaagccatgggacgttattcccatggtcactcagatggccatgacggatacaaccccgttcggccagcagagagtgtttaaagaaaaggtggacactcgcacccaagagcctaaagagggtacaaagaagctaatgaaaatcacggcagaatggctctggaaggagctggggaaaaagaaaacccccaggatgtgtactcgggaagagttcacaagaaaggtccgctctaacgccgctttgggagcgatctttaccgatgagaataaatggaagagcgccagggaagcagttgaggacagtggcttctgggaactggtggataaggagcgaaacctccatcttgaaggcaaatgcgagacttgtgtatataatatgatggggaagcgggagaaaaagctgggagaatttggtaaagctaagggctccagagccatttggtacatgtggttaggggcaaggttcctggagtttgaagccttgggattcctcaacgaggaccactggtttagccgcgaaaattctctgtcaggcgtggagggtgaggggctacataagcttggatacatactgcgtgatgtcagtaaaaaggaaggcggcgctatgtatgccgacgatacagcggggtgggacacccggatcacactcgaggatctgaaaaacgaagagatggtgactaatcacatggaaggagagcataagaaattggcagaggccattttcaagctgacctaccagaacaaggttgtgagagtccagaggccaacgcctcgcggtaccgtgatggacatcatttcccgacgggaccagagaggcagcgggcaagtagttacatatggactcaatactttcaccaacatggaagctcagcttatcaggcagatggagggcgaaggtgtgtttaaatctatacaacagctgacagccactgaggagatcgcagtcaagaactggttagtgcgcgtggggagagaacggctgtcgaggatggctatttcaggagatgactgcgtcgttaaacccttggatgaccgtttcgccagcgctctcaccgccctgaatgatatgggcaaggtgcgaaaagacatccagcagtgggagccatcccgcggctggaacgattggacgcaagtacccttttgcagtcaccacttccatgaactaattatgaaggacgggagagtgcttgtcgtgccttgtcggaatcaggatgagctgatcggaagggcacgcatttctcagggtgcgggctggagcctcagagaaacagcctgcctggggaagtcctacgctcagatgtggtcattgatgtattttcaccggagggacttacgactggccgcaaacgctatatgtagtgccgttccatctcattgggtgccgaccagccgtactacatggtccatccacgcaacccacgagtggatgactaccgaggatatgctcacagtctggaatagagtgtggattcaagaaaacccctggatggaggacaaaacgcctgtagaatcatgggaggaaatcccataccttggaaagcgcgaggatcagtggtgcggcagcctgatcggtctaacctctcgggccacttgggcgaaaaatattcagacagctataaaccaggttaggtccctgatcgggaatgaggaatataccgactacatgcccagtatgaagagattccgccgggaggaagaggaagccggagtgctctggtga

SEQ ID NO: 14980 - RNA, 9876 nt, synthetic construct
  misc_feature 1..9876: note = derived and/or modified CDS sequence (opt3) from DENV-2__JN851123__SS-prME
  source 1..9876: mol_type = other RNA
accgcaggcatcattataatgatgatcccaacggtgatggctttccacctgactacgaggaacggggaacctcatatgattgtcagcaggcaggaaaagggaaaatccctcctttttaagaccgagaatggtgttaacatgtgcacactgatggcaatggacttgggcgaattatgtgaggatactatcacctacaattgcccactgctgaaacaaaacgaaccggaggacattgattgttggtgcaattctacatcaacctgggtgacttatgggacatgtaccgccacgggagagcaccggcgcgaaaagcgaagtgtagcgctcgtgccccatgtcggcatgggtctggagactcgtaccgaaacatggatgagctccgagggggcttggaaacacgcccagagaatcgagacttgggtgcttaggcatcctggattcaccataatggcagccatcctggcttacacaattggcaccacgtattttcagcgggttttgatcttcattctcctgactgcagtggccccatctatgacaatgcgctgcatcggcatatcgaacagagactttgtcgaaggggtgtcaggaggtagctgggtagatattgttctggagcacggcagttgtgtgaccactatggctaagaataagcccacactcgacttcgaattaatcaaaaccgaggccaagcaccctgcgacgctgaggaaatactgcattgaagcaaaacttaccaacacaactaccgcctcccggtgtccaacacagggggagccctctttgaatgaggaacaagataaacgctttgtctgcaagcatagcatggtggaccgaggatggggcaacggttgtgggctgttcggaaagggcggcatcgtgacttgcgctatgtttacctgcaaaaagaatatggaggggaaaatcgtccagcctgaaaacctagagtatacaattgttataaccccacactccggagaagagaatgccgtgggtaacgatactggcaagcatgggaaagagatcaaggtaacgccgcagtcaagtattacagaagcagagctcaccggatacggcactgtgaccatggaatgtagccccagaacaggtctggacttcaatgagatggtccttctgcagatggaaaacaaggcttggttggtgcacaggcaatggtttctcgatctgcctttaccatggctgcccggggccgacacccagggctctaactggatccagaaggagactctcgttacattcaagaatcctcacgcgaaaaagcaggatgtggtcgtgcttggatcccaagagggcgccatgcatacggcactgaccggggctactgaaatacagatgtcaagcggaaacttgctatttacaggtcacctgaaatgccggctccgtatggacaagctgcagcttaaaggcatgagttattctatgtgtaccgggaagttcaaggtagttaaagagattgccgaaacacaacatggaactatcgtgatccgcgtccagtacgagggcgacggttccccatgcaagattcccttcgagatcatggatctggagaagagacacgtgttggggaggctcattaccgtcaatccgatagtgacggagaaggacagccctgttaacatcgaagctgagcccccatttggcgattcgtacattatcatcggagtggaacctggccagctgaaattatcttggttcaagaaggggtcctcaattggacagatgtttgagaccacaatgcggggtgccaaacgaatggcaatactgggcgacactgcctgggatttcgggagtctaggaggcgtatttaccagcatcggtaaggctctccatcaagtcttcggggcgatttatggcgcagccttttccggagtgtcttggacaatgaaaatcctgattggcgttgtgatcacttggatagggatgaatagccgctcaaccagtctttccgtcagcttggtgctggtaggagtggttacgctctacctgggcgtcatggtgcaggctgactctggttgtgtggtctcatggaagaacaaagagcttaagtgcgggagtggaatcttcattacagataatgttcacacctggactgaacagtataagtttcagcccgagagcccatccaaactggcctctgcaatccaaaaggcccacgaagagggcatttgtggtatcagatcggtgacaaggttggaaaacctcatgtggaaacagataacccccgagctgaatcatattttaagcgagaacgaaatcaagctgactattatgaccggcgacatcaaagggataatgcaggctggaaagcggtccctacgccctcagccaacagagctcaaatactcatggaaggcctggggcaaggcaaaaatgctgagtacggaacttcacaatcataccttcttgatcgatgggccggagactgcggaatgccccaacacaaatagagcttggaactctctggaggtggaggactatggatttggcgtattcaccacaaatatttggctcaagctgaaagaaaggcaagatgtcttttgtgacagcaagttaatgtccgccgcaatcaaagacaaccgtgccgtgcacgctgatatgggttactggattgagtcagccctgaacgacacttggaagatcgaaaaggccagcttcatagaggttaaatcttgccactggcctaagtcccataccctttggagtaatggggtgttggagagcgaaatgattatccccaagaacttcgctggacccgtctctcagcacaattatcggcctggctaccatacgcagacagccggtccatggcacctcggccgactggagatggattttgacttctgtgaagggaccactgtggttgtgaccgaggattgcggaaacagaggcccctccctaaggacaactaccgcgtcagggaagctgatcacagaatggtgctgtcgcagttgcacgctcccgcctctgcggtacagaggagaggacggctgttggtatggtatggagattaggccacttaaagaaaaggaggaaaatttggtaaacagcctggtcaccgccgggcatggacagatcgataatttttcgttaggcgtgctcggtatggctctgttccttgaggaaatgctgcgcactcgagtgggcacaaagcacgcaattttgctcgtcgccgtttcctttgtgaccctgataactgggaacatgtctttccgggacctaggacgtgtaatggtgatggtcggcgctacaatgaccgatgacatcgggatgggagtgacgtacctggccctcctggcagcgtttaaagttagacccactttcgccgctggccttttgctgaggaagttaaccagcaaagagctcatgatgacaaccattggtatcgtgctgctttcacaaagtactattcctgagacaatcctggaactaaccgatgccctcgcactggggatgatggtcttgaagatagtgcgcaatatggagaaatatcagctggctgttacaatcatggccattttatgcgtgcccaacgcagtcatcctccagaatgcctggaaggtatcctgtactaccctggctgtggtttctgtgagcccacttctgttgacgtcctcacaacagaaggcggactggattcctctcgccctgacaatcaaaggactaaaccccaccgcaatatttctgactacccttagccggacaagtaagaaaagatcttggccactcaatgaagctattatggccgtcggcatggtgtccatcctggccagctcgttgctgaagaacgatatcccgatgactggccctttagtagctgggggactcctgaccgtgtgctacgtccttacgggtaggtcagcagacctggagttggaacgagccgcggacgttcgctgggaggagcaggctgaaatttctggcagttcccccatactcagcatcacaatttctgaggatgggagcatgtccatcaaaaatgaagaggaggaacagaccctgactattctaatccggacaggactgcttgtgatatcaggcctcttcccagtgagtatccccattaccgccgcagcctggtatctgtgggaggtcaagaaacaaagagctggtgtgttgtgggacgttcctagcccaccccctgtagggaaggcagaattagaggatggagcctacaggatcaagcagaaaggcattctgggctattctcagatcggggcgggagtgtacaaggaaggtacttttcacacaatgtggcatgtcacccgtggcgctgtgctcatgcacaaagggaagcgcatagagccgtcctgggccgacgttaaaaaggatctgatttcatacggaggcggttggaaacttgagggggaatggaaagagggagaagaggtgcaggtcctggcattggaaccaggcaagaacccccgggccgtgcaaacgaaacctggcctattcaagactaacaccgggacaatcggagctgtaagtctggactttagcccaggtacctccggctctcccatcgtcgataaaaaggggaaggtggttggactctatggcaatggtgtggtcacaagatcggggacttacgtgagcgccattgcacagaccgagaaatcaatcgaggacaaccctgaaatagaggatgacattttcaggaagaaacgactgacgatcatggatcttcatccgggagctggcaagacaaaacggtatttacccgccattgttcgcgaagcgatcaagagaggcctgaggactctcatattggccccaacccgggtggtcgcagctgagatggaagaggccctgcgagggctccctattagataccagacacccgctatccgcgcagagcacaccggaagggaaatcgtggacctgatgtgtcatgccactttcaccatgcgtcttctgtccccaattcgggtacctaattataacttgatcattatggatgaggcccactttacagaccccgctagtatagcggcaagaggttacatctctacgagggtggaaatgggcgaggccgctgggattttcatgactgccaccccaccgggaagccgcgacccttttccccagtccaatgcaccaatcatggatgaggaacgagagatccccgaaagatcatggaactctggccacgagtgggttacagacttcaagggtaaaaccgtctggtttgtgcctagcattaaggccgggaatgatatagctgcgtgcctacggaaaaacggaaagaaagtgatccaactgagtaggaagactttcgactccgaatatattaagacacgcaccaatgattgggactttgtcgtaacgactgatatcagcgagatgggcgccaacttcaaagcagagcgtgtgattgacccaagacggtgtatgaagcccgttatcctcacagatggcgaagagagggtgatattagctgggcctatgccggtcacccattcttcagccgcacagcgccgaggaagagtgggtcggaatcccaagaacgaaaatgaccagtacatctacatgggcgagcccctggaaaacgatgaggactgcgcccactggaaggaggctaaaatgcttctggacaatattaacacccctgaagggatcattccctccatgtttgagccagaaagggagaaggttgatgccatcgacggagaatatcgcctcagaggcgaggcgaggaaaactttcgtggatttgatgcggcgtggtgacctgcctgtctggctcgcataccgcgtggccgctgaggggataaactatgccgatcgaagatggtgttttgacggcgtaaagaataaccaaattctggaagagaatgtggaagttgagatctggacaaaggagggagaaaggaagaaacttaaaccccggtggctagatgctcgcatttacagtgacccactggcattgaaagagttcaaagagttcgccgctggcagaaagagcttaaccctgaacctcatcacagagatggggaggctgcctacttttatgacgcagaaggcccggaatgcacttgataacctggcggtcctccataccgccgaagctggaggtcgagcctataatcacgcattgtcggagctgccggagacactagaaactctgctccttctgaccttattggctacagtgaccggcgggatattcctgtttctcatgtctggaaaaggcatcggtaagatgactctggggatgtgctgcattatcacggcctccattcttctgtggtacgcacagatccagccccactggatagccgctagcattatcctcgagttctttttgatcgtgctgttaattccagaacctgagaaacaaagaacaccacaggacaaccagctaacatatgtcgttatcgcgatactgactgtggtagccgcaaccatggctaatgaaatgggcttcctcgagaagaccaaaaaggattttggacttggctcaattaccactcagcaaccagagagtaacatcctggacattgatttgcgccctgcctctgcctggacactgtacgcagtggctacgaccttcatcactcccatgctcaggcattccatagaaaatagctcagtcaacgtgagtctgacagccatcgcgaatcaggctaccgttcttatggggctcggaaagggttggccgctgagcaaaatggacattggcgtgccattgctggccatcgggtgttactcccaggtcaaccctattaccttaacagcagccctactgctccttgtagctcactatgcaatcattggacccggcctgcaggccaaggcgactcgggaggctcaaaaacgtgccgcagccggtatcatgaagaatccaacggtggacgggataaccgttattgatttggaccccatcccttacgatccgaaatttgaaaagcagctgggccaggtgatgctcctggtcctttgcgtgacacaggtcttaatgatgagaactacctgggctctgtgtgaggccctcacattggcaaccggacccatctctactctgtgggaaggcaacccagggaggttctggaatacgacaattgctgtgagcatggccaacatatttcgcggatcctatctagcgggcgccggtctactcttctcaatcatgaagaacaccgcaaatactcggcgagggaccggaaacacaggcgagactcttggtgagaaatggaagaatagactgaacgctttgggcaaatctgaatttcaaatttacaagaaaagtgggatccaggaggttgacaggaccctggccaaggaaggaattaaacgcggcgagacagatcatcacgcagtgtcgcgggggagcgctaagctcagatggttcatcgagcgtaatctggtaacgcctgaaggaaaggtggtcgacttaggctgcggtagagggggatggtcctattactgtggcggtcttaaaaacgttaaggaggtgaaaggcctgaccaaagggggacccggccatgaagaacctataccaatgtctacttatgggtggaatctcgtccggctacagtcaggagtggatgtattctttacaccccctgaaaaatgcgacaccctgttgtgtgatatcggcgagagctccccaaaccccactgtggaggccggtcgcacactgcgagttctcaatcttgtggaaaactggctgaataacaatacccaattctgcattaaggtcttgaacccgtacatgcctagtgtgatcgagaagatggaagccctgcagagaaaatacgggggagcgctcgtcaggaatccattatctcggaacagcacgcacgagatgtattgggtgtcaaacgcttccggcaatattgttagtagcgtaaacatgatctctcgcatgctgataaatagatttaccatgaggcacaagaaagcaacatacgaacccgacgtggatcttggctccgggactcgaaacattggaatcgagtcagagacccctaatctggacatcattggtaagcggatagagaaaatcaagcaggaacatgaaacaagctggcactatgatcaggaccatccatacaagacttgggcctatcacggctcgtacgagaccaaacaaacagggtctgctagttccatggtcaacggagtggttcgtctactcaccaagccctgggacgtgattccgatggtcactcagatggccatgacggatacaacccctttcggccagcagagagtgtttaaagaaaaggtagacactcgcacccaagagcccaaagagggtacaaagaagctgatgaaaatcacggcagaatggttgtggaaggagctggggaaaaagaaaaccccaaggatgtgtactcgggaagagttcacaagaaaggtgcgcagcaatgccgctctcggagcgatttttaccgatgagaacaaatggaagtcagccagggaagcagttgaggactccggcttctgggaacttgtcgataaggagcgaaatctgcacttagaaggcaaatgcgagacttgtgtgtataacatgatggggaagcgggagaaaaagctgggagaatttggtaaagctaagggctctagagccatctggtacatgtggttgggggcaaggttcctcgagtttgaagccctgggattcctaaatgaggaccattggtttagccgcgaaaacagtctttccggcgtggagggtgaggggctgcacaagctcggatacatactgcgtgatgtcagcaaaaaggaaggcggcgctatgtatgccgacgatacagcggggtgggacacccggatcacattggaggatctgaaaaatgaagagatggttactaaccatatggaaggagagcacaagaaactcgcagaggccattttcagacttacctaccagaataaggtggtaagggtgcagcgccctacgccccgaggtaccgtcatggacatcatttctcggagagaccagaggggctcagggcaagtggttacatatggactgaacactttcaccaacatggaagctcagttaatccgccagatggagggcgaaggtgtgtttaagagtattcaacatctgacagtcactgaggagatagccgtgaaaaattggttggtaagagttgggcgggaaaggctctcccgtatggcaatcagcggagatgactgcgtggtcaagccactggatgaccgattcgcttctgccctaaccgctcttaacgatatgggcaaagtgcgcaaggacattcagcagtgggagccctcgagaggctggaatgattggacacaggtgcctttttgctcacaccacttccatgaactgatcatgaaagacgggcgggtcctcgttgtgccatgtaggaaccaagatgagctgatcggacgcgccagaattagccagggtgcaggctggtccttgcgggaaacagcgtgcttagggaagagttacgcccagatgtggtctctgatgtattttcacaggcgagacctccgtcttgctgccaatgcaatatgtagcgctgtaccgtcccattgggtgcccacctcaagaactacatggagtatccacgccacccacgagtggatgactaccgaggatatgctgacagtctggaaccgcgtgtggattcaggaaaatccttggatggaggacaagacgccaatcgaatcttgggaggaaattccctacctaggaaaacgggaggatcaatggtgcggcagcctgatcggtctcacctccagggcaacttgggccaagaacatacagacagcgatcaatcaggttagatcattgattgggaacgaggaatataccgactacatgcctagcatgaaacgcttccggagggaggaagaggaagctggagtgctgtggtga

SEQ ID NO: 14981 - RNA, 9876 nt, synthetic construct
  misc_feature 1..9876: note = derived and/or modified CDS sequence (opt3) from DENV-2__JN851118__SS-prME
  source 1..9876: mol_type = other RNA
accgccggaatcattataatgatgatccccacagtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgttgcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgaggtgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacaccctgcgacgctgcggaagtactgcgtggaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaaggtcgttcagcctgaaaacctagagtatacaatcgtgattaccccacactccggagaagagaatgccgtaggtaacgatactggcaaacatgggaaggagataaaagtgacgccgcagtcaagtatcacagaagcagagctcaccggatacggcactgtcaccatggaatgtagccccaggacaggtctggacttcaatgagatggtgcttctgcagatggaaaacaaggcttggttggttcaccggcaatggtttctcgatctgcctttaccatggctgcccggggccgacacccagggctctaactggattcagaaagagactctcgtgacattcaagaatcctcacgcgaagaaacaggatgtcgtggtacttggatcccaagagggcgccatgcatacggcactgaccggggctactgaaatccagatgtcaagcggaaacttgctatttacaggtcacctgaagtgccgtctccgcatggacaaactgcagcttaagggcatgagttattctatgtgtaccgggaaattcaaggttgtgaaggagatagccgaaacacaacatggaactattgtcatcagagtgcagtacgagggcgacggttccccatgcaaaatccccttcgagattatggatctggaaaagaggcacgtcttggggcggctcatcaccgtgaatccgattgttacggagaaagacagccctgtgaacatagaagctgagcccccatttggcgattcgtacatcattatcggagtagaacctggccagctgaagttatcttggttcaaaaaggggtcctcaatcggacagatgtttgagaccacaatgcgaggtgccaagcgcatggcaattctgggcgacactgcctgggatttcgggagtctaggaggcgtctttaccagcataggtaaagctctccatcaagtgttcggggcgatctatggcgcagccttttccggagtttcttggacaatgaagattctgatcggcgtggtcattacttggatcgggatgaatagcagatcaaccagtctttccgtgagcttggtactggtgggagttgtcacgctctacctgggcgtgatggtgcaggctgactctggttgtgtcgtttcatggaaaaacaaggagcttaaatgcgggagtggaatattcatcacagataatgtgcacacctggactgaacagtataagtttcagcccgagagcccatccaagctggcctctgcaattcaaaaagcccacgaagagggcatctgtggtattaggtcggtgacacggttggaaaacctcatgtggaagcagatcacccccgagctgaatcatatattaactgagaacgaagtaaaactgaccattatgacaggcgacatcaaggggattatgcaggctggaaaacgcagcctaagacctcagccaacggagctcaagtactcctggaaagcctggggcaaggcaaagatgctgtcaaccgaacttcacaatcatactttcttgatcgatgggccggagacagcggaatgccccaacaccaatagggcttggaacagtctggaggtcgaggactatggatttggcgtgttcacaactaatatatggctcaaactgaaggaacgtcaagatgtattttgtgactctaaattaatgagcgccgcaatcaaggacaaccgggccgtgcacgctgatatgggttactggattgagtccgccctgaacgacacctggaaaatcgaaaaggcatcattcattgaggtcaagagctgccactggcctaaatctcatacgctttggtccaatggggtgttggagagtgaaatgatcataccaaagaacttcgctggacccgttagccagcacaattatcgacctggctaccatacacagaccgccggtccatggcacctcggcagactggagatggattttgacttctgtgaagggactaccgtggtagtcacagaggattgcggaaacaggggcccctctctacgcactaccacagcgtccgggaaactgattacggaatggtgctgtcggtcatgcaccctcccgcctctgagatacaggggagaggacggctgttggtatggtatggagatccgcccacttaaggaaaaagaggaaaatttggtgaacagtctggtgactgccgggcatggacagatcgataattttagcttaggcgtcctcggtatggctctgttccttgaggaaatgctgcgaacacgggttggcaccaagcacgcaattttgctcgtggccgtatcgtttgtgactctgatcacagggaacatgtccttccgtgacctaggaagagtcatggtgatggttggcgctaccatgacggatgacattgggatgggagtgacttacctggccctcctggcagcgtttaaggtcaggcccaccttcgccgctggccttttgctgcgcaaattaacatctaaggagctcatgatgaccactataggtatcgtgctgcttagccaatcaacaattcctgagagtatcctggaactaaccgatgccctcgcactggggatgatggttttgaaaattgtgcggaatatggagaagtatcagctggctgtcacaatcatggccatattatgcgtacccaacgcagtgatcctccagaatgcctggaaagtttcctgtactaccctggctgtggtctctgtgagcccacttctgttgacgtcctcacaacagaaggcggactggattcctctcgccctgacaatcaagggactaaaccccaccgcaatttttctgactacccttagcagaacaagtaaaaagaggtcttggccactcaatgaagctatcatggccgtaggcatggtgtccatactggccagctcgttgctgaaaaacgatattccgatgactggccctttagtcgctgggggactcctgaccgtttgctacgtgcttacgggtcgatcagcagacctggagttggaacgcgccgcggacgtgcggtgggaggagcaggctgaaatctctggcagttcccccatcctcagcattacaatatctgaggatgggagcatgtccatcaagaatgaagaggaggaacagaccctgactattctaatcagaacaggactgcttgtcatttcaggcctcttcccagtgagtatccccataaccgccgcagcctggtatctgtgggaggttaaaaagcaaagggctggtgtattgtgggacgtgcctagcccaccccctgtcgggaaagcagaattagaggatggagcctaccgtatcaagcagaagggcattctgggctattctcagatcggggcgggagtgtacaaagaaggtacttttcacacaatgtggcatgttacccgcggcgctgtgctcatgcacaaggggaaacggattgagccgtcctgggccgacgtcaagaaagatctgatctcatacggaggcggttggaaacttgagggggaatggaaggagggagaagaggtgcaggtactggcattggaaccaggcaaaaaccccagagccgtccaaacgaagcctggcctattcaaaactaacaccgggacaataggagctgtgagtctggactttagcccaggtacctccggctctcccattgttgataagaaagggaaggtggtcggactctatggcaatggtgtggttacaaggtcggggacttacgtgagcgccatcgcacagaccgagaagtcaatcgaggacaaccctgaaattgaggatgacatcttcagaaagaaacggctgacgataatggatcttcatccgggagctggcaaaacaaagcgctatttacccgccattgtcagagaagcgatcaaaaggggcctgcggactctcattttggccccaacccgagtggtagcagctgagatggaagaggccctgagagggctccctatccgctaccagacacccgctataagggcagagcacaccggacgtgaaattgtggacctgatgtgtcatgccactttcaccatgcggcttctgtccccaatcagagttcctaattataacttgatcattatggatgaggcccactttacagaccccgctagtatcgcggcaaggggttacatttctacgcgcgtcgaaatgggcgaggccgctgggatattcatgactgccaccccaccgggaagccgagacccttttccccagtccaatgcaccaatcatggatgaggaaagagagattcccgaacggtcatggaactctggccacgagtgggtgacagacttcaagggtaagaccgtgtggtttgtccctagcatcaaagccgggaatgatatcgctgcgtgcctaaggaagaacggcaagaaggtaattcaactgagtcgcaaaactttcgactccgaatatataaagacacgtaccaatgattgggactttgtggttacgactgatatcagcgagatgggcgccaacttcaaggcagagagagtgattgacccacggaggtgtatgaaacccgtcatcctcacagatggcgaagaacgcgtgattttagctgggcctatgccggttacccattcttcagccgcacagcgaagaggacgggtgggtaggaatccaaagaacgaaaatgaccagtacatctacatgggcgagcccctggaaaacgatgaggactgcgcccactggaaagaggctaagatgcttctggacaatataaacacccctgaagggatcattccctccatgtttgagccagaacgcgagaaagtcgatgccatcgacggagaatatagactcaggggcgaggcgcggaagactttcgtggatttgatgcgtcgcggtgacctgcctgtatggctcgcataccgagtggccgctgaggggattaactatgccgatagaaggtggtgttttgacggcgttaaaaataaccaaatcctggaagagaatgtcgaagtggagatatggacaaaggagggagaacggaagaaacttaagccccgctggctagatgctagaatttacagtgacccactggcattgaaagagttcaaggagttcgccgctggcaggaagtcgttaaccctgaacctcatcacagagatggggcggctgcctacttttatgacgcagaaggccaagaatgcacttgataacctggcggtgctccataccgccgaagctggaggtcgagcctataatcacgcattgagcgagctgccggagacactagaaactctgctccttctgaccttattggctacagtcaccggcgggattttcctgtttctcatgtctggaaaaggcatcggtaagatgactctggggatgtgctgcataatcacggcctccattcttctgtggtacgcacagatccagccccactggattgccgctagcatcatactcgagttctttttgattgttctgttaatcccagaacctgagaaacaaagaacaccccaggacaaccagctaacatatgtggtaatcgcgattctgactgtggtcgccgcaaccatggctaatgaaatgggcttcctcgagaagaccaagaaggattttggacttggctcaatcaccactcagcaaccagagagtaacatactggacattgatttgcgccctgcctctgcctggacactgtacgcagtggctacgaccttcatcactcccatgctcaggcattccattgaaaatagctcagttaacgtgagtctgacagccatcgcgaatcaggctaccgtccttatggggctcggaaagggttggccgctgagcaaaatggacataggcgtaccattgctggccatcgggtgttactcccaggtgaaccctattaccttaacagcagccctactgctccttgttgctcactatgcaatcattggacccggcctgcaggccaaggcgactcgggaggctcaaaaacgtgccgcagccggtatcatgaagaatccaacggtggacgggatgaccgtcattgatttggaccccatcccttacgatccgaaatttgaaaagcagctgggccaggtgatgctcctggtcctttgcgtgacacaggttttaatgatgagaactacctgggctctgtgtgaggccctcacattggcaaccggacccatatctactctgtgggaaggcaacccagggaggttctggaatacgacaattgctgtgagcatggccaacatctttcgcggatcctatctagcgggcgccggtctactcttctcaatcatgaagaacaccgcaaatactcggcgagggaccggaaacacaggcgagactcttggtgagaaatggaagaatagactgaacgctttgggcaaatctgaatttcaaatttacaagaaaagtgggatacaggaggtagacaggaccctggccaaggaaggaatcaaacgcggcgagacagatcatcacgcagtgtcgcgggggagcgctaagctcagatggttcgtcgagcgtaatctggttacgcctgaaggaaaggtggtcgacttaggctgcggtagagggggatggtcctattactgtggcggtcttaaaaacgtgaaggaggtaaaaggcctgaccaaagggggacccggccatgaagaacctattccaatgtctacttatgggtggaatctcgtgcggctacagtcaggagttgatgtgttctttacaccccctgaaaaatgcgacaccctgttgtgtgatatcggcgagagctccccaaaccccactgtcgaggccggtcgcacactgcgagtgctcaatcttgtcgaaaactggctgaataacaatacccaattctgcattaaggtgttgaacccgtacatgcctagtgttatcgagaagatggaagccctgcagagaaaatacgggggagcgctcgtaaggaatccattatctcggaacagcacgcacgagatgtattgggtgtcaaacgcttccggcaatatagtcagtagcgtgaacatgatctctcgcatgctgattaatagatttaccatgaggcacaagaaagcaacatacgaacccgacgttgatcttggctccgggactcgaaacatcggaattgagtcagagacccctaatctggacatcataggtaagcggattgagaaaatcaagcaggagcatgaaacaagctggcactatgatcaggaccatccatacaagacttgggcctatcacggctcgtacgagaccaaacaaacagggtctgctagttccatggtgaacggagtcgtgcgtctactcaccaagccctgggacgtaatcccgatggtgactcagatggccatgacggatacaacccctttcggccagcagagagtttttaaagaaaaggtcgacactcgcacccaagagcccaaagagggtacaaagaagctgatgaaaattacggcagaatggttgtggaaggagctggggaaaaagaaaaccccaaggatgtgtactcgggaagagttcacaagaaaggtgcgcagcaatgccgctctcggagcgatatttaccgatgagaacaaatggaagtcagccagggaagcagtggaggactccggcttctgggaacttgtcgataaggagcgaaatctgcacttagaaggcaaatgcgagacttgtgtttataacatgatggggaagcgggagaaaaagctgggagaatttggtaaagctaagggctctagagccatctggtacatgtggttgggggcaaggttcctcgagtttgaagccctgggattcctaaatgaggaccattggtttagccgcgaaaacagtctttccggcgtggagggtgaggggctgcacaagctcggatacattctgcgtgatgtaagcaaaaaggaaggcggcgctatgtatgccgacgatacagcggggtgggacacccggatcacattggaggatctgaaaaatgaagagatggtgactaaccatatggaaggagagcacaagaaactcgcagaggccattttcaaacttacctaccagaataaggtcgtgagagttcagaggcctacgccccgcggtaccgtgatggacatcatatctcgacgggaccagagaggctcagggcaagtcgtgacatatggactgaacactttcaccaacatggaagctcagttaatcaggcagatggagggcgaaggtgtatttaaaagtattcaacagctgacagttaaggaggagatcgccgtgaaaaattggttgattcgcgtcgggagagaacggctctccaggatggcaatcagcggagatgactgcgtggtgaagccactggatgaccgtttcgcttctgccctaactgctcttaacgatatgggcaaagtccgaaaggacattcagcagtgggagccctcgcgcggctggaatgattggacccaagttcctttttgctcacatcacttccacgaactgataatgaaggacgggagagtgctcgtagtgccatgtcggaaccaggatgagctgatcggaagggcccgcattagccagggtgcaggctggtccttgagagaaacggcgtgcttagggaaaagttacgcccagatgtggtctctgatgtattttcatcggagggacctccgacttgctgccaatgcaatctgtagcgctgtcccgtcccactggatccccacatcacgtaccacttggagtattcatgccacacacgagtggatgaccactgaggatatgctgaccgtgtggaacagagtttggatacaagaaaatccttggatggaggacaagacaccagtggaatcttgggaggaaatcccctacctaggaaaacgcgaggatcagtggtgcggcagcctgattggtctcacgtcccgggcaacctgggccaagaacatccagactgcgattaatcaggtcaggtcattgatcgggaacgaggaatatacagactacatgcctagcatgaaaagattccgccgggaggaagaggaagctggagtgctgtggtga

SEQ ID NO: 14982 - RNA, 9876 nt, synthetic construct
  misc_feature 1..9876: note = derived and/or modified CDS sequence (opt3) from DENV-2__JN851124__SS-prME
  source 1..9876: mol_type = other RNA
accgccggcatcattattatgatgatccccacagtgatggctttccacctgactacgaggaacggggaacctcatatgattgtctcaaggcaggaaaagggaaaatccctcctttttaagaccgaaaatggtgttaacatgtgcacactgatggcaatggacttgggcgaattatgtgaagatactatcacctacaattgcccactgctaaaacaaaacgaaccggaagacattgattgttggtgcaattctacatcaacctgggtgacttatgggacatgtaccgccacgggagagcaccggcgcgaaaagcgaagtgtagcgctcgtgccccatgtcggcatgggtctggagactcgtaccgaaacatggatgagctccgagggggcttggaaacacgcccagagaatcgagacttgggtgatgaggcatcctggattcaccgttatggcagccatacttgcttacacaatcggcaccacgtattttcagcgggtgctgattttcatcttgctcactgcagtcgccccatctatgacaatgcgctgcattggcatctcgaacagagactttgtggaaggggtatcaggaggtagctgggttgatatagtgctggagcacggcagttgtgtcaccactatggctaagaataagcccacactggacttcgaactcattaaaaccgaggccaagcaccctgcgacgttaaggaaatactgcatcgaagcaaagctgaccaacacaactaccgcctcccggtgtccaacacagggggagccctctcttaatgaggaacaagataaacgctttgtgtgcaagcatagcatggtggaccgaggatggggcaacggttgtgggttgttcggaaagggcggcattgtcacttgcgctatgtttacctgcaaaaagaatatggaggggaaagttgtgcagcctgaaaacctggagtatacaatcgtaatcaccccacactccggagaagagaatgccgtgggtaacgatactggcaagcatgggaaagagattaaggtcacgccgcagtcaagtataacagaagcagagctaaccggatacggcactgtgaccatggaatgtagccccagaacaggtctcgacttcaatgagatggttctgcttcagatggaaaacaaggcttggctggtgcacaggcaatggtttttggatctccctctgccatggttacccggggccgacacccagggctctaactggatccagaaggagactctggtcacattcaagaatcctcacgcgaaaaagcaggatgtggtagttctcggatcccaagagggcgccatgcatacggcacttaccggggctactgaaattcagatgtcaagcggaaacctgttgtttacaggtcacctaaaatgccggctgcgtatggacaagctccagctgaaaggcatgagttattctatgtgtaccgggaagttcaaggtggtcaaagagatcgccgaaacacaacatggaactatagtgattcgcgtccagtacgagggcgacggttccccatgcaagatccccttcgagatcatggatcttgagaagagacacgtgctggggaggttgattaccgttaatccgatcgtgacggagaaggacagccctgtaaacattgaagctgagcccccatttggcgattcgtacataatcattggagtcgaacctggccagctcaaactgtcttggttcaagaaggggtcctcaatcggacagatgtttgagaccacaatgcggggtgccaaacgaatggcaatcttaggcgacactgcctgggatttcgggagtctgggaggcgtgtttaccagcattggtaaggctctacatcaagttttcggggcgatatatggcgcagccttttccggagtgtcttggacaatgaaaatcctcattggcgtcgtgatcacttggattgggatgaatagccgctcaaccagtctgtccgtaagccttgtgttggttggagtcgtgacgctgtacctcggcgtgatggtccaggctgactctggttgtgttgtgtcatggaagaacaaagagctgaagtgcgggagtggaatcttcataacagataatgtgcacacctggactgaacagtataagtttcagcccgagagcccatccaaacttgcctctgcaatccaaaaggcccacgaagagggcatttgtggtatcagatcggtaacaaggctggaaaacttgatgtggaaacagattacccccgagctcaatcatatcctgagcgagaacgaagtcaagatgactataatgaccggcgacattaaagggatcatgcaggctggaaagcggtccttacgccctcagccaacagagctgaaatactcatggaaggcctggggcaaggcaaaaatgctaagtacggaactccacaatcataccttcctgattgatgggccggagactgcggaatgccccaacacaaatagagcttggaactctcttgaggtggaggactatggatttggcgttttcaccacaaatatctggttgaagctgaaagaaaggcaagatgtgagctgtgactccaagctcatgtcagccgcaataaaagacaaccgtgccgtccacgctgatatgggttactggatcgagagcgccctgaacgacacttggaagattgaaaaggcatcttttatcgaggtgaaatcctgccactggcctaagagtcataccttatggagcaatggggttctggagtctgaaatgattatccccaaaaacttcgctggacccgtgtcccagcacaattatcggcctggctaccatacgcagacagccggtccatggcaccttggccgattggagatggatttcgacttttgtgaagggaccactgtagtcgtgaccgaggattgcggaaacagaggcccctcactcaggacaactaccgcgagtgggaagctgataacagaatggtgctgtcgcagctgcacgctaccgcctctgcggtacagaggagaggacggctgttggtatggtatggagattaggccactcaaagaaaaggaggaaaatctggtgaactcgcttgtcaccgccgggcatggacagatcgataatttctccttgggcgttctgggtatggctttatttctcgaggaaatgctgcgcactcgagtgggcacaaagcacgcaatccttctggtagccgtgtctttcgtcaccttgattactgggaacatgagctttcgggacctcggacgtgtgatggttatggtgggcgctacaatgaccgatgacatcgggatgggagtcacgtacctggccctactggcagcgttcaaagtgagacccacttttgccgctggcctcctgcttaggaagttgacctcaaaagagctgatgatgacaaccattggtatagttttactcagtcaatccactatccctgagacaattctggaacttaccgatgccctggcactagggatgatggtgctcaaggtcgtacgcaatatggagaaatatcagctggctgtgacaatcatggccattttgtgcgttcccaacgcagtgatcctgcagaatgcctggaaggtctcttgtactaccttagctgtggtaagcgtgtccccactcctgcttacgtcaagccaacagaaggcggactggatacctctggccttgacaatcaaaggactcaaccccaccgcaattttcctgactaccctaagtcggacatctaagaaaagatcctggccactgaatgaagctatcatggccgtcggcatggttagcattcttgcctcgtcactcctgaagaacgatatcccgatgactggccctttggtggctgggggactgttaaccgtgtgctacgtcctcacgggtaggtctgcagacctggagcttgaacgagccgcggacgtgcgctgggaggagcaggctgaaataagtggctccagccccattctgtctatcacaatcagcgaggatgggtccatgtcaattaaaaatgaagaggaggaacagaccttgactatactcatccggacaggactgctagttattagtggcctgtttccagtaagcatccccattaccgccgcagcctggtatctttgggaggtgaagaaacaaagagctggtgtcctctgggacgtgccttctccaccccctgttgggaaggcagaactggaggatggagcctacaggatcaagcagaaaggcatattgggctattcccagatcggggcgggagtgtacaaggaaggtactttccacacaatgtggcatgtcacccgtggcgctgtgttaatgcacaaagggaagcgcattgagccgtcatgggccgacgtcaaaaaggatctgatcagttacggaggcggttggaagctcgagggggaatggaaagagggagaagaggtccaggtgctggcacttgaaccaggcaagaacccccgggccgttcaaacgaaacctggcctgtttaagactaacaccgggacaattggagctgtgagcttggacttctccccaggtacctctggctcgcccatcgtcgataaaaaggggaaggtggttggactatatggcaatggtgtggtcacaagaagcgggacttacgtgtcagccatagcacagaccgagaaatccattgaggacaaccctgaaatcgaggatgacatctttaggaagaaacgactgacgattatggatctccatccgggagctggcaagacaaaacggtatctgcccgccatcgtacgcgaagcgataaagagaggccttaggactttaattctggccccaacccgggtggttgcagctgagatggaagaggccctccgagggttgcctatcagataccagacacccgctattcgcgcagagcacaccggaagggaaatcgtcgacctgatgtgtcatgccactttcaccatgcgtctcctgagtccaatacgggtgcctaattataaccttattatcatggatgaggcccacttcacagaccccgcttctatcgcggcaagaggttacattagcacgagggtggaaatgggcgaggccgctgggatctttatgactgccaccccaccgggatcccgcgaccctttcccccagtcaaatgcaccaattatggatgaggaacgagagatacccgaaagatcttggaacagcggccacgagtgggtcacagactttaagggtaaaaccgtatggttcgtgcctagtatcaaggccgggaatgatattgctgcgtgcctgcggaaaaacggaaagaaagttatccaattgtccaggaagacttttgacagcgaatatatcaagacacgcaccaatgattgggacttcgtggtcacgactgatatttctgagatgggcgccaactttaaagcagagcgtgtgatagacccaagacggtgtatgaagcccgttatcctaacagatggcgaagagagggtgattctggctgggcctatgccggtcacccattcatccgccgcacagcgccgaggaagagtgggtcggaatcccaaaaacgaaagtgaccagtacatctacatgggcgagcccctcgaaaatgatgaggactgcgcccactggaaggaggctaaaatgttactggacaacattaatacccctgaagggatcatacccagcatgttcgagccagaaagggagaaggtagatgccatcgacggagaatatcgccttagaggcgaggcgaggaaaacttttgtggatctgatgcggcgtggtgacctccctgtttggttggcataccgcgtcgccgctgaggggattaactatgccgatcgaagatggtgtttcgacggcgtgaagaacaatcaaatcctggaagagaacgtggaagtcgagatttggacaaaggagggagaaaggaaaaagctcaaaccccggtggctggatgctcgcatctactcggacccacttgcactaaaggagtttaaagagttcgccgctggcagaaagtctctgaccttgaatttaataacagagatggggaggctgcctactttcatgacgcagaaggcccggaacgcactcgataatctggcggttcttcataccgccgaagctggaggtcgagcctataaccacgcactgtccgagctcccggagacattggaaactctgctactgctcacccttctggctacagtgaccggcgggatatttttattcttgatgagcggaaaaggcatcggtaagatgactctggggatgtgctgcattatcacggcctcaatactcctgtggtacgcacagatccagccccactggattgccgctagtatcattcttgagtttttcctgatcgtactcttgataccagaacctgagaaacaaagaacaccacaggacaatcagctgacatatgtggtcattgcgatcttaactgtggttgccgcaaccatggctaacgaaatgggctttctagagaagaccaaaaaggatttcggactgggatcttccaccactcagcaacatgagagcaatatcctcgacattgatcttcgcccagcctcagcctggacactgtacgcagtggctacgacctttatcactcctatgttgaggcacagtatagaaaacagctccgtcaatgtatctctgacagccattgcgaaccaggctaccgtgctcatggggctgggaaagggttggccccttagcaaaatggacatcggcgttccgctcctggccattgggtgttactcccaggtgaatccaatcaccttgacagcagccctgttaagcctagtagctcattatgcaataatcggacctggcctgcaggccaaggcgactcgggaggctcaaaaacgtgccgcagccggtattatgaagaaccccacggtggacgggatcaccgtcattgatctcgacccaatcccctacgatcctaaattcgaaaagcagcttggccaggtgatgctgttggttctgtgcgtgacacaggtactcatgatgagaactacctgggctctgtgtgaggcccttacattagcaaccggaccgatttctactctgtgggaaggcaatcccgggaggttttggaacacgacaatcgctgtgagtatggccaatatattccgcggatcgtatctcgcgggcgccggtttgctgtttagcattatgaagaacaccgcaaacactcggcgagggaccggaaatacaggcgagactctaggtgagaaatggaagaacagactgaatgctctcggcaaatccgagttccaaatctacaagaaatctgggatccaggaggtcgacaggacccttgccaaggaaggaattaaacgcggcgagacagatcaccatgcagtttcacgggggagcgctaagctgagatggtttgtggagcgtaacttggtcacgccagaaggaaaggtggtagacctgggctgcggtagagggggctggtcctattactgtggcggtctcaaaaatgtgaaggaggttaaaggcctgaccaaagggggacctggccacgaagaaccaatacctatgagtacttatgggtggaacttagtgcggcttcagtctggagtcgatgtgttcttcacaccacccgaaaaatgcgacaccctgctctgtgatatcggcgagagctcacctaatccaactgtcgaggccggtcgcacactacgagtgctgaacttggttgaaaattggctgaacaataacacccaattttgcattaaggtactcaatccctacatgccgtccgtgatcgagaagatggaagcccttcagagaaaatacgggggagcgctggtcaggaaccctttgagtcggaatagcacgcacgagatgtattgggtgtctaacgcttccggcaacattgtttcaagcgtgaatatgatctcgcgcatgctgataaacagattcaccatgaggcataagaaagtcacatacgaaccagacgtggatctcggctctgggactcgaaatatcggaattgagagtgagacccccaacttagacatcattggtaagcggatcgagaaaataaagcaggagcacgaaacatcctggcattatgatcaggaccacccttacaagacttgggcatatcacggcagctacgagaccaaacaaacagggtcagcctcctctatggtaaatggagtggttcgtctgcttaccaagccatgggacgtcattcccatggtgactcagatggctatgacggatacaaccccgtttggccagcagagagtgttcaaagaaaaggtcgacactcgcacccaagagcctaaagagggtacaaagaagctgatgaaaatcacggccgaatggctatggaaggagctcgggaaaaagaaaacccccaggatgtgtactcgggaagagtttacaagaaaggttcgcagcaacgcagccctgggagctatcttcaccgatgagaataaatggaagagtgcgagggaagccgtggaggactccggcttttgggaattggtagataaggagcgaaacctgcatctcgaaggcaaatgcgagacttgtgtgtataatatgatggggaagcgggagaagaaacttggagagttcggtaaagcaaaaggcagcagagctatttggtacatgtggctgggggccaggtttttagagttcgaagcactgggatttttgaacgaggaccactggttctctcgcgaaaattcactcagtggcgtcgagggtgaggggctgcataagctaggatacatacttcgtgatgtgtccaaaaaggaaggcggcgccatgtatgctgacgatacagccgggtgggacacccggatcacactggaggatctcaaaaacgaagagatggttactaatcacatggaaggagagcataagaaactggcggaggcaatttttaagttgacctaccagaacaaggtggtcagagtgcagaggccaacgcctcgcggtaccgtaatggacatcattagccgacgggaccagagaggctctgggcaagttgtgacatatggactgaatactttcaccaacatggaagcccagctcatcaggcagatggagggcgaaggtgtcttcaaatcgatacaacagcttacagctactgaggagatcgccgtgaagaactggctggtgcgcgtcgggagagaacggttatcaaggatggcaattagcggagatgactgcgttgtgaaacccctggatgaccgttttgcttccgccttgaccgctctcaatgatatgggcaaggtacgaaaagacatccagcagtgggagccaagtcgcggctggaacgattggacgcaagtgcccttctgctctcaccactttcatgaactgattatgaaggacgggagagtcctagtggttccttgtcggaatcaggatgagcttatcggaagggcccgcattagccagggtgcaggctggtccctgagagaaacagcgtgcctcgggaagtcatacgcccagatgtggagtctgatgtatttccaccggagggacttgcgattagctgccaacgcaatatgttctgctgtgccaagccattgggtcccgacctcccgtactacatggtcaatccacgccacccacgagtggatgactaccgaggatatgctgacagtgtggaatagagtatggattcaagaaaacccctggatggaggacaaaacgcctgttgaaagctgggaggaaatcccatacctcggaaagcgcgaggatcagtggtgcggctctcttatcggtctgacctcccgggcaacttgggccaaaaatattcagacagcgataaaccaggtgaggagtctaatcgggaatgaggaatataccgactacatgcccagcatgaagagatttcgccgggaggaagaggaagctggagtcctgtggtga

SEQ ID NO: 14983 - RNA, 9876 nt, synthetic construct
  misc_feature 1..9876: note = derived and/or modified CDS sequence (opt3) from DENV-2__JN851114__SS-prME
  source 1..9876: mol_type = other RNA
accgccggaatcattataatgatgatccccacagtgatggctttccacctgactacgcgaaacggggaacctcatatgattgtcagcaggcaggaaaaggggaaatccctcctttttaagaccgaaaatggtgttaacatgtgcacactgatggcaatggacttgggagaattatgtgaagatactatcacctacaattgcccactgctgcggcaaaacgaaccggaggacattgattgttggtgcaattctacatcaacctgggtgacttatgggacatgtaccgccacgggagagcaccgccgagaaaaacgtagtgttgcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacaccctgcgacgctgcggaagtactgcgtggaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaaggtcgttcagcctgaaaacctagagtatacaatcgtgattaccccacactccggagaagagaatgccgtaggtaacgatactggcaaacatgggaaggagataaaagtgacgccgcagtcaagtatcacagaagcagagctcaccggatacggcactgtcaccatggaatgtagccccaggacaggtctggacttcaatgagatggtgcttctgcagatggaaaacaaggcttggttggttcaccggcaatggtttctcgatctgcctttaccatggctgcccggggccgacacccagggctctaactggattcagaaagagactctcgtgacattcaagaatcctcacgcgaagaaacaggatgtcgtggtacttggatcccaagagggcgccatgcatacggcactgaccggggctactgaaatccagatgtcaagcggaaacttgctatttacaggtcacctgaagtgccgtctccgcatggacaaactgcagcttaagggcatgagttattctatgtgtaccgggaaattcaaggttgtgaaggagatagccgaaacacaacatggaactattgtcatcagagtgcagtacgagggcgacggttccccatgcaaaatccccttcgagattatggatctggaaaagaggcacgtcttggggcggctcatcaccgtgaatccgattgttacggagaaagacagccctgtgaacatagaagctgagcccccatttggcgattcgtacatcattatcggagtagaacctggccagctgaagttatcttggttcaaaaaggggtcctcaatcggacagatgtttgagaccacaatgcgaggtgccaagcgcatggcaattctgggcgacactgcctgggatttcgggagtctaggaggcgtctttaccagcataggtaaagctctccatcaagtgttcggggcgatctatggcgcagccttttccggagtttcttggacaatgaagattctgatcggcgtggtcattacttggatcgggatgaatagcagatcaaccagtctttccgtgagcttggtactggtgggagttgtcacgctctacctgggcgtgatggtgcaggctgactctggttgtgtcgtttcatggaaaaacaaggagcttaaatgcgggagtggaatattcatcacagataatgtgcacacctggactgaacagtataagtttcagcccgagagcccatccaagctggcctctgcaattcaaaaagcccacgaagagggcatctgtggtattaggtcggtgacacggttggaaaacctcatgtggaagcagatcacccccgagctgaatcatatattaactgagaacgaagtaaaactgaccattatgacaggcgacatcaaggggattatgcaggctggaaaacgcagcctaagacctcagccaacggagctcaagtactcctggaaagcctggggcaaggcaaagatgctgtcaaccgaacttcacaatcatactttcttgatcgatgggccggagacagcggaatgccccaacaccaatagggcttggaacagtctggaggtcgaggactatggatttggcgtgttcacaactaatatatggctcaaactgaaggaacgtcaagatgtattttgtgactctaaattaatgagcgccgcaatcaaggacaaccgggccgtgcacgctgatatgggttactggattgagtccgccctgaacgacacctggaaaatcgaaaaggcatcattcattgaggtcaagagctgccactggcctaaatctcatacgctttggtccaatggggtgttggagagtgaaatgatcataccaaagaacttcgctggacccgttagccagcacaattatcgacctggctaccatacacagaccgccggtccatggcacctcggcagactggagatggattttgacttctgtgaagggactaccgtggtagtcacagaggattgcggaaacaggggcccctctctacgcactaccacagcgtccgggaaactgattacggaatggtgctgtcggtcatgcaccctcccgcctctgagatacaggggagaggacggctgttggtatggtatggagatccgcccacttaaggaaaaagaggaaaatttggtgaacagtctggtgactgccgggcatggacagatcgataattttagcttaggcgtcctcggtatggctctgttccttgaggaaatgctgcgaacacgggttggcaccaagcacgcaattttgctcgtggccgtatcgtttgtgactctgatcacagggaacatgtccttccgtgacctaggaagagtcatggtgatggttggcgctaccatgacggatgacattgggatgggagtgacttacctggccctcctggcagcgtttaaggtcaggcccaccttcgccgctggccttttgctgcgcaaattaacatctaaggagctcatgatgaccactataggtatcgtgctgcttagccaatcaacaattcctgagagtatcctggaactaaccgatgccctcgcactggggatgatggttttgaaaattgtgcggaatatggagaagtatcagctggctgtcacaatcatggccatattatgcgtacccaacgcagtgatcctccagaatgcctggaaagtttcctgtactaccctggctgtggtctctgtgagcccacttctgttgacgtcctcacaacagaaggcggactggattcctctcgccctgacaatcaagggactaaaccccaccgcaatttttctgactacccttagcagaacaagtaaaaagaggtcttggccactcaatgaagctatcatggccgtaggcatggtgtccatactggccagctcgttgctgaaaaacgatattccgatgactggccctttagtcgctgggggactcctgaccgtttgctacgtgcttacgggtcgatcagcagacctggagttggaacgcgccgcggacgtgcggtgggaggagcaggctgaaatctctggcagttcccccatcctcagcattacaatatctgaggatgggagcatgtccatcaagaatgaagaggaggaacagaccctgactattctaatcagaacaggactgcttgtcatttcaggcctcttcccagtgagtatccccataaccgccgcagcctggtatctgtgggaggttaaaaagcaaagggctggtgtattgtgggacgtgcctagcccaccccctgtcgaaaaagcagagttagaagatggggcctaccgtatcaagcagaagggcattctgggctattctcagatcggcgcgggggtgtacaaagagggaacttttcacacaatgtggcatgttacccgcggtgctgtgctcatgcacaagggcaaacggattgagccgtcctgggccgacgtcaagaaagatctgatctcatacgggggaggctggaaacttgaaggtgagtggaaggaaggggaggaagtgcaggtactggcattggagccaggcaagaaccccagagccgtccaaacgaagcctggcctattcaaaactaacaccggcacaataggggctgtgagtctggactttagcccaggaacctccggttctcccattgttgataagaaaggcaaggtggtcgggctctatggaaatggcgtggttacaaggtcgggtacttacgtgagcgccatcgcacagaccgagaagtcaatcgaagacaaccctgagattgaagatgacatcttcagaaagaaacggctgacgataatggatcttcatccgggggctggaaaaacaaagcgctatttacccgccattgtcagagaggcgatcaaaaggggcctgcggactctcattttggccccaacccgagtggtagcagctgaaatggaggaggccctgagaggcctccctatccgctaccagacacccgctataagggcagaacacaccgggcgtgagattgtggacctgatgtgtcatgccactttcaccatgcggcttctgtccccaatcagagttcctaattataacttgatcattatggatgaagcccactttacagaccccgctagtatcgcggcaaggggatacatttctacgcgcgtcgagatgggtgaggccgctggcatattcatgactgccaccccaccggggagccgagacccttttccccagtccaatgcaccaatcatggatgaagagagagaaattcccgagcggtcatggaactctggacacgaatgggtgacagacttcaagggcaagaccgtgtggtttgtccctagcatcaaagccggtaatgatatcgctgcgtgcctaaggaagaacgggaaaaaggtaattcaactgagtcgcaaaactttcgactccgagtatataaagacacgtaccaatgattgggactttgtggttacgactgatatcagcgagatgggagccaacttcaaggcagaaagagtgattgacccacggaggtgtatgaaacccgtcatcctcacagatggcgaggaacgcgtgattttagctggccctatgccggttacccattcttcagccgcacagcgaagagggcgggtgggaaggaatccaaagaacgagaatgaccagtacatctacatgggtgaacccctggagaacgatgaggactgcgcccactggaaagaagctaagatgcttctggacaatataaacacccctgagggcatcattccctccatgtttgaaccagagcgcgaaaaagtcgatgccatcgacggggagtatagactcaggggagaggcgcggaagactttcgtggatttgatgcgtcgcggcgacctgcctgtatggctcgcataccgagtggccgctgaaggtattaactatgccgatagaaggtggtgttttgacggggttaaaaataaccaaatcctggaggaaaatgtcgaggtggagatatggacaaaggaaggcgagcggaagaaacttaagccccgctggctagatgctagaatttacagtgacccactggcattgaaagagttcaaggagttcgccgctggaaggaagtcgttaaccctgaacctcatcacagaaatgggccggctgcctacttttatgacgcagaaggccaagaatgcacttgataacctggcggtgctccataccgccgaggctgggggacgagcctataatcacgcattgagcgagctgccggaaacactagagactctgctccttctgaccttattggctacagtcaccggtggcattttcctgtttctcatgtctgggaaaggaatcggcaagatgactctgggtatgtgctgcataatcacggcctccattcttctgtggtacgcacagatccagccccactggattgccgctagcatcatactcgagttctttttgattgttctgttaatcccagagcctgaaaaacaaagaacaccccaggacaaccagctaacatatgtggtaatcgcgattctgactgtggtcgccgcaaccatggctaatgagatggggttcctcgagaagaccaaaaaggattttggccttggatcaatcaccactcagcaaccagaaagtaacatactggacattgatttgcgccctgcctctgcctggacactgtacgcagtggctacgaccttcatcactcccatgctcaggcattccattgagaatagctcagttaacgtgagtctgacagccatcgcgaatcaggctaccgtccttatgggcctcgggaagggatggccgctgagcaaaatggacataggtgtaccattgctggccatcggctgttactcccaggtgaaccctattaccttaacagcagccctactgctccttgttgctcactatgcaatcattgggcccggactgcaggccaaggcgactcgggaagctcaaaaacgtgccgcagccggcatcatgaagaatccaacggtggacggtatgaccgtcattgatttggaccccatcccttacgatccgaaatttgagaagcagctgggacaggtgatgctcctggtcctttgcgtgacacaggttttaatgatgagaactacctgggctctgtgtgaagccctcacattggcaaccggccccatatctactctgtgggagggaaacccaggcaggttctggaatacgacaattgctgtgagcatggccaacatctttcgcgggtcctatctagcgggagccggcctactcttctcaatcatgaagaacaccgcaaatactcggcgaggtaccgggaacacaggagagactcttggcgaaaaatggaagaatagactgaacgctttgggtaaatctgagtttcaaatttacaagaaaagtggcatacaggaagtagacaggaccctggccaaggaggggatcaaacgcggagagacagatcatcacgcagtgtcgcggggcagcgctaagctcagatggttcgtcgaacgtaatctggttacgcctgaggggaaggtggtcgacttaggatgcggcaggggtgggtggtcctattactgtggaggccttaaaaacgtgaaggaagtaaaaggtctgaccaagggcgggcccggacatgaggaacctattccaatgtctacttatggctggaatctcgtgcggctacagtcaggggttgatgtgttctttacaccccctgagaaatgcgacaccctgttgtgtgatatcggagagagctccccaaaccccactgtcgaagccggccgcacactgcgagtgctcaatcttgtcgagaactggctgaataacaatacccaattctgcattaaggtgttgaacccgtacatgcctagtgttatcgaaaagatggaggccctgcagagaaaatacggtggggcgctcgtaaggaatccattatctcggaacagcacgcacgaaatgtattgggtgtcaaacgcttccggaaatatagtcagtagcgtgaacatgatctctcgcatgctgattaatagatttaccatgaggcacaagaaagcaacatacgagcccgacgttgatcttggctccggcactcgaaacatcgggattgagtcagaaacccctaatctggacatcataggaaagcggattgagaaaatcaagcaggaacatgagacaagctggcactatgatcaggaccatccatacaagacttgggcctatcacggttcgtacgaaaccaaacaaacaggctctgctagttccatggtgaacggggtcgtgcgtctactcaccaagccctgggacgtaatcccgatggtgactcagatggccatgacggatacaacccctttcggacagcagagagtttttaaagagaaggtcgacactcgcacccaagagcccaaagaaggcacaaagaagctgatgaaaattacggcagagtggttgtggaaggaactgggtaaaaagaaaaccccaaggatgtgtactcgggaggagttcacaagaaaggtgcgcagcaatgccgctctcggggcgatatttaccgatgaaaacaaatggaagtcagccagggaggcagtggaagactccggattctgggagcttgtcgataaggaacgaaatctgcacttagagggcaaatgcgagacttgtgtttataacatgatgggcaagcgggagaaaaagctgggggagtttggaaaagctaagggttctagagccatctggtacatgtggttgggcgcaaggttcctcgaatttgaggccctggggttcctaaatgaagaccattggtttagccgcgagaacagtctttccggagtggagggcgaaggtctgcacaagctcgggtacattctgcgtgatgtaagcaaaaaggagggaggcgctatgtatgccgacgatacagcgggctgggacacccggatcacattggaagatctgaaaaatgaggaaatggtgactaaccatatggagggggagcacaagaaactcgcagaagccattttcaaacttacctaccagaataaggtcgtgagagttcagaggcctacgccccgcggaaccgtgatggacatcatatctcgacgggaccagagaggttcaggccaagtcgtgacatatgggctgaacactttcaccaacatggaggctcagttaatcaggcagatggaaggagagggcgtatttaaaagtattcaacagctgacagttaaggaggaaatcgccgtgaaaaattggttgattcgcgtcggtagagagcggctctccaggatggcaatcagcggggatgactgcgtggtgaagccactggatgaccgtttcgcttctgccctaactgctcttaacgatatgggaaaagtccgaaaggacattcagcagtgggaaccctcgcgcggctggaatgattggacccaagttcctttttgctcacatcacttccacgagctgataatgaaggacggcagagtgctcgtagtgccatgtcggaaccaggatgaactgatcgggagggcccgcattagccagggagcaggttggtccttgagagagacggcgtgcttaggcaaaagttacgcccagatgtggtctctgatgtattttcatcggagggacctccgacttgctgccaatgcaatctgtagcgctgtcccgtcccactgggtgcccacatcacgtaccacttggagtatccatgccacacacgagtggatgaccactgaagatatgctgaccgtttggaacagagtgtggattcaagagaatccttggatggaagacaagacaccagtcgagtcttgggaagagataccctacctagggaaacgcgaggatcagtggtgcggaagcctgatcggcctcacgtcccgggcaacctgggccaagaacattcagactgcgatcaatcaggtgaggtcattgattggtaacgaagagtatacagactacatgcctagcatgaaaagattccgccgggaagaggaagaggctggggtactgtggtga

SEQ ID NO: 14984 - RNA, 9876 nt, synthetic construct
  misc_feature 1..9876: note = derived and/or modified CDS sequence (opt3) from DENV-2__JN851126__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctaaaacaaaacgaaccggaggacattgattgttggtgcaattctacatcaacctgggtgacttatgggacatgtaccgccacgggagagcaccggcgcgaaaagcgaagtgtagcgctcgtgccccatgtcggcatgggtctggagactcgtaccgaaacatggatgagctccgagggggcttggaaacacgcccagagaatcgagacttgggtgcttaggcatcctggattcaccataatggcagccatcctggcttacacaattggcaccacgtattttcagcgggttttgatcttcattctcctgactgcagtggccccatctatgacaatgcgctgcatcggcatatcgaacagagactttgtcgaaggggtgtcaggaggtagctgggtagatattgttctggagcacggcagttgtgtgaccactatggctaagaataagcccacactcgacttcgaattaatcaaaaccgaggccaagcaccctgcgacgctgaggaaatactgcattgaagcaaagcttaccaacacaactaccgcctcccggtgtccaacacagggggagccctctttgaatgaggaacaagataaacgctttgtctgcaagcatagcatggtggaccgaggatggggcaacggttgtgggctgttcggaaagggcggcatcgtgacttgcgctatgtttacctgcaaaaagaatatggaggggaaaatcgtccagcctgaaaacctagagtatacaattgttataaccccacactccggagaagagaatgccgtgggtaacgatactggcaagcatgggaaagagatcaaggtaacgccgcagtcaagtattacagaagcagagctcaccggatacggcactgtgaccatggaatgtagccccagaacaggtctggacttcaatgagatggtccttctgcagatggaaaacaaagcttggttggtgcacaggcaatggtttctcgatctgcctttaccatggctgcccggggccgacacccagggctctaactggatccagaaggagactctcgttacattcaagaatcctcacgcgaaaaagcaggatgtggtcgtgcttggatcccaagagggcgccatgcatacggcactgaccggggctactgaaatacagatgtcaagcggaaacttgctatttacaggtcacctgaaatgccggctccgtatggacaagctgcagcttaaaggcatgagttattctatgtgtaccgggaagttcaaggtagttaaagagattgccgaaacacaacatggaactatcgtgatccgcgtccagtacgagggcgacggttccccatgcaagattcccttcgagatcatggatctggaaaaaagacacgtgttggggaggctcattaccgtcaatccgatagtgacggagaaggacagccctgttaacatcgaagctgagcccccatttggcgattcgtacattatcatcggagtggaacctggccagctgaaattatcttggttcaagaaggggtcctcaattggacagatgtttgagaccacaatgcggggtgccaaacgaatggcaatactgggcgacactgcctgggatttcgggagtctaggaggcgtatttaccagcatcggtaaggctctccatcaagtcttcggggcgatttatggcgcagccttttccggagtgtcttggacaatgaaaatcctgattggcgttgtgatcacttggatagggatgaatagccgctcaaccagtctttccgtcagcttggtgctggtaggagtggttacgctctacctgggcgtcatggtgcaggctgactctggttgtgtggtctcatggaagaacaaagagcttaagtgcgggagtggaatcttcattacagataatgttcacacctggactgaacagtataagtttcagcccgagagcccatccaaactggcctctgcaatccaaaaggcccacgaagagggcatttgtggtatcagatcggtgacaaggttggaaaacctcatgtggaaacagataacccccgagctgaatcatattttaagcgagaacgaaatcaagctgactattatgaccggcgacatcaaagggataatgcaggctggaaagcggtccctacgccctcagccaacagagctcaaatactcatggaaggcctggggcaaggcaaaaatgctgagtacggaacttcacaatcataccttcttgatcgatgggccggagactgcggaatgccccaacacaaatagagcttggaactctctggaggtggaggactatggatttggcgtattcaccacaaatatttggctcaagctgaaagaaaggcaagatgtcttttgtgacagcaagttaatgtccgccgcaatcaaagacaaccgtgccgtgcacgctgatatgggttactggattgagtcagccctgaacgacacttggaagatcgaaaaggcaagcttcatagaggttaaatcttgccactggcctaagtcccataccctttggagtaatggggtgttggagagcgaaatgattatcccaaaaaacttcgctggacccgtctctcagcacaattatcggcctggctaccatacgcagacagccggtccatggcacctcggccgactggagatggattttgacttctgtgaagggaccactgtggttgtgaccgaggattgcggaaacagaggcccctccctaaggacaactaccgcgtcagggaagctgatcacagaatggtgctgtcgcagttgcacgctcccgcctctgcggtacagaggagaggacggctgttggtatggtatggagattaggccacttaaagaaaaggaggaaaatttggtaaacagcctggtcaccgccgggcatggacagatcgataatttttcgttaggcgtgctcggtatggctctgttccttgaggaaatgctgcgcactcgagtgggcacaaagcacaccattttgctcgtcgcagtttcctttgtgactctgataacagggaacatgtctttccgggacctaggacgtgtagtggtcatggtgggcgccaccatgacggatgacatcgggatgggagttacttacctggctctcctggccgcatttaaagtgagacccaccttcgcggccggccttttgctgaggaagttaacaagcaaagagctcatgatgaccactattggtatcgtcctgctttcacaaagtacaattcctgagaccatcctggaactaacagatgctctcgccctggggatgatggtgttgaagatagttcgcaatatggagaaatatcagctggcagtgactatcatggctattttatgcgtccccaacgccgtaatcctccagaatgcatggaaggtgtcctgtaccgccctggctgttgtgtctgtcagcccacttctgttgacgtcctcacaacagaaggcggactggattcctctcgccctgacaatcaaaggactaaaccccaccgcaatatttctgactacccttagccggacaagtaagaaaagatcttggccactcaatgaagctattatggccgtgggcatggtatccatcctggccagctcgttgctgaagaacgatatcccgatgactggccctttagtggctgggggactcctgaccgtctgctacgttcttacgggtaggtcagcagacctggagttggaacgagccgcggacgtgcgctgggaggagcaggctgaaatttctggcagttcccccatactcagcatcacaatttctgaggatgggagcatgtccatcaaaaatgaagaggaggaacagaccctgactattctaatccggacaggactgcttgtgatatcaggcctcttcccagtcagtatccccattaccgccgcagcctggtatctgtgggaggtgaagaaacaaagagctggtgttttgtgggacgtacctagcccaccccctgtggggaaggcagaattagaggatggagcctacaggatcaagcagaaaggcattctgggctattctcagatcggggcgggagtctacaaggaaggtacttttcacacaatgtggcatgtgacccgtggcgctgttctcatgcacaaagggaagcgcatagagccgtcctgggccgacgtgaaaaaggatctgatttcatacggaggcggttggaagcttgagggggaatggaaagagggagaagaggtccaggtgctggcattggaaccaggcaagaacccccgggccgtacaaacgaaacctggcctattcaagactaacaccgggacaatcggagctgtcagtctggactttagcccaggtacctccggctctcccatcgtggataaaaaggggaaggttgtgggactctatggcaatggtgtcgtgacaagatcggggacttacgttagcgccattgcacagaccgagaaatcaatcgaggacaaccctgaaatagaggatgacattttcaggaagaaacgactgacgatcatggatcttcatccgggagctggcaagacaaaacggtatttacccgccattgtgcgcgaagcgatcaagagaggcctgaggactctcatattggccccaacccgggtcgtggcagctgagatggaagaggccctgcgagggctccctattagataccagacacccgctatccgcgcagagcacaccggaagggaaatcgtagacctgatgtgtcatgccactttcaccatgcgtcttctgtccccaattcgggtgcctaattataacttgatcattatggatgaggcccactttacagaccccgctagtatagcggcaagaggttacatctctacgagggttgaaatgggcgaggccgctgggattttcatgactgccaccccaccgggaagccgcgacccttttccccagtccaatgcaccaatcatggatgaggaaaaggagatccccgaacgatcatggaactctggccacgagtgggtcacagacttcaaaggtaagaccgtgtggtttgtgcctagcattaaagccgggaatgatatagctgcgtgcctaagaaagaacggaaaaaaggtcatccaactgagtcggaagactttcgactccgaatatattaaaacaaggaccaatgattgggactttgtagtgacgactgatatcagcgagatgggcgccaacttcaaggcagagcgcgttattgacccacgtagatgtgtgaaacccgtcatcctcacagatggcgaagagcgggtgatattagctgggcctatgccggttacccattcttcagccgcacagaggcgcggacgagtgggtagaaatccaaagaacgaaaatgaccagtacatctacatgggcgagcccctggaaaacgatgaggactgcgcccactggaaagaggctaagatgcttctggacaatattaacacccctgaagggatcattccctccatgtttgagccagaacgggagaaagtcgatgccatcgacggagaatataggctccgcggcgaggcgagaaagactttcgtggatttgatgaggcggggtgacctgcctgtatggctcgcataccgtgtggccgctgaggggataaactatgccgatcgccgatggtgttttgacggcgttaagaataaccaaattctggaagagaatgtcgaagtggagatctggacaaaagagggagaaagaaagaaacttaagcccaggtggctagatgctcggatttacagtgacccactggcattgaaagagttcaaggaattcgccgctggccgcaagagcttaaccctgaacctcatcacagagatggggagactgcctacttttatgacgcagaaagccaggaatgcacttgataacctggcggtgctccataccgccgaagctggaggtcgggcctataatcacgcattgtcggagctgccggagacactagaaactctgctccttctgaccttattggctacagtcaccggcgggatattcctgtttctcatgtctggaaagggcatcggtaaaatgactctggggatgtgctgcattatcacggcctccattcttctgtggtacgcacagatccagccccactggatagccgctagcattatcctcgagttctttttgatcgttctgttaattccagaacctgagaagcaacgaaccccccaggacaaccagctaacatatgtggtaatcgcgatactgactgtggtcgccgcaaccatggctaatgaaatgggcttcctcgagaaaacaaagaaggattttggacttggctcaattaccactcagcaaccagagagtaacatcctggacattgatttgagacctgcctctgcctggacactgtacgcagtggctacgaccttcatcactcccatgctccgccattccatagaaaatagctcagttaacgtgagtctgacagccatcgcgaatcaggctaccgtccttatggggctcggaaaaggttggccgctgagcaagatggacattggcgtaccattgctggccatcgggtgttactcccaggtgaaccctattaccttaacagcagccctactgctccttgttgctcactatgcaatcattggacccggcctgcaggccaaagcgactagggaggctcaaaagcgggccgcagccggtatcatgaaaaatccaacggtggacgggataaccgtcattgatttggaccccatcccttacgatccgaagtttgaaaagcagctgggccaggtgatgctcctggtcctttgcgtgacacaggttttaatgatgcgtactacctgggctctgtgtgaggccctcacattggcaaccggacccatctctactctgtgggaaggcaacccagggagattctggaatacgacaattgctgtgagcatggccaacatatttaggggatcctatctagcgggcgccggtctgctcttctcaatcatgaaaaacaccgcaaatactcgccgggggaccggaaacacaggcgagactcttggtgagaagtggaaaaatcgactgaacgctttgggcaagtctgaatttcaaacctacaaaaagagtgggattcaggaggtagacagaacactggccaaagaaggaatcaagaggggcgagacggatcatcacgcagtgtcgcgcgggagcgctaagctccggtggttcgtcgagagaaatctggttacccctgaaggaaaagtggtcgacttaggctgcggtcgtgggggatggtcctattactgtggcggtcttaagaacgtgaaagaggtaaagggcctgactaaagggggacccggccatgaagagcctattccaatgtctacatatgggtggaatctcgtgaggctacagtcaggagttgatgtgttctttaccccccctgaaaagtgcgacactctgttgtgtgatatcggcgagagctccccaaaccccacagtcgaggccggtcggaccctgcgcgtgctcaatcttgtcgaaaactggctgaataacaatacgcaattctgcataaaggtgttgaacccgtacatgcctagtgttatcgagaaaatggaaaccctgcagcgaaagcacgggggagccctcgtaagaaatccattatctaggaacagcacacacgagatgtactgggtgtcaaacgcgtccggcaatattgtcagtagcgtgaacatgatctctcggatgctgattaatcgctttactatgagacataaaaaggctacctatgaacccgacgttgatcttggctccgggacaaggaacatcggaatagagtcagagactcctaatctggacattatcggtaaacgaatcgaaaagattaagcaggagcacgaaaccagctggcattacgatcaggaccacccatataaaacatgggcataccacggctcgtatgagaccaagcaaactgggtctgccagttccatggtgaacggagtcgtgcggctactcacgaaaccctgggacgtaataccgatggtgacacagatggctatgaccgatactacccctttcggccagcagcgtgtttttaaggaaaaagtcgacacaagaacgcaagagcccaaggagggtaccaagaaactgatgaagatcactgccgaatggttgtggaaagagctggggaagaaaaagacaccacgcatgtgtaccagggaagagttcactcggaaagtgagaagcaatgcagccctcggagctatttttacagatgagaacaagtggaagtcagcgcgcgaagccgtggaggactccaggttctgggaacttgtcgataaagagcgaaatctgcatttagaaggcaagtgcgagacctgtgtttacaacatgatgggcaaacgggagaagaaactgggggaatttggaaaggcaaagggttctagagctatctggtatatgtggttgggcgccaggttcctcgagtttgaagcactggggttcctaaatgaggaccactggtttagccgcgaaaacagtctttccggagtggagggcgagggtctgcataaactcgggtacattctgcgtgatgtaagcaagaaagaaggaggcgccatgtacgctgacgatacagccggctgggacactcggatcaccttggaggatctgaagaatgaagagatggtgacgaaccacatggaaggggagcataaaaagctcgcggaggcaatattcagacttacctatcagaataaggtcgtgagggttcagcgccctacaccccgaggaactgtgatggacatcatttctcggagagaccagaggggttcaggccaagtcgtgacctacgggctgaacacattcactaacatggaagcccagttaatccgccagatggagggagaaggcgtatttaaaagtattcaacacctgaccgttacggaggagatcgctgtgaagaattggttggtcagagtgggtcgggaaaggctctcccgtatggccattagcggggatgactgcgtggtcaaaccactggatgaccgattcgcatctgctctaacagcccttaacgatatgggaaaggttcgcaaagacatacagcagtgggagccctcgagaggctggaatgattggacccaggtgcctttttgctcacaccatttccacgaactgatcatgaaggacggccgggtactcgtggtcccatgtaggaaccaagatgagctgattgggcgcgctagaatcagccagggagccggttggtccttgcgggaaactgcatgcttaggcaagagttatgcgcagatgtggtctctgatgtactttcataggcgagacctccgtcttgccgctaatgccatctgtagcgcagtgccgtcccactgggttcccacatcaagaaccacttggagtattcacgctacccatgagtggatgacaacggaggatatgctgaccgtgtggaaccgcgtctggatacaggaaaatccttggatggaggacaaaactccagtggaatcttgggaggaaatcccctatctagggaagcgggaggatcaatggtgcggaagcctgattggcctcacatccagggccacctgggcaaaaaacatccagactgccattaatcaggtaagatcattgatcggtaacgaggaatacacagactatatgcctagcatgaagcgcttccggagggaggaagaggaagcgggggttctgtggtga

SEQ ID NO: 14985 - RNA, 9876 nt, synthetic construct
  misc_feature 1..9876: note = derived and/or modified CDS sequence (opt3) from DENV-2__JN851121__SS-prME
  source 1..9876: mol_type = other RNA
accgcaggaatcattataatgatgatccccaccgtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgaggtgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacaccctgcgacgctgcggaagtactgcgtggaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaaggtcgttcagcctgaaaacctagagtatacaatcgtgattaccccacactccggagaagagaatgccgtaggtaacgatactggcaaacatgggaaggagataaaagtgacgccgcagtcaagtatcacagaagcagagctcaccggatacggcactgtcaccatggaatgtagccccaggacaggtctggacttcaatgagatggtgcttctgcagatggaaaacaaggcttggttggttcaccggcaatggtttctcgatctgcctttaccatggctgcccggggccgacacccagggctctaactggattcagaaagagactctcgtgacattcaagaatcctcacgcgaagaaacaggatgtcgtggtacttggatcccaagagggcgccatgcatacggcactgaccggggctactgaaatccagatgtcaagcggaaacttgctatttacaggtcacctgaagtgccgtctccgcatggacaaactgcagcttaagggcatgagttattctatgtgtaccgggaaattcaaggttgtgaaggagatagccgaaacacaacatggaactattgtcatcagagtgcagtacgagggcgacggttccccatgcaaaatccccttcgagattatggatctggaaaagaggcacgtcttggggcggctcatcaccgtgaatccgattgttacggagaaagacagccctgtgaacatagaagctgagcccccatttggcgattcgtacatcattatcggagtagaacctggccagctgaagttatcttggttcaaaaaggggtcctcaatcggacagatgtttgagaccacaatgcgaggtgccaagcgcatggcaattctgggcgacactgcctgggatttcgggagtctaggaggcgtctttaccagcataggtaaagctctccatcaagtgttcggggcgatctatggcgcagccttttccggagtttcttggacaatgaagattctgatcggcgtggtcattacttggatcgggatgaatagcagatcaaccagtctttccgtgagcttggtactggtgggagttgtcacgctctacctgggcgctatggtgcaggccgactctggttgtgtggtctcatggaaaaacaaggagcttaaatgcgggagtggaatattcatcacagataatgttcacacctggactgaacagtataagtttcagcccgagagcccatccaagctggcatctgccattcaaaaagctcacgaagagggcatctgtggtattaggtcggtgacacggttggaaaacctcatgtggaagcagatcacccccgagctgaatcatatattaactgagaacgaagtgaaactgaccattatgacaggcgacatcaaggggattatgcaggccggaaaacgcagcctaagacctcagccaacggagctcaagtactcctggaaagcatggggcaaggcgaagatgctgtcaaccgaacttcacaatcatactttcttgatcgatgggccggagacagctgaatgccccaacaccaatagggcctggaacagtctggaggtagaggactatggatttggcgtcttcacaactaatatatggctcaaactgaaggaacgtcaagatgtgttttgtgactctaaattaatgagcgcagccatcaaggacaaccgggctgttcacgccgatatgggttactggattgagtccgcactgaacgacacctggaaaatcgaaaaggcttcattcattgaggtgaaaagctgccactggcctaaatctcatacgctttggtccaatggggtcttggagagtgaaatgatcataccaaagaacttcgccggacccgtgagccagcacaattatcgacctggctaccatacacagaccgcgggtccatggcacctcggcagactggagatggattttgacttctgtgaagggactaccgttgtggtaacagaggattgcggaaacaggggcccctctctacgcactaccacagcctccgggaaactgattacggaatggtgctgtcggtcatgcaccctcccgcctctgagatacaggggagaggacggctgttggtatggtatggagatccgcccacttaaggaaaaagaggaaaatttggtcaacagtctggtgactgctgggcatggacagatcgataattttagcttaggcgtgctcggtatggcactgttccttgaggaaatgctgcgaacacgggtcggcaccaagcacgccattttgctcgttgctgtgtcgtttgtaactctgatcacagggaacatgtccttccgtgacctaggaagagtgatggtcatggtgggcgccaccatgacggatgacattgggatgggagttacttacctggcactcctggcggcctttaaggtgaggcccaccttcgctgccggccttttgctgcgcaaattaacatctaaggagctcatgatgaccactataggtatcgtcctgcttagccaatcaacaattcctgagagtatcctggaactaaccgatgcactcgctctggggatgatggtgttgaaaattgttcggaatatggagaagtatcagctggccgtgacaatcatggcaatattatgcgtccccaacgccgtaatcctccagaatgcttggaaagtgtcctgtactaccctggcggttgtgtctgtcagcccacttctgttgacgtcctcacaacagaaggccgactggattcctctcgcactgacaatcaagggactaaaccccaccgctatttttctgactacccttagcagaacaagtaaaaagaggtcttggccactcaatgaagccatcatggccgtgggcatggtatccatactggctagctcgttgctgaaaaacgatattccgatgactggccctttagtggcagggggactcctgaccgtctgctacgttcttacgggtcgatcagccgacctggagttggaacgcgcggctgacgtgcggtgggaggagcaggccgaaatctctggcagttcccccatcctcagcattacaatatctgaggatgggagcatgtccatcaagaatgaagaggaggaacagaccctgactattctaatcagaacaggactgcttgtgatttcaggcctcttcccagtcagtatccccataaccgcagccgcttggtatctgtgggaggtgaaaaagcaaagggccggtgttttgtgggacgtacctagcccaccccctgtggggaaagccgaattagaggatggagcgtaccgtatcaagcagaagggcattctgggctattctcagatcggggctggagtctacaaagaaggtacttttcacacaatgtggcatgtgacccgcggcgccgttctcatgcacaaggggaaacggattgagccgtcctgggcagacgtgaagaaagatctgatctcatacggaggcggttggaaacttgagggggaatggaaggagggagaagaggtccaggtgctggccttggaaccaggcaaaaaccccagagctgtacaaacgaagcctggcctattcaaaactaacaccgggacaataggagccgtcagtctggactttagcccaggtacctccggctctcccattgtggataagaaagggaaggttgtgggactctatggcaatggtgtcgtgacaaggtcggggacttacgttagcgcaatcgctcagaccgagaagtcaatcgaggacaaccctgaaattgaggatgacatcttcagaaagaagcggctgacgataatggatcttcatccgggagccggcaaaacaaagcgctatttacccgcgattgtgagagaagccatcaaaaggggcctgcggactctcattttggcaccaacccgagtcgtggctgccgagatggaagaggctctgagagggctccctatccgctaccagacacccgcaataagggccgagcacaccggacgtgaaattgtagacctgatgtgtcatgccactttcaccatgcggcttctgtccccaatcagagtgcctaattataacttgatcattatggatgaggctcactttacagaccccgcgagtatcgcagccaggggttacatttctacgcgcgttgaaatgggcgaggctgccgggatattcatgactgcaaccccaccgggaagccgagacccttttccccagtccaatgccccaatcatggatgaggaaagagagattcccgaacggtcatggaactctggccacgagtgggtcacagacttcaagggtaagaccgtgtggtttgtgcctagcatcaaagctgggaatgatatcgcggcctgcctaaggaagaacggcaagaaggtcattcaactgagtcgcaaaactttcgactccgaatatataaagacacgtaccaatgattgggactttgtagtgacgactgatatcagcgagatgggcgcaaacttcaaggctgagagagttattgacccacggaggtgtatgaaacccgtgatcctcacagatggcgaagaacgcgtcattttagccgggcctatgccggtgacccattcttcagcagcccagcgaagaggacgggttggtaggaatccaaagaacgaaaatgaccagtacatctacatgggcgagcccctggaaaacgatgaggactgcgctcactggaaagaggccaagatgcttctggacaatataaacacccctgaagggatcattccctccatgtttgagccagaacgcgagaaagtggatgcgatcgacggagaatatagactcaggggcgaggcacggaagactttcgtcgatttgatgcgtcgcggtgacctgcctgtgtggctcgcctaccgagtagctgccgaggggattaactatgctgatagaaggtggtgttttgacggcgtgaaaaataaccaaatcctggaagagaatgttgaagtcgagatatggacaaaggagggagaacggaagaaacttaagccccgctggctagatgcaagaatttacagtgacccactggccttgaaagagttcaaggagttcgctgccggcaggaagtcgttaaccctgaacctcatcacagagatggggcggctgcctacttttatgacgcagaaggcaaagaatgcgcttgataacctggccgtgctccataccgctgaagccggaggtcgagcatataatcacgctttgagcgagctgccggagacactagaaactctgctccttctgaccttattggccacagtgaccggcgggattttcctgtttctcatgtctggaaaaggcatcggtaagatgactctggggatgtgctgcataatcacggcatccattcttctgtggtacgcccagatccagccccactggattgctgcgagcatcatactcgagttctttttgattgtcctgttaatcccagaacctgagaaacaaagaacaccccaggacaaccagctaacatatgttgtgatcgccattctgactgtagtggcagctaccatggccaatgaaatgggcttcctcgagaagaccaagaaggattttggacttggctcaatcaccaaccagcaaccagagagtaatatactggacattgatttgcgccctgcctctgcatggactctgtacgctgtcgccacaacgttcatcacccccatgctcaggcattccattgaaaacagctcagtgaatgttagtctgactgcgatcgctaaccaggccacagtgcttatggggctcggaaagggttggccgctgagcaaaatggacataggcgtcccattgctggcaatcgggtgttactcccaggtaaatcctattaccttaaccgccgctctactgctccttgtggcacactatgccatcattggacccggcctgcaggcgaaggctacacgggaggcccaaaaacgtgcagccgctggtatcatgaagaacccaactgttgacgggatgacggtgattgatttggaccccatcccttacgatccgaaatttgaaaagcagctgggccaggtcatgctcctggtgctttgcgtcacccaggtgttaatgatgagaacaacttgggccctgtgtgaggcactcaccttggctacaggacccatatctaccctgtgggaaggcaatccagggaggttctggaacactacgattgccgttagcatggcgaacatctttcgcggatcctatctagccggcgcaggtctactcttctcaatcatgaagaatacagctaacacccggcgagggactggaaataccggcgagacacttggtgagaaatggaagaacagactgaatgccttgggcaaatctgaatttcaaatttacaagaaaagtgggatacaggaggtggacaggactctggcaaaggaaggaatcaaacgcggcgagaccgatcatcacgctgtatcgcgggggagcgccaagctcagatggttcgtggagcgtaacctggtcacacctgaaggaaaggttgtggacttaggctgcggtagagggggatggtcctattactgtggcggtcttaaaaatgtcaaggaggtgaaaggcctgacgaaagggggacccggccatgaagaacctattccaatgtctacctatgggtggaacctcgtacggctacagtcaggagtggatgttttctttactccccctgaaaaatgcgacacactgttgtgtgatatcggcgagagctccccaaatcccaccgtggaggccggtcgcactctgcgagtcctcaaccttgtggaaaattggctgaacaataacacacaattctgcattaaggtcttgaatccgtacatgcctagtgtgatcgagaagatggaagcgctgcagagaaaatacgggggagctctcgttaggaacccattatctcggaacagcacccacgagatgtattgggtatcaaatgcatccggcaacatagtgagtagcgtcaatatgatctctcgcatgctgattaacagatttacgatgaggcacaagaaagccacctacgaacccgacgtggatcttggctccgggacacgaaatatcggaattgagtcagagactcctaacctggacatcataggtaagcggattgagaaaatcaagcaggagcatgaaaccagctggcactatgatcaggaccatccatacaagacatgggcttatcacggctcgtacgagactaaacaaaccgggtctgccagttccatggttaatggagtggtccgtctactcacaaagccctgggacgtgatcccgatggtaacccagatggcaatgactgatacgacacctttcggccagcagagagtgtttaaagaaaaggttgacacccgcactcaagagcccaaagagggtaccaagaagctgatgaaaattacagccgaatggttgtggaaggagctggggaaaaagaaaacgccaaggatgtgtacccgggaagagttcactagaaaggtccgcagcaacgctgcgctcggagccatatttacagatgagaataaatggaagtcagcaagggaagctgtggaggactccggcttctgggaacttgtggataaggagcgaaacctgcacttagaaggcaaatgcgagacctgtgtctataatatgatggggaagcgggagaaaaagctgggagaatttggtaaagccaagggctctagagcaatctggtacatgtggttgggggccaggttcctcgagtttgaagctctgggattcctaaacgaggaccattggtttagccgcgaaaatagtctttccggcgttgagggtgaggggctgcacaagctcggatacattctgcgtgatgtgagcaaaaaggaaggcggcgccatgtatgcggacgatactgcagggtgggacacacggatcaccttggaggatctgaaaaacgaagagatggtaacaaatcatatggaaggagagcacaagaaactcgccgaggctattttcaaacttacttaccagaacaaggtggtcagagtgcagaggcctacaccccgcggtacggttatggacatcatatctcgacgggaccagagaggctcagggcaagtggtcacctatggactgaacacattcactaatatggaagcccagttaatcaggcagatggagggcgaaggtgtgtttaaaagtattcaacagctgaccgtaaaggaggagatcgcagttaaaaactggttgattcgcgtggggagagaacggctctccaggatggctatcagcggagatgactgcgtcgtgaagccactggatgaccgtttcgcctctgctctaacagcccttaatgatatgggcaaagtgcgaaaggacattcagcagtgggagccctcgcgcggctggaacgattggactcaagtccctttttgctcacatcacttccacgaactgataatgaaggacgggagagttctcgtggtaccatgtcggaatcaggatgagctgatcggaagggcacgcattagccagggtgcgggctggtccttgagagaaaccgcctgcttagggaaaagttacgctcagatgtggtctctgatgtattttcatcggagggacctccgacttgccgcaaacgctatctgtagcgccgtgccgtcccactgggtccccacgtcacgtacaacctggagtatccatgcaactcacgagtggatgacaaccgaggatatgctgactgtgtggaatagagtttggattcaagaaaacccttggatggaggacaagaccccagtggaatcttgggaggaaataccctacctaggaaaacgcgaggatcagtggtgcggcagcctgatcggtctcacatcccgggccacgtgggcgaagaatattcagaccgctatcaaccaggtcaggtcattgattgggaatgaggaatatactgactacatgcctagcatgaaaagattccgccgggaggaagaggaagccggagtgctgtggtga

SEQ ID NO: 14986 - RNA, 9876 nt, synthetic construct
  misc_feature 1..9876: note = derived and/or modified CDS sequence (opt3) from DENV-2__JN851115__SS-prME
  source 1..9876: mol_type = other RNA
accgccggaatcattataatgatgatccccacagtgatggctttccacctgactacgcgaaacggggaacctcatatgattgtcagcaggcaggaaaagggaaaatccctcctttttaagaccgaaaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactcggaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgaggtgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacaccctgcgacgctgcggaagtactgcgtggaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaaggtcgttcagcctgaaaaccttgagtatacaatcgtgattaccccacactccggagaagagaatgccgtaggtaacgatactggcaaacatgggaaggagataaaagtgacgccgcagtcaagtatcacagaagcagagctcaccggatacggcactgtcaccatggaatgtagccccaggacaggtctggacttcaatgagatggtgcttctgcagatggaaaacaaggcttggttggttcaccggcaatggctcctggatttacctctgccatggctccccggggccgacacccagggctctaactggattcagaaagagactcttgtgacatttaagaatcctcacgcgaagaaacaggatgtcgtggtactgggatcccaagagggcgccatgcatacggcattgaccggggctactgaaatccagatgtcaagcggaaacctactgttcacaggtcacctcaagtgccgtctgcgcatggacaaacttcagctgaagggcatgagttattctatgtgtaccgggaaatttaaggttgtgaaggagatagccgaaacacaacatggaactattgtcatcagagtgcagtacgagggcgacggttccccatgcaaaatccccttcgagattatggatttggaaaagaggcacgtcctcgggcggctgatcaccgtgaatccgattgttacggagaaagacagccctgtgaacatagaagctgagcccccattcggcgattcgtacatcattatcggagtagaacctggccagttaaagctgtcttggtttaaaaaggggtcctcaatcggacagatgttcgagaccacaatgcgaggtgccaagcgcatggcaattctaggcgacactgcctgggattttgggagtctcggaggcgtcttcaccagcataggtaaagctctgcatcaagtgtttggggcgatctatggcgcagccttctccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatatttatcacagataatgtgcacacctggactgaacagtataagttccagcccgagagcccatccaagttggcctctgcaattcaaaaagcccacgaagagggcatctgtggtattaggtcggtgacacggctcgaaaacctgatgtggaagcagatcacccccgagttaaatcatatactgactgagaacgaagtaaaactaaccattatgacaggcgacatcaaggggattatgcaggctggaaaacgcagcctcagacctcagccaacggagctgaagtactcctggaaagcctggggcaaggcaaagatgctttcaaccgaattgcacaatcatacttttctgatcgatgggccggagacagcggaatgccccaacaccaatagggcttggaacagtctcgaggtcgaggactatggattcggcgtgtttacaactaatatatggctgaaattaaaggaacgtcaagatgttttctgtgactctaaactgatgagcgccgcaatcaaggacaaccgggccgtgcacgctgatatgggttactggattgagtccgcccttaacgacacctggaaaatcgaaaaggcatcatttattgaggtcaagagctgccactggcctaaatctcatacgttgtggtccaatggggtgctcgagagtgaaatgatcataccaaagaacttcgctggacccgttagccagcacaattatcgacctggctaccatacacagaccgccggtccatggcacctgggcagactagagatggatttcgacttttgtgaagggactaccgtggtagtcacagaggattgcggaaacaggggcccctctctgcgcactaccacagcgtccgggaaactcattacggaatggtgctgtcggtcatgcaccctgccgcctcttagatacaggggagaggacggctgttggtatggtatggagatccgcccattgaaggaaaaagaggaaaatctggtgaacagtttagtgactgccgggcatggacagatcgataatttcagcctcggcgtcctgggtatggctctttttctggaggaaatgttgcgaacacgggttggcaccaagcacgcaattctcctggtggccgtatcgttcgtgactctaatcacagggaacatgtcctttcgtgacctgggaagagtcatggtgatggttggcgctaccatgacggatgacattgggatgggagtgacttacctcgccctgcttgcagcgttcaaggtcaggcccacctttgccgctggcttgctgttacgcaaactcacatctaaggagctgatgatgaccactataggtatcgtgcttctgagccaatcaacaattcctgagagtatcctagaactcaccgatgccctggcattggggatgatggttctgaaaattgtgcggaatatggagaagtatcagttagctgtcacaatcatggccatactctgcgtacccaacgcagtgatcctgcagtccgcctggaaagtttcttgtactacccttgctgtggtcagcgtgtccccactgttgctcacgtcaagccaacagaaggcggactggattcctctggccctaacaatcaagggactgaatcccaccgcaattttccttactaccctcagtagaacatctaaaaagaggtcctggccactgaacgaagctatcatggccgtaggcatggtgagcatattggcctcgtcactgctaaagaatgatattccgatgactggccctctcgtcgctgggggactgcttaccgtttgctacgtgctgacgggtcgatctgcagacttggagctcgaacgcgccgcggacgtgcggtgggaggagcaggctgaaatcagtggctccagccccatcctgtctattacaataagcgaggatgggtccatgtcaatcaagaacgaagaggaggaacagaccctaactattctgatcagaacaggacttctcgtcattagtggcctgtttccagtgagcatccccataaccgccgcagcctggtatttgtgggaggttaaaaagcaaagggctggtgtattatgggacgtgccttctccaccccctgtcgggaaagcagaactggaggatggagcctaccgtatcaagcagaagggcattctcggctattcccagatcggggcgggagtgtacaaagaaggtactttccacacaatgtggcatgttacccgcggcgctgtgctgatgcacaaggggaaacggattgagccgtcatgggccgacgtcaagaaagatcttatcagttacggaggcggttggaagctggagggggaatggaaggagggagaagaggtgcaggtattggcactagaaccaggcaaaaatcccagagccgtccaaacgaagcctggcctgtttaaaactaacaccgggacaataggagctgtgagcctcgacttctccccaggtacctctggctcgcccattgttgataagaaagggaaggtggtcggactgtatggcaacggtgtggttacaaggagcgggacttacgtgtcagccatcgcacagaccgagaagtccatcgaggacaatcctgaaattgaggatgacatctttcggaaaaagagacttacgataatggatttacatccgggagctggcaaaacaaagcgctatctgcccgccattgtcagagaagcgatcaaaaggggcctccggactttgattctggccccaacccgagtggtagcagctgagatggaagaggccctcagagggctgcctatccgctaccagacacccgctataagggcagagcacaccggacgtgaaattgtggaccttatgtgtcatgccactttcaccatgcggctgttgagtccaatcagagttcctaactataatctaatcattatggatgaggcccacttcacagaccccgcttctatcgcggcaaggggttacattagcacgcgcgtcgaaatgggcgaggccgctgggatatttatgactgccaccccaccgggatcccgagaccctttcccccagtcaaacgcaccaatcatggatgaggaaagagagattcccgaacggtcttggaatagcggccacgagtgggtgacagactttaagggtaagaccgtgtggttcgtccctagtatcaaagccgggaacgatatcgctgcgtgcctgaggaagaatggcaaaaaggtaattcaactctcccgcaaaacttttgacagcgaatatataaagacacgtaccaacgattgggacttcgtggttacgactgatatctctgagatgggcgccaattttaaggcagagagagtgattgacccacggaggtgtatgaaacccgtcatcttaacagatggcgaagaacgcgtgattctggctgggcctatgccggttacccattcatccgccgcacagcgaagaggacgggtgggtaggaacccaaagaatgaaaacgaccagtacatctacatgggcgagccccttgaaaatgatgaggactgcgcccactggaaagaggctaagatgctgctcgacaacataaatacccctgaagggatcattcccagtatgttcgagccagaacgcgagaaagtcgatgccatcgacggagaatatagattgaggggcgaggcgcggaagacttttgtggatctgatgcgtcgcggtgacctccctgtatggctggcataccgagtggccgctgaggggattaactatgccgatagaaggtggtgtttcgacggcgttaaaaacaatcaaatccttgaagagaacgtcgaagtggagatatggacaaaggagggagaacggaagaaactaaagccccgctggctggatgctagaatttacagcgacccattggcattaaaagagtttaaggagttcgccgctggcaggaaatcgctgaccctcaatctgatcacagagatggggcggcttcctactttcatgacgcagaaggccaagaacgcactggataatctcgcggtgttgcataccgccgaagctggaggtcgagcctataaccacgcactgtctgagctaccggagacactggaaactctccttctgttaaccttgctggctacagtcaccggcgggatttttctcttcctgatgtccggaaaaggcatcggtaagatgactcttgggatgtgctgcataatcacggccagcattctgctctggtacgcacagatccagccccactggattgccgcttcaatcatattggagtttttcctgattgttttactaatcccagaacctgagaaacaaagaacaccccaggacaatcagctgacatatgtggtaatcgcgattctcactgtggtcgccgcaaccatggctaacgaaatgggctttcttgagaagaccaaaaaggatttcggactgggcagtatcaccactcagcaaccagagtctaatatattggacattgatctgcgccctgcctccgcctggacactctacgcagtggctacgacctttatcactcccatgctgaggcatagcattgaaaactcaagtgttaatgtgagccttacagccatcgcgaaccaggctaccgtcctcatggggctgggaaagggttggccgttgtccaaaatggacataggcgtaccactgttagccatcgggtgttactctcaggtgaatcctattaccctaacagcagccctgctccttctggttgctcactatgcaatcattggacccggcttgcaggccaaggcgactcgggaggctcaaaaacgtgccgcagccggtatcatgaagaacccaacggtggacgggatgaccgtcattgatctggaccccatcccttacgatccgaaattcgaaaagcagctcggccaggtgatgctgcttgtcttatgcgtgacacaggttctgatgatgagaactacctgggctctctgtgaggccttgacactggcaaccggacccataagcactctatgggaaggcaatccagggaggttttggaacacgacaattgctgtgtccatggccaatatcttccgcggatcatatctggcgggcgccggtctcctattttctatcatgaagaacaccgcaaacactcggcgagggaccggaaatacaggcgagactctgggtgagaaatggaagaacagattgaatgctctgggcaaaagtgagttccaaatttacaagaaatcggggatacaggaggtagacaggaccctcgccaaggaaggaatcaaacgcggcgagacagatcatcacgcagtgagccgggggtccgctaagctgagatggtttgtcgagcgtaacttagttacgcctgaaggaaaggtggtcgaccttggctgcggtagagggggatggtcttattactgtggcggtctgaaaaatgtgaaggaggtaaaaggcctcaccaaagggggacccggccatgaagaacctattccaatgtcaacttatgggtggaacctagtgcggctgcagagcggagttgatgtgttcttcacaccccctgaaaaatgcgacaccttgctgtgtgatatcggcgagtccagtccaaatcccactgtcgaggccggtcgcacactccgagtgcttaacctggtcgaaaattggttgaacaataacacccaattttgcattaaggtgctgaatccgtacatgccttctgttatcgagaagatggaagccctccagagaaaatacgggggagcgttagtaaggaacccactgagcagaaattcaacgcacgagatgtattgggtgtccaacgctagtggcaacatagtcagctctgtgaatatgatctcccgcatgcttattaacagattcaccatgaggcacaagaaagcaacatacgaacccgacgttgatctgggctcagggactcgaaatatcggaattgagagcgagacccctaacctagacatcataggtaagcggattgagaaaatcaagcaggagcatgaaacatcgtggcactatgatcaggaccatccatacaagacttgggcctatcacggctcttacgagaccaaacaaacagggagtgcttccagcatggtgaatggagtcgtgcgtctcctgaccaagccctgggacgtaatcccgatggtgactcagatggccatgacggatacaaccccttttggccagcagagagttttcaaagaaaaggtcgacactcgcacccaagagcccaaagagggtacaaagaagttgatgaaaattacggcagaatggctgtggaaggagctcgggaaaaagaaaaccccaaggatgtgtactcgggaagagtttacaagaaaggtgcgctcaaacgccgctcttggagcgatattcaccgatgagaataaatggaagtccgccagggaagcagtggaggactctggcttttgggaactggtcgataaggagcgaaacttacacctggaaggcaaatgcgagacttgtgtttataatatgatggggaagcgggagaaaaagttgggagagttcggtaaagctaagggcagcagagccatctggtacatgtggctcggggcaaggtttctggagttcgaagccctaggatttcttaacgaggaccattggttcagtcgcgaaaattccctgagcggcgtggagggtgaggggctccacaagctgggatacattttgcgtgatgtatctaaaaaggaaggcggcgctatgtatgccgacgatacagcggggtgggacacccggatcacactggaggatctcaaaaacgaagagatggtgactaatcatatggaaggagagcacaagaaacttgcagaggccatttttaagctgacctaccagaacaaggtcgtgagagttcagaggcctacgccccgcggtaccgtgatggacatcatatcacgacgggaccagagaggcagtgggcaagtcgtgacatatggattaaatactttcaccaacatggaagctcagctgatcaggcagatggagggcgaaggtgtattcaaatccattcaacagttgacagttaaggaggagatcgccgtgaaaaactggctcattcgcgtcgggagagaacggctgagcaggatggcaatctctggagatgactgcgtggtgaagccactagatgaccgttttgcttcggcccttactgctctgaatgatatgggcaaagtccgaaaggacattcagcagtgggagccctcacgcggctggaacgattggacccaagttcctttctgcagccatcactttcacgaactcataatgaaggacgggagagtgctggtagtgccatgtcggaatcaggatgagttgatcggaagggcccgcatttcccagggtgcaggctggagtttaagagaaacggcgtgcctggggaaatcttacgcccagatgtggagcctcatgtatttccatcggagggaccttcgactggctgccaacgcaatctgttccgctgtcccgtcacactgggtgcccacaagtcgtaccacttggtctatccatgccacacacgagtggatgaccactgaggatatgctaaccgtttggaatagagtgtggattcaagaaaacccttggatggaggacaagacaccagtcgaaagctgggaggaaataccctacctgggaaaacgcgaggatcagtggtgcggctccctcatcggtttgacgtcacgggcaacctgggccaagaatattcagactgcgatcaaccaggtgaggagcctgattgggtatgaggaatacacagactacatgccttctatgaaaagatttcgccgggaggaagaggaagctggagtactttggtga

SEQ ID NO: 14987 - RNA, 9876 nt, synthetic construct
  misc_feature 1..9876: note = derived and/or modified CDS sequence (opt3) from DENV-2__JN851127__SS-prME
  source 1..9876: mol_type = other RNA
accgcaggcatcattataatgatgatcccaacagtgatggctttccacctgactacgcggaacggggaacctcatatgattgtcagcaggcaggaaaagggaaaatccctcctttttaagaccgagaatggtgttaacatgtgcacactgatggcaatggacttgggcgaattatgtgaggatactatcacctacaattgcccactgctgaaacaaaacgaaccggaggacattgattgttggtgcaattctacatcaacctgggtgacttatgggacatgtaccgccacgggagagcaccggcgcgaaaagcgaagtgtagcgctcgtgccacatgtcggcatgggtctggagactcgtaccgaaacatggatgagctccgagggggcttggaaacacgcccagagaatcgagacttgggtgcttaggcatcctggattcaccataatggcagccatcctggcttacacaattggcaccacgtattttcagcgggttttgatcttcattctcctgactgcagtggccccatctatgacaatgcgctgcatcggcatatcgaacagagactttgtcgaaggggtgtcaggaggtagctgggtagatattgttctggagcacggcagttgtgtgaccactatggctaagaataagcccacactcgacttcgaattaatcaaaaccgaggccaagcaccctgcgacgctgaggaaatactgcattgaagcaaaacttaccaacacaactaccgcctcccggtgtccaacacagggggagccctctttgagcgaggaacaagataaacgctttgtctgcaagcattccatggtggaccgaggatggggcaatggttgtgggctgttcggaaagggcggcatcgtgacttgcgctatgtttacctgcaaaaagaacatggaggggaaaatcgtccagcctgaaaatctagagtatacaattgttataaccccacactcaggagaagagaacgccgtgggtaatgatactggcaagcatgggaaagagatcaaggtaacgccgcagagtagcattacagaagcagagctcaccggatacggcactgtgaccatggaatgttctcccagaacaggtctggacttcaacgagatggtccttctgcagatggaaaataaggcttggttggtgcacaggcaatggtttctcgatctgcctttaccatggctgcccggggccgacacccagggctccaactggatccagaaggagactctcgttacattcaagaaccctcacgcgaaaaagcaggatgtggtcgtgcttggatcacaagagggcgccatgcatacggcactgaccggggctactgaaatacagatgagcagtggaaatttgctatttacaggtcacctgaaatgccggctccgtatggacaagctgcagcttaaaggcatgtcttattccatgtgtaccgggaagttcaaggtagttaaagagattgccgaaacacaacatggaactatcgtgatccgcgtccagtacgagggcgacggtagcccatgcaagattcccttcgagatcatggatctggagaagagacacgtgttggggaggctcattaccgtcaacccgatagtgacggagaaggactcgcctgttaatatcgaagctgagcccccatttggcgattcttacattatcatcggagtggaacctggccagctgaaattatcctggttcaagaaggggtcaagtattggacagatgtttgagaccacaatgcggggtgccaaacgaatggcaatactgggcgacactgcctgggatttcgggagcctaggaggcgtatttacctccatcggtaaggctctccatcaagtcttcggggcgatttatggcgcagccttttctggagtgagctggacaatgaaaatcctgattggcgttgtgatcacttggatagggatgaactcacgcagtacctcccttagcgtctctttggtgctggtaggagtggttacgctctacctgggcgtcatggtgcaggctgactcaggttgtgtggtcagttggaagaataaagagcttaagtgcgggagcggaatcttcattacagataacgttcacacctggactgaacagtataagtttcagcccgagtccccatctaaactggcctcggcaatccaaaaggcccacgaagagggcatttgtggtatcagaagcgtgacaaggttggaaaatctcatgtggaaacagataacccccgagctgaaccatattttatccgagaatgaaatcaagctgactattatgaccggcgacatcaaagggataatgcaggctggaaagcggtcactacgccctcagccaatcgagctcaaatacagttggaaggcctggggcaaggcaaaaatgctgtctacagaacttcacaaccatacgttcttgattgatgggccggagaccgcggaatgccccaatactaacagagcttggaatagcctggaggtggaggactatggatttggcgtattcacaaccaacatctggctcaagctgaaagaaaggcaagatgtcttttgtgactccaagttaatgtcagccgtgattaaagacaatcgtgcagttcacgccgatatgggttactggatcgagagcgctctgaacgacacatggaagatagaaaaggcctctttcattgaggtgaaatcctgccactggcctaagagtcatactctttggagcaacggggtcttggagtctgaaatgatcatccccaagaatttcgcaggacccgtgtcccagcacaactatcggcctggctaccatacccagacggctggtccatggcacctcggccgactggagatggattttgacttctgtgaagggacaaccgttgtggtaactgaggattgcggaaatagaggcccctcactaaggaccacaactgccagtgggaagctgattaccgaatggtgctgtcgcagctgcacactcccgcctctgcggtacagaggagaggacggctgttggtatggtatggagatcaggccacttaaagaaaaggaggaaaacttggtcaattcgctggtgacggcggggcatggacagattgataacttttccttaggcgtgctcggtatggccctgttccttgaggaaatgctgcgcacccgagtcggcactaagcacgctatattgctcgttgcagtgtcttttgtaacactgatcaccgggaatatgagcttccgggacctaggacgtgtgatggtcatggtgggcgccactatgacagatgacattgggatgggagttacctacctggctctcctggccgcatttaaagtgagacccacgttcgcggccggccttttgctgaggaagttaacttcaaaagagctcatgatgaccacaatcggtattgtcctgcttagtcaatccaccatccctgagactatactggaactaacagatgctctcgccctggggatgatggtgttgaagatcgttcgcaacatggagaaatatcagctggcagtgaccattatggctatcttatgcgtccccaatgccgtaattctccagaacgcatggaaggtgtcttgtacaactctggccgttgtgagcgtctccccacttctgttgacctcaagccggcaaaaggctgactggatccctctcgcgctgacgataaaaggactaaatcccacagccatttttctgaccactcttagtagaacctctaagaaaaggtcctggccactcaacgaagcaatcatggctgtgggcatggtaagcatcctggcctcgtcattgctgaagaatgatattccgatgacaggccctttagtggccgggggactcctgactgtctgctacgttcttaccggtcgatctgctgacctggagttggaacgcgcagccgacgtgcggtgggaggagcaggcggaaataagtggctccagccccatcctctctattacgatcagcgaggatgggtccatgtcaattaaaaacgaagaggaggaacagacactgaccatcctaataagaactggactgcttgtgatcagtggcctcttcccagtcagcattcccatcacagctgccgcatggtatctgtgggaggtgaagaaacagagggccggtgttttgtgggacgtaccttctccaccccctgtggggaaggctgaattagaggatggagcataccgtattaagcaaaaaggcatcctgggctattcccagataggggccggagtctacaaggaaggtacctttcacactatgtggcatgtgacacgcggcgcggttctcatgcacaaagggaagcggattgagccgtcatgggctgacgtgaaaaaggatctgatcagttacggaggcggttggaaacttgagggggaatggaaagagggagaagaggtccaggtgctggccttggaaccaggcaagaatcccagagcagtacagaccaaacctggcctattcaagacgaacactgggaccatcggagccgtcagcctggacttttccccaggtacatctggctcgcccattgtggataaaaaggggaaggttgtgggactctatggcaacggtgtcgtgaccaggagcgggacatacgtttcagctatcgcccaaactgagaaatccatagaggacaatcctgaaattgaggatgacatcttccgaaagaaacggctgaccattatggatcttcatccgggagcaggcaagacgaaacgctatttacccgctatcgtgagagaagccataaagaggggcctgcggacactcattttggcgccaactcgagtcgtggccgcagagatggaagaggctctgagagggctccctatccgctaccagacccccgccatcagggctgagcacacaggacgtgaaattgtagacctgatgtgtcatgcaaccttcactatgcggcttctgagtccaatcagagtgcctaactataatttgattataatggatgaggcccactttaccgaccccgcctctatcgctgcgaggggttacattagcacacgcgttgaaatgggcgaggcagccgggatcttcatgacggctactccaccgggatcccgagacccttttccccagtcaaacgccccaatcatggatgaggaaagagagattcccgaacggtcttggaatagcggccacgagtgggtcaccgacttcaagggtaaaacagtgtggtttgtgcctagtataaaggcagggaacgatatcgccgcttgcctaaggaaaaatggaaagaaagtcattcagctgtcccgcaagaccttcgacagcgaatatatcaagactcgtacaaacgattgggactttgtagtgaccacggatatttctgagatgggcgcgaatttcaaagccgagagagttatcgacccacggaggtgtatgaagcccgtgatactcactgatggcgaagaacgcgtcatcttagcagggcctatgccggtgacacattcatccgctgcccaacgaagaggacgggttggtaggaaccccaagaatgaaaacgaccagtacatttacatgggcgagcccctggaaaatgatgaggactgcgcacactggaaggaggccaaaatgcttctggacaacatcaatacccctgaagggattatccccagtatgtttgagccagaacgcgagaaggtggatgctatagacggagaatatagactcaggggcgaggcccggaaaaccttcgtcgatttgatgcgtcgcggtgacctgcctgtgtggctcgcgtaccgagtagcagccgaggggattaactatgctgatagaaggtggtgttttgacggcgtgaagaacaatcagatcctggaagagaacgttgaagtcgagatttggactaaggagggagaacggaagaaacttaaaccccgctggctagatgccagaatctacagcgacccactggctttgaaagagttcaaagagttcgcagccggcaggaagtcgttaacactgaatctcataaccgagatggggcggctgcctacatttatgactcaaaaggctcgaaacgcccttgataatctggcagtgctccatacggcggaagccggaggtagagcttataaccacgccttgtctgagctgccggagaccctagaaacactgctccttctgactttattggcaaccgtgacaggcgggatcttcctgtttctcatgtccggaaaaggcattggtaagatgaccctggggatgtgctgcatcattactgctagcatccttctgtggtacgcccagatacagccccactggattgcagcctcaatcatcctcgagttctttttgattgtcctgttaatcccagaacctgagaaacagcgcacgccccaagacaatcagctaacctatgttgtgatagctattctgacagtagtggcggccactatggcaaacgaaatgggcttcctcgagaagaccaaaaaggattttggacttggcagtatcacaacccagcagccagagtctaatattctggacatcgatttgaggcctgcttccgcctggactctgtacgccgtcgcaacaacgttcataacccccatgctccggcatagcatcgaaaactcaagtgtgaatgttagcctgactgctattgccaaccaagcgacagtgcttatggggctcggaaagggttggccgctgtccaaaatggacatcggcgtcccattgctggctattgggtgttactctcaggtaaatcctatcaccttaaccgccgcactactgctccttgtggcccactatgctattatcggacccggcctgcaggcaaaggccacacgtgaggcgcagaaaagagctgccgcaggtataatgaagaacccaactgttgacgggattacggtgatcgatttggaccccatcccttacgatccgaaatttgaaaagcaactgggccaggtcatgctcctggtgctttgcgtcacccaggtgttaatgatgaggacaacttgggccctgtgtgaggctctcaccttggccacaggacccattagcaccctgtgggaaggcaatccagggcgcttctggaacactacgatagcagtttccatggctaatatctttcggggatcatatctagccggcgcgggtctactcttctctattatgaagaacacagccaacacccgaagagggactggaaataccggcgagacacttggtgagaaatggaagaacaggctgaatgcattgggcaaaagtgaatttcagatctacaagaaatcggggattcaagaggtggaccgcactctggctaaggaaggaatcaaacggggcgagaccgatcatcacgccgtaagcagagggtccgcaaagctccgttggttcatagagaggaacctggtgacacctgaaggaaaggtcgttgacttaggctgcggtagaggcgggtggtcttattactgtgggggtcttaaaaatgtgaaggaggtcaaaggcctgacgaaagggggacccggccatgaagaacctatcccaatgtcaacctatgggtggaacctcgtgcgcctacagagcggagtagatgtgttctttactccccctgaaaaatgcgacacactgttgtgtgatattggcgagtccagtccaaatcccaccgttgaggctggtcgaactctgagagtgctcaaccttgtcgaaaattggctgaacaataacacacagttctgcatcaaggtgttgaatccgtacatgccttctgtcattgagaagatggaagccctgcaaaggaaatacgggggagccctcgtgcggaacccattaagccgcaattcaacccacgagatgtattgggtttccaacgcgagtggcaacatcgtaagctctgtgaatatgatatccagaatgctgattaacaggtttacgatgcgacacaagaaagctacctacgaacccgacgtcgatcttggctcagggacacggaatatcggaatcgagagcgagactcctaacctggacattataggtaagcgtatcgagaaaattaagcaggagcatgaaacctcgtggcactatgatcaggaccatccatacaagacatgggcatatcacggctcttacgagactaaacagaccgggagtgcctccagcatggtgaatggagttgtgagactactcacaaagccctgggacgtcatcccgatggtgacccaaatggctatgactgatacgacacctttcggccagcagcgcgtatttaaagaaaaggtggacaccaggactcaggagcccaaagagggtaccaagaagctgatgaaaattacagccgaatggttgtggaaggagctggggaaacggaagacgccaagaatgtgtacccgcgaagagttcactaggaaagttcgatcaaacgcagccctcggagctatctttacagatgagaataagtggaaatccgcgcgggaagccgtcgaggactctggcttctgggaacttgtggataaggagagaaacctgcacttagaaggcaagtgcgagacctgtgtgtataatatgatggggaaaagggagaagaaactgggagaatttggtaaggcaaaaggcagccgcgctatatggtacatgtggttgggggcccgtttcctcgagtttgaagcactgggattcctaaacgaggaccattggtttagtcgggaaaattcccttagcggcgtcgagggtgaggggctgcacaagctcggatacatcctgagagatgtttctaagaaagaaggcggcgccatgtatgctgacgatactgccgggtgggacacaaggattaccttggaggatctgaagaacgaagagatggtgacaaatcatatggaaggagtacacaaaaagctcgcggaggcaatcttccgccttacttaccaaaacaaagtggtccgagtgcagcggcctacccccagaggtacggttatggacattatctcaaggcgcgaccagagaggcagtggacaggtggtcacctatggactgaatacattcactaacatggaggcccaattaattcggcagatggaaggcgagggtgtgtttaagtccatacagcatctgaccgtaacagaagagatcgctgttaagaactggttggtgagggtcgggcgtgagcgactcagccgcatggccatttctggagatgactgcgtggtgaaaccactggatgacagattcgcatcggctctaactgcccttaatgatatgggcaaggtccggaaagacatccaacagtgggaaccctcaaggggctggaacgattggacccaggttcctttttgcagccaccacttccatgagctgatcatgaaggacgggcgcgtgctcgtagtgccatgtagaaatcaggatgaactgattggacgggctaggatatcccaaggtgccggctggagtttgcgagagacggcatgcttagggaaatcttacgcgcagatgtggagcctgatgtattttcaccgtagagacctccgccttgccgctaacgccatctgttccgcagtcccgtcacattgggtgcccacaagtcggaccacttggtctattcacgctacacacgaatggatgaccactgaggatatgctgaccgtttggaatagggtgtggatccaggagaacccttggatggaagacaagacaccaattgagagctgggaagagatcccctacctaggaaagagagaagatcagtggtgcggctccctgataggtctcacgtcacgcgccacctgggccaaaaatatccaaactgccattaaccaggtccggagcttgatcgggaatgaggagtatacagactacatgccttctatgaagaggttccgaagagaagaggaagaggcgggagtgctgtggtga

SEQ ID NO: 14988 - RNA, 9876 nt, synthetic construct
  misc_feature 1..9876: note = derived and/or modified CDS sequence (opt3) from DENV-2__JN851120__SS-prME
  source 1..9876: mol_type = other RNA
accgccggaatcattataatgatgatccccacagtgatggctttccacctgactacgcgaaacggggagcctcatatgattgtaagcaggcaggaaaagggaaaatccctcctttttaagaccgagaatggtgttaacatgtgcacactgatggcaatggacttgggcgaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgtagcgctcgtgccccatgtaggcatgggtctggagactagaaccgaaacatggatgagctccgagggggcttggaagcacgcccagaggatcgagacttggatacttcggcatcctggattcaccatcatggcagccattctggcttacacagtgggcaccacgtattttcagcgcgttttgatcttcattctcctgactgcagtgacaccatctatggccatgaggtgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaacaccctgcgacgctgcggaagtactgcgtcgaagcaaaacttaccaacacaactaccgcctcccgctgtccaacacagggggagccctctttgaatgaggaacaagataagcgatttgtgtgcaaacatagcatggtggacagaggatggggcaacggttgtgggctgttcggaaagggcggcattgtcacttgcgctatgtttacctgcaagaaaaatatggaggggaaggttgtgcagcctgaaaacctagagtatacaatcgtaatcaccccacactccggagaagagaatgccgtgggtaacgatactggcaaacatgggaaggagattaaagtcacgccgcagtcaagtataacagaagcagagctcaccggatacggcactgtgaccatggaatgtagccccaggacaggtctggacttcaatgagatggttcttctgcagatggaaaacaaggcttggttggtgcaccggcaatggtttctcgatctgcctttaccatggctgcccggggccgacacccagggctctaactggatccagaaagagactctcgtcacattcaagaatcctcacgcgaagaaacaggatgtggtagttcttggatcccaagagggcgccatgcatacggcactgaccggggctactgaaattcagatgtcaagcggaaacttgctatttacaggtcacctgaagtgccgtctccgcatggacaaactgcagcttaagggcatgagttattctatgtgtaccgggaaattcaaggtggtcaaggagatcgccgaaacacaacatggaactatagtgattagagtccagtacgagggcgacggttccccatgcaaaatccccttcgagatcatggatctggaaaagaggcacgtgttggggcggctcattaccgttaatccgatcgtgacggagaaagacagccctgtaaacattgaagctgagcccccatttggcgattcgtacataatcattggagtcgaacctggccagctgaagttatcttggttcaaaaaggggtcctcaatcggacagatgtttgagaccacaatgcgaggtgccaagcgcatggcaatcctgggcgacactgcctgggatttcgggagtctaggaggcgtgtttaccagcattggtaaagctctccatcaagttttcggggcgatatatggcgcagccttttccggagtgtcttggacaatgaagatcctgattggcgtcgtgatcacttggattgggatgaatagcagatcaaccagtctttccgtcagcttggtgctggttggagtcgtgacgctctacctgggcgtgatggtccaggctgactctggttgtgttgtgtcatggaaaaacaaggagcttaaatgcgggagtggaatcttcataacagataatgtgcacacctggactgaacagtataagtttcagcccgagagcccatccaagctggcctctgcaatccaaaaagcccacgaagagggcatttgtggtatcaggtcggtaacacggttggaaaacctcatgtggaagcagattacccccgagctgaatcatatcttaactgagaacgaagtcaaactgaccataatgacaggcgacattaaggggatcatgcaggctggaaaacgcagcctaagacctcagccaacggagctcaagtactcctggaaagcctggggcaaggcaaagatgctgtcaaccgaacttcacaatcatactttcttgattgatgggccggagacagcggaatgccccaacaccaatagggcttggaacagtctggaggtggaggactatggatttggcgttttcacaactaatatctggctcaaactgaaggaacgtcaagatgtgttttgtgactctaaattaatgagcgccgcaataaaggacaaccgggccgtccacgctgatatgggttactggatcgagtccgccctgaacgacacctggaaaattgaaaaggcatcattcatcgaggtgaaaagctgccactggcctaaatctcatacgctttggtccaatggggttttggagagtgaaatgattatcccaaagaacttcgctggacccgtgagccagcacaattatcgacctggctaccatacacagaccgccggtccatggcacctcggcagactggagatggattttgacttctgtgaagggactaccgtagtcgtgacagaggattgcggaaacaggggcccctctctacgcactaccacagcgtccgggaaactgataacggaatggtgctgtcggtcatgcaccctcccgcctctgagatacaggggagaggacggctgttggtatggtatggagattcgcccacttaaggaaaaagaggaaaatttggtgaacagtctggtcactgccgggcatggacagatcgataattttagcttaggcgttctcggtatggctctgttccttgaggaaatgctgcgaacacgggtgggcaccaagcacgcaatcttgctcgtagccgtgtcgtttgtcactctgattacagggaacatgtccttccgtgacctaggaagagtgatggttatggtgggcgctaccatgacggatgacatcgggatgggagtcacttacctggccctcctggcagcgtttaaggtgaggcccaccttcgccgctggccttttgctgcgcaaattaacatctaaggagctcatgatgaccactattggtatagttctgcttagccaatcaacaatccctgagagtattctggaactaaccgatgccctcgcactggggatgatggtgttgaaaatcgtccggaatatggagaagtatcagctggctgtaacaattatggccatcttatgcgtgcccaacgcagttatactccagaatgcctggaaagtgtcctgtactaccctggctgtcgtgtctgtaagcccacttctgttgacgtcctcacaacagaaggcggactggatccctctcgccctgacaattaagggactaaaccccaccgcaatctttctgactacccttagcagaacaagtaaaaagaggtcttggccactcaatgaagctattatggccgtgggcatggtctccatcctggccagctcgttgctgaaaaacgatataccgatgactggccctttagttgctgggggactcctgaccgtgtgctacgtgcttacgggtcgatcagcagacctggagttggaacgcgccgcggacgtccggtgggaggagcaggctgaaatttctggcagttcccccatcctcagcatcacaatttctgaggatgggagcatgtccataaagaatgaagaggaggaacagaccctgactatcctaattagaacaggactgcttgtgatctcaggcctcttcccagttagtattcccatcaccgccgcagcctggtatctgtgggaggtcaagaagcaaagggctggtgtgttgtgggacgtccctagcccaccccctgtggggaaagcagaattagaggatggagcctaccgtataaagcagaagggcatcctgggctattctcagattggggcgggagtttacaaagaaggtacttttcacacaatgtggcatgtgacccgcggcgctgtcctcatgcacaaggggaaacggatcgagccgtcctgggccgacgtgaagaaagatctgatttcatacggaggcggttggaaacttgagggggaatggaaggagggagaagaggtacaggtcctggcattggaaccaggcaaaaaccccagagccgtgcaaacgaagcctggcctattcaaaactaacaccgggacaatcggagctgttagtctggactttagcccaggtacctccggctctcccatagtggataagaaagggaaggtcgtgggactctatggcaatggtgttgtgacaaggtcggggacttacgtcagcgccattgcacagaccgagaagtcaatcgaggacaaccctgaaatcgaggatgacattttcagaaagaagcggctgacgatcatggatcttcatccgggagctggcaaaacaaagcgctatttacccgccatagtgagagaagcgattaaaaggggcctgcggactctcatcttggccccaacccgagtagtggcagctgagatggaagaggccctgagagggctccctattcgctaccagacacccgctatcagggcagagcacaccggacgtgaaatagttgacctgatgtgtcatgccactttcaccatgcggcttctgtccccaattagagtccctaattataacttgatcatcatggatgaggcccactttacagaccccgctagtattgcggcaaggggttacatctctacgcgcgtggaaatgggcgaggccgctgggattttcatgactgccaccccaccgggaagccgagacccttttccccagtccaatgcaccaataatggatgaggaaagagagatccccgaacggtcatggaactctggccacgagtgggtgacagacttcaagggtaagaccgtctggtttgtacctagcattaaagccgggaatgatatcgctgcgtgcctaaggaagaacggcaagaaggtgatccaactgagtcgcaaaactttcgactccgaatatattaagacacgtaccaatgattgggactttgttgtgacgactgatataagcgagatgggcgccaacttcaaggcagagagagtcatcgacccacggaggtgtatgaaacccgtgattctcacagatggcgaagaacgcgttatcttagctgggcctatgccggtgacccattcttcagccgcacagcgaagaggacgggtcggtaggaatccaaagaacgaaaatgaccagtacatttacatgggcgagcccctggaaaacgatgaggactgcgcccactggaaagaggctaagatgcttctggacaatatcaacacccctgaagggataatcccctccatgtttgagccagaacgcgagaaagtggatgccattgacggagaatatagactcaggggcgaggcgcggaagactttcgtagatttgatgcgtcgcggtgacctgcctgtgtggctcgcataccgagttgccgctgaggggatcaactatgccgatagaaggtggtgttttgacggcgtcaaaaataaccaaattctggaagagaatgtggaagtggagatctggacaaaggagggagaacggaagaaacttaagccccgctggctagatgctagaatatacagtgacccactggcattgaaagagttcaaggagttcgccgctggcaggaagtcgttaaccctgaacctcattacagagatggggcggctgcctacttttatgacgcagaaggccaagaatgcacttgataacctggcggtcctccataccgccgaagctggaggtcgagcctataatcacgcattgagcgagctgccggagacactagaaactctgctccttctgaccttattggctacagttaccggcgggatcttcctgtttctcatgtctggaaaaggcattggtaagatgactctggggatgtgctgcatcataacggcctccatccttctgtggtacgcacagattcagccccactggatcgccgctagcattatcctcgagttctttttgatagtgctgttaattccagaacctgagaaacaaagaacaccccaggacaaccagctaacatatgtagtgatcgcgatcctgactgtcgtggccgcaaccatggctaatgaaatgggcttcctcgagaagaccaaaaaggattttggacttggctcaattaccactcagcaaccagagagtaacatcctggacatagatttgcgccctgcctctgcctggacactgtacgcagttgctacgaccttcattactcccatgctcaggcattccatcgaaaatagctcagtgaacgtcagtctgacagccattgcgaatcaggctaccgtacttatggggctcggaaagggttggccgctgagcaaaatggacatcggcgtgccattgctggccatagggtgttactcccaggttaaccctatcaccttaacagcagccctactgctccttgtggctcactatgcaattatcggacccggcctgcaggccaaggcgactcgggaggctcaaaaacgtgccgcagccggtattatgaagaatccaacggtcgacgggatgaccgtgatcgatttggaccccattccttacgatccgaaatttgaaaagcagctgggccaggtcatgctcctggtgctttgcgttacacaggtgttaatgatgagaactacctgggctctgtgtgaggccctcacattggcaaccggacccatctctactctgtgggaaggcaacccagggaggttctggaatacgacaatagctgtaagcatggccaacatttttcgcggatcctatctagcgggcgccggtctactcttctcaatcatgaagaacaccgcaaatactcggcgagggaccggaaacacaggcgagactcttggtgagaaatggaagaatagactgaacgctttgggcaaatctgaatttcaaatctacaagaaaagtgggattcaggaggtggacaggaccctggccaaggaaggaataaaacgcggcgagacagatcatcacgcagtctcgcgggggagcgctaagctcagatggttcgttgagcgtaatctggtgacgcctgaaggaaaggtcgtggacttaggctgcggtagagggggatggtcctattactgtggcggtcttaaaaacgtaaaggaggtgaaaggcctgaccaaagggggacccggccatgaagaacctatcccaatgtctacttatgggtggaatctcgttcggctacagtcaggagtggatgtcttctttacaccccctgaaaaatgcgacaccctgttgtgtgatattggcgagagctccccaaaccccactgtggaggccggtcgcacactgcgagtcctcaatcttgtggaaaactggctgaataacaatacccaattctgcatcaaggttttgaacccgtacatgcctagtgtaattgagaagatggaagccctgcagagaaaatacgggggagcgctcgtgaggaatccattatctcggaacagcacgcacgagatgtattgggtctcaaacgcttccggcaatatcgtgagtagcgttaacatgatatctcgcatgctgatcaatagatttaccatgaggcacaagaaagcaacatacgaacccgacgtggatcttggctccgggactcgaaacattggaatcgagtcagagacccctaatctggacattatcggtaagcggatagagaaaattaagcaggagcatgaaacaagctggcactatgatcaggaccatccatacaagacttgggcctatcacggctcgtacgagaccaaacaaacagggtctgctagttccatggtcaacggagtggtacgtctactcaccaagccctgggacgtgatcccgatggttactcagatggccatgacggatacaacccctttcggccagcagagagtctttaaagaaaaggtggacactcgcacccaagagcccaaagagggtacaaagaagctgatgaaaatcacggcagaatggttgtggaaggagctggggaaaaagaaaaccccaaggatgtgtactcgggaagagttcacaagaaaggtgcgcagcaatgccgctctcggagcgatttttaccgatgagaacaaatggaagtcagccagggaagcagtcgaggactccggcttctgggaacttgttgataaggagcgaaatctgcacttagaaggcaaatgcgagacttgtgtgtataacatgatggggaagcgggagaaaaagctgggagaatttggtaaagctaagggctctagagccatatggtacatgtggttgggggcaaggttcctcgagtttgaagccctgggattcctaaatgaggaccattggtttagccgcgaaaacagtctttccggcgtagagggtgaggggctgcacaagctcggatacatcctgcgtgatgtgagcaaaaaggaaggcggcgctatgtatgccgacgatacagcggggtgggacacccggattacattggaggatctgaaaaatgaagagatggtcactaaccatatggaaggagagcacaagaaactcgcagaggccatcttcaaacttacctaccagaataaggtggttagagtgcagaggcctacgccccgcggtaccgtcatggacattatctctcgacgggaccagagaggctcagggcaagtggtaacatatggactgaacactttcaccaacatggaagctcagttaataaggcagatggagggcgaaggtgtttttaaaagtatccaacagctgacagtgaaggaggagattgccgtcaaaaattggttgatccgcgtggggagagaacggctctccaggatggcaattagcggagatgactgcgtggtcaagccactggatgaccgtttcgcttctgccctaactgctcttaacgatatgggcaaagttcgaaaggacatccagcagtgggagccctcgcgcggctggaatgattggacccaagtgcctttttgctcacatcacttccacgaactgattatgaaggacgggagagtactcgtggtcccatgtcggaaccaggatgagctgataggaagggcccgcatcagccagggtgcaggctggtccttgagagaaacggcgtgcttagggaaaagttacgcccagatgtggtctctgatgtattttcatcggagggacctccgacttgctgccaatgcaatttgtagcgctgtgccgtcccactgggttcccacatcacgtaccacttggagtatccatgccacacacgagtggatgaccactgaggatatgctgaccgtgtggaacagagtctggatccaagaaaatccttggatggaggacaagacaccagtggaatcttgggaggaaattccctacctaggaaaacgcgaggatcagtggtgcggcagcctgataggtctcacgtcccgggcaacctgggccaagaacatccagactgcgattaatcaggtaaggtcattgatcgggaacgaggaatatacagactacatgcctagcatgaaaagattccgcattgaggaagaggaagctggagttctgtggtga

SEQ ID NO: 14989 - RNA, 9876 nt, synthetic construct
  misc_feature 1..9876: note = derived and/or modified CDS sequence (opt3) from DENV-2__JN851131__SS-prME
  source 1..9876: mol_type = other RNA
accgcaggagtgatcattatgatgataccaacagtaatggctttccacctgactacgagaaacggggaacctcatatgatcgttagcaggcaggaaaagggaaaatccctcctttttaagaccgagaatggtgtgaacatgtgcacactgatggcaattgacttgggcgaattatgtgaggatactatcacctacaattgcccactgctacggcaaaacgaaccggaggacattgattgttggtgcaattctacatcaacctgggtaacttatgggacatgtaccgccacgggagagcaccgccgagaaaaacgtagtgtggcgctcgtaccccatgtgggcatgggtctggagactaggaccgaaacatggatgagctccgagggggcttggaagcacgcccagaggatcgagacttgggttcttcggcatcctggattcaccataatggcagccatcctggcttacacaattggcaccacgtattttcagcgcgtgttgatcttcattctcctgactgcagtcgccccatctatgacaatgagatgcatcggcatatcgaacagggactttgtggaaggggtatcaggaggtagctgggttgatattgtgctggagcacggcagttgtgtcaccactatggctaaaaataagcccacactcgacttcgaattaatcaagaccgaggccaaacaccctgcgacgctgcggaagtactgcattgaagcaaaacttaccaacacaactaccgcctcccgctgtccaacacagggggagccctctttgaaggaggaacaagataaacgatttgtgtgcaagcatagcatggtggacagaggatggggcaatggttgtgggctgttcggaaagggcggcatcgtcacttgcgctatgtttacctgcaaaaagaacatggaggggaaagttgtgcagcctgaaaatctagagtatacaatcgtaattaccccacactccggagaagagaacgccgtgggtaatgatactggcaagcatgggaaagagataaaggtcacgccgcagtcaagtatcacagaagcagagctcaccggatacggcactgtgaccatggaatgtagccccaggacaggtctggacttcaacgagatggttcttctgcagatggaagataaggcttggttggtgcaccggcaatggtttctcgacctgcctttaccatggctgcccggggccgatacccagggctctaattggattcagaaggagactctcgtcacattcaagaaccctcacgcgaaaaagcaggacgtggtagttcttggatcccaagagggcgccatgcatacggcactgaccggggctactgaaatccagatgtcaagcggaaacttgctatttacaggtcacctgaaatgccgtctccgcatggacaagctgcagcttaaaggcatgagttattctatgtgtaccgggaagttcaaggtggtcaaagagatagccgaaacacaacatggaactattgtgatcagagtccagtacgagggcgatggttccccatgcaagatccccttcgagattatggacctggagaaaaggcacgtgttggggcggctcatcaccgttaatccgattgtgacggagaaggatagccctgtaaacatagaagctgagcccccatttggcgactcgtacatcattatcggagtcgaacctggccagctgaaattatcttggttcaagaaggggtcctcaatcggacagatgtttgagaccacaatgcgaggtgccaaacgcatggcaattctgggcgatactgcctgggacttcgggagtctaggaggcgtgtttaccagcataggtaaggctctccatcaagttttcggggcgatctatggcgcagccttttccggagtgtcttggacaatgaaaattctgatcggcgtcgtgattacttggatcgggatgaatagcagatcaaccagtctttccgtcagcttggtgctggttggagtcgtgacgctctacctgggcgtgatggtccaggctgattctggttgtgttgtgtcatggaagaacaaagagcttaagtgcgggagtggaatattcatcacagacaatgtgcacacctggactgaacagtataagtttcagcccgagagcccatccaaactggcctctgcaattcaaaaggcccacgaagagggcatctgtggtattaggtcggtaacacggttggaaaacctcatgtggaaacagatcacccccgagctgaatcatatattaagcgagaacgaagtcaagctgactattatgaccggcgatatcaaagggattatgcaggctggaaagcgctccctaagacctcagccaacagagctcaaatactcatggaagacgtggggcaaggccaaaatgctgagtaccgaacttcacaatcatactttcttgatcgacgggccggagacagcagaatgccccaacaccaatagggcgtggaactctctggaggtggaggattatggatttggcgttttcacaactaatatatggctcaagctgaaagaacgtcaagaggtgttttgtgacagcaagttaatgtccgctgccatcaaagacaaccgggcagtccacgccgatatgggttactggattgaatcagctctgaatgacacctggaagatcgagaaggccagcttcattgaggtgaaatcttgccactggcctaagtcccatacgctttggagtaacggggttttggaaagcgagatgatcatacccaaaaacttcgcaggacccgtgtctcagcacaattatcgacctggctaccatacacagaccgctggtccatggcacctcggcaagctggaaatggattttgacttctgtgaggggactaccgtagtcgtgacagaagattgcggaaacagaggcccctccctaaggactaccacagcctcagggaaactgattacggagtggtgctgtcgcagttgcaccctcccgcctctgcggtacagaggagaggacggctgttggtatggtatggaaatcaggccaagcaaggagaaggaagagaatcttgtgaactcgttggtcactgcggggcatggacagatcgataatttttccctgggcgttttaggtatggccctcttcctggaagagatgcttcgcacacgagtgggcaccaaacacgctattctgttggtagcagtgtcttttgtcactctcatcacagggaacatgagcttccgggacctgggacgtgtgatggttatggtgggcgccaccatgacggatgacattgggatgggagtcacttacctagctctgctcgccgcatttaaggtgagacccaccttcgcggccggcctgcttttgaggaaactgacatcaaaggagttaatgatgaccactataggtatcgttctcctgagtcaatccacaattcctgaaaccatccttgagctgacagatgctctagccctcgggatgatggtgctgaaaattgtccgcaatatggaaaagtatcagttggcagtaactatcatggctatactgtgcgtgcccaacgccgttatcttacagaatgcatggaaggtgtcttgtaccacgctcgccgtcgtgagcgtatccccactgcttctgacatcaagccaacagaaagctgactggattcctttggcgctcaccatcaagggactgaaccccactgccatttttctaaccacactgagtcggacttctaaaaagagatcctggccacttaatgaggcaatcatggctgtgggcatggtcagcatactcgcctcgtcactgttgaaaaacgatattccgatgaccggccctctggttgccgggggattactcacggtgtgctacgtgctgacaggtaggtctgctgaccttgaactggagcgagcagccgacgtccgctgggaggaacaggcggagatcagtggctccagccccatcttgtctattaccataagcgaagatgggtccatgtcaatcaagaatgaggaggaagaacagactctcacaattctgatccggaccggactactggtgattagtggccttttcccagttagcatccccataactgctgccgcatggtatctctgggaagtcaagaaacaaagagccggtgtgctgtgggacgtcccttctccaccccctgtggggaaagctgagttggaagatggagcatacaggatcaaacagaagggcattttaggctattcccagatcggggccggagtttacaaagagggtacatttcacaccatgtggcatgtgacgcgtggcgcggtcctgatgcacaaggggaaacgcattgagccgtcatgggctgacgtgaagaaggatctcatcagttacggaggcggttggaaactggaaggggagtggaaggaaggagaggaagtacaggtccttgccctggagccaggcaaaaacccccgggcagtgcaaactaagcctggcttgttcaaaaccaatacagggaccataggagccgttagcctagacttttccccaggtacatctggctcgcccattgtggataagaaggggaaagtcgtgggactgtatggcaacggtgttgtgactagaagcgggacctacgtctcagctatcgcccagacggagaagtccatcgaagacaaccctgagattgaagatgacatcttcaggaaaaagcgactcacaataatggatctgcatccgggagcaggcaaaactaagcggtatcttcccgctattgtgcgcgaggccatcaagagaggcttaaggaccctgattctcgcgccaacacgggtagtggccgcagaaatggaggaggctttgcgagggctgcctatcagataccagacccccgccatacgcgttgaacacactggaagggagattgtcgacctcatgtgtcatgctaccttcacaatgcgtctgcttagtccaatccgggtgcctaattataacctgatcattatggatgaagcacactttacggaccccgcctctatcgccgctagaggttacattagcactagggtggagatgggcgaggcggcagggatattcatgaccgccacaccaccgggatcccgcgacccttttccccagtcaaatgctccaatcatggatgaagaacgagaaattcccgagagatcttggaacagcggccacgaatggatcaccgacttcaaaggtaagactgtctggtttgtacctagtatcaaagccgggaatgatattgcagcctgcttgcggaagaacggcaaaaaggtgatacaactatccaggaagacattcgacagcgagtatatcaaaacccgcacgaatgattgggactttgttgtgactacagatatttctgagatgggcgctaacttcaaggcggaacgtgtcatcgacccaagacggtgtatgaaacccgtgattctgaccgatggcgaggaaagggttatcctcgccgggcctatgccggtgacccattcatccgcagctcagcgccgaggaagagtcggtcggaatccaaagaacgagaatgaccagtacatatacatgggcgaacccttagagaacgatgaggactgcgcccactggaaagaagcaaagatgctgcttgacaatatcaacactcctgaggggattatccccagtatgtttgaaccagagagggaaaaagtggatgccattgacggagagtatcgcctgagaggcgaggctaggaagacattcgtagatctcatgcggcgtggtgacttgcctgtgtggctggcctaccgcgttgcggcagaagggatcaattatgccgatcgaagatggtgttttgacggcgtcaagaacaaccaaatactcgaggaaaatgtggaggtggagatttggaccaaagaaggagagaggaagaaactgaagccccggtggcttgatgctcgcatctacagcgacccactagccctgaaagagttcaaggagttcgctgcaggcagaaagtcgttgacattaaacctgattactgaaatggggaggctccctacgtttatgacccagaaagcccggaatgctctggataaccttgccgtcctgcatacagcagaggcgggaggtcgagcctataatcacgctctctctgagttgccggaaactctggagaccctactgctccttacactgttagccaccgttactggcgggatcttcttgtttctgatgtccggaaagggcataggtaaaatgacgctcgggatgtgctgcatcattaccgcaagcgtgctgctttggtacgctcagatccagccccactggattgccgcatcaatcatactggagttctttctcattgtattgctgatcccagagcctgaaaagcaaagaacaccccaggacaaccagttaacttatgtggtcatcgccattctaaccgtggttgctgcgacaatggccaatgagatgggcttcctggagaaaaccaagaaggattttggactcggcagtatcgcaatacagcaaccagaatctaacattcttgacatcgatctgcgccctgcttccgcctggactttgtacgccgtggcaacaacgttcattacccccatgctgaggcatagcatcgaaaattcaagtgtcaacgtaagcctcactgctatagccaatcaggcgacagtgctgatggggcttggaaaaggttggccgctctccaagatggacatcggcgttccactgttggctattgggtgttactctcaggtgaaccctatcaccctgaccgccgcattactactgctcgtcgcccactatgctattatcggacccggccttcaggcaaaagccacacgggaagcgcaaaagcgtgctgccgcaggtattatgaaaaatccaactgtggacgggatcacggtcatagatctggaccccattccttacgatccgaagtttgagaagcagttgggccaggtgatgctgctcgttctgtgcgtgacccaggtacttatgatgagaacaacttgggccttatgtgaagctctgaccctcgccacaggacccatcagcaccttgtgggagggcaacccagggaggttctggaatactacgatcgcagtgtccatggctaacatttttcgcggatcatatctggccggcgcgggtctactgttctctataatgaaaaatacagccaacacccggcgagggactggaaacaccggcgagacactcggtgaaaagtggaaaaatagacttaacgcactgggcaagagtgagtttcaaatctacaaaaagtcggggattcaggaagtcgacaggactttggctaaagagggaatcaagcgcggcgagaccgatcatcacgccgttagccgggggtccgcaaagctgagatggttcgtggaacgtaatctcgtcacacctgagggaaaagtggtagacctgggctgcggtagagggggatggtcttattactgtggcggtttaaagaacgtgaaagaagttaagggccttacgaaagggggacccggccatgaggaacctattccaatgtcaacctatgggtggaatctggtgcggctccagagcggagtcgatgtgttctttactccccctgagaagtgcgacacactactgtgtgatatcggcgagtccagtccaaaccccaccgtcgaagctggtcgcactttgcgagtgctgaatctcgttgagaactggcttaataacaatacacaattctgcataaaggtactgaacccgtacatgccttctgtgatcgagaaaatggaggccttgcagagaaagtacgggggagccctggtcaggaatccactcagccggaactcaacccacgaaatgtattgggtgtccaatgcgagtggcaacattgttagctctgtgaacatgatctcccgcatgttaattaatagatttacgatgaggcacaaaaaggctacctacgagcccgacgtcgatctgggctcagggacacgaaacatcggaatagagagcgaaaaacctaatcttgacattatcggtaagcggatcgagaagattaaacaggaacatgagacttcgtggcactatgatcaggaccatccatacaagacctgggcatatcacggctcttacgaaacaaaacaaactgggagtgcctccagcatggtgaacggagtagtgcgtctgctaaccaagccctgggacgttataccgatggtcacacagatggctatgaccgatactacgcctttcggccagcagagagtgtttaaagagaaggtggacacacgcacccaagagcccaaggaaggtactaaaaagctcatgaaaatcaccgccgagtggctgtggaaggaattggggaaaaagaaaacaccaaggatgtgtacgcgggaggagttcaccagaaaggtccgctcaaatgcagccctgggagctatttttactgatgaaaacaagtggaaatccgcgagggaggccgttgaagactctggcttctgggagctcgtgaataaggaacgaaaccttcacctggagggcaaatgcgagacatgtgtatataatatgatggggaagcgggagaaaaagttaggagagtttggtaaggcaaaaggcagcagagctatctggtacatgtggctgggggccaggttcttggaatttgaggcactcggattcctgaacgaagatcattggtttagtcgcgaaaattccctaagcggcgtggagggtgaagggcttcacaagctgggatacattctccgtgacgtctctaaaaaggagggcggcgccatgtatgctgatgacaccgccgggtgggatactcggatcacactggaagacttgaaaaacgaggaaatggtgaccaatcatatggagggagagcacaagaagctggcggaagcaatattcaaactcacataccagaacaaggttgtgagagtccagaggcctactccccgcggtaccgtgatggatatcatttcacgacgggaccagagaggcagtgggcaagtagttacgtatggacttaataccttcacaaacatggaggcccagctgatcaggcagatggaaggcgagggtgtgtttaaatccattcaacatttaactgtcaccgaggaaatcgctgtgaagaactggctggtgcgcgtcgggagagagcggttgagcaggatggccatttctggagacgattgcgttgtgaaaccactcgacgatcgtttcgcatcggctctgacagccctaaatgacatgggcaaggtacgaaaggatatacagcagtgggaaccctcacgcggctggaacgactggactcaggtgcctttttgcagccaccacttccatgagcttatcatgaaagatgggagagtcctggtggttccatgtcggaatcaagacgaactcattggaagggctcgcatctcccagggtgccggctggagtctgagagagaccgcatgcttggggaagtcttacgcgcagatgtggagcttaatgtattttcaccggagggatctgcgactcgccgctaacgccatctgttccgcagtgccgtcacattgggtccccacgagtcgtacaacctggtctattcacgctactcacgagtggatgacaaccgaagacatgcttactgtgtggaatagagtatggatacaggagaacccttggatggaagataaaaccccagttgagagctgggaagagatcccctacctgggaaagcgcgaggaccaatggtgcggctccctaattggtctgacatcacgggccacgtgggccaaaaatatccagaccgccattaaccaggtgaggagcctcatcgggaatgaagagtatactgattacatgccttctatgaagagattccgccgggaagaggaagaggcgggagtcttgtggtga

SEQ ID NO: 14990 - RNA, 9876 nt, synthetic construct
  misc_feature 1..9876: note = derived and/or modified CDS sequence (opt3) from DENV-2__JN851122__SS-prME
  source 1..9876: mol_type = other RNA
accgccggaatcattataatgatgatccccaccgtgatggctttccacctgactacgcgaaacggggagcctcatatgattgtcagcaggcaggaaaagggaaaatccctcctttttaagaccgagaatggtgttaacatgtgcaccctgatggcaatggacttgggcgaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgttgcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgaggtgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacaccctgcgacgctgcggaagtactgcgtggaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaaggtcgttcagcctgaaaacctagagtatacaatcgtgattaccccacactccggagaagagaatgccgtaggtaacgatactggcaaacatgggaaggagataaaagtgacgccgcagtcaagtatcacagaagcagagctcaccggatacggcactgtcaccatggaatgtagccccaggacaggtctggacttcaatgagatggtgcttctgcagatggaaaacaaggcttggttggttcaccggcaatggtttctcgatctgcctttaccatggctgcccggggccgacacccagggctctaactggattcagaaagagactctcgtgacattcaagaatcctcacgcgaagaaacaggatgtcgtggtacttggatcccaagagggcgccatgcatacggcactgaccggggctactgaaatccagatgtcaagcggaaacttgctatttacaggtcacctgaagtgccgtctccgcatggacaaactgcagcttaagggcatgagttattctatgtgtaccgggaaattcaaggttgtgaaggagatagccgaaacacaacatggaactattgtcatcagagtgcagtacgagggcgacggttccccatgcaaaatccccttcgagattatggatctggaaaagaggcacgtcttggggcggctcatcaccgtgaatccgattgttacggagaaagacagccctgtgaacatagaagctgagcccccatttggcgattcgtacatcattatcggagtagaacctggccagctgaagttatcttggttcaaaaaggggtcctcaatcggacagatgtttgagaccacaatgcgaggtgccaagcgcatggcaattctgggcgacactgcctgggatttcgggagtctaggaggcgtctttaccagcataggtaaagctctccatcaagtgttcggggcgatctatggcgcagccttttccggagtttcttggacaatgaagattctgatcggcgtggtcattacttggatcgggatgaatagcagatcaaccagtctttccgtgagcttggtactggtgggagttgtcacgctctacctgggcgtgatggtgcaggctgactctggttgtgtcgtttcatggaaaaacaaggagcttaaatgcgggagtggaatattcatcacagataatgtgcacacctggactgaacagtataagtttcagcccgagagcccatccaagctggcctctgcaattcaaaaagcccacgaagagggcatctgtggtattaggtcggtgacacggttggaaaacctcatgtggaagcagatcacccccgagctgaatcatatattaactgagaacgaagtaaaactgaccattatgacaggcgacatcaaggggattatgcaggctggaaaacgcagcctaagacctcagccaacggagctcaagtactcctggaaagcctggggcaaggcaaagatgctgtcaaccgaacttcacaatcatactttcttgatcgatgggccggagacagcggaatgccccaacaccaatagggcttggaacagtctggaggtcgaggactatggatttggcgtgttcacaactaatatatggctcaaactgaaggaacgtcaagatgtattttgtgactctaaattaatgagcgccgcaatcaaggacaaccgggccgtgcacgctgatatgggttactggattgagtccgccctgaacgacacctggaaaatcgaaaaggcatcattcattgaggtcaagagctgccactggcctaaatctcatacgctttggtccaatggggtgttggagagtgaaatgatcataccaaagaacttcgctggacccgttagccagcacaattatcgacctggctaccatacacagaccgccggtccatggcacctcggcagactggagatggattttgacttctgtgaagggactaccgtggtagtcacagaggattgcggaaacaggggcccctctctacgcactaccacagcgtccgggaaactgattacggaatggtgctgtcggtcatgcaccctcccgcctctgagatacaggggagaggacggctgttggtatggtatggagatccgcccacttaaggaaaaagaggaaaatttggtgaacagtctggtgactgccgggcatggacagatcgataattttagcttaggcgtcctcggtatggctctgttccttgaggaaatgctgcgaacacgggttggcaccaagcacgcaattttgctcgtggccgtatcgtttgtgactctgatcacagggaacatgtccttccgtgacctaggaagagtcatggtgatggttggcgctaccatgacggatgacattgggatgggagtgacttacctggccctcctggcagcgtttaaggtcaggcccaccttcgccgctggccttttgctgcgcaaattaacatctaaggagctcatgatgaccactataggtatcgtgctgcttagccaatcaacaattcctgagagtatcctggaactaaccgatgccctcgcactggggatgatggttttgaaaattgtgcggaatatggagaagtatcagctggctgtcacaatcatggccatattatgcgtacccaacgcagtgatcctccagaatgcctggaaagtttcctgtactaccctggctgtggtctctgtgagcccacttctgttgacgtcctcacaacagaaggcggactggattcctctcgccctgacaatcaagggactaaaccccaccgcaatttttctgactacccttagcagaacaagtaaaaagaggtcttggccactcaatgaagctatcatggccgtaggcatggtgtccatactggccagctcgttgctgaaaaacgatattccgatgactggccctttagtcgctgggggactcctgaccgtttgctacgtgcttacgggtcgatcagcagacctggagttggaacgcgccgcggacgtgcggtgggaggagcaggctgaaatctctggcagttcccccatcctcagcattacaatatctgaggatgggagcatgtccatcaagaatgaagaggaggaacagaccctgactattctaatcagaacaggactgcttgtcatttcaggcctcttcccagtgagtatccccataaccgccgcagcctggtatctgtgggaggttaaaaagcaaagggctggtgtattgtgggacgtgcctagcccaccccctgtcgggaaagcagaattagaggatggagcctaccgtatcaagcagaagggcattctgggctattctcagatcggggcgggagtgtacaaagaaggtacttttcacacaatgtggcatgttacccgcggcgctgtgctcatgcacaaggggaaacggattgagccgtcctgggccgacgtcaagaaagatctgatctcatacggaggcggttggaaacttgagggggaatggaaggagggagaagaggtgcaggtactggcattggaaccaggcaaaaaccccagagccgtccaaacgaagcctggcctattcaaaactaacaccgggacaataggagctgtgagtctggactttagcccaggtacctccggctctcccattgttgataagaaagggaaggtggtcggactctatggcaatggtgtggttacaaggtcggggacttacgtgagcgccatcgcacagaccgagaagtcaatcgaggacaaccctgaaattgaggatgacatcttcagaaagaaacggctgacgataatggatcttcatccgggagctggcaaaacaaagcgctatttacccgccattgtcagagaagcgatcaaaaggggcctgcggactctcattttggccccaacccgagtggtagcagctgagatggaagaggccctgagagggctccctatccgctaccagacacccgctataagggcagagcacaccggacgtgaaattgtggacctgatgtgtcatgccactttcaccatgcggcttctgtccccaatcagagttcctaattataacttgatcattatggatgaggcccactttacagaccccgctagtatcgcggcaaggggttacatttctacgcgcgtcgaaatgggcgaggccgctgggatattcatgactgccaccccaccgggaagccgagacccttttccccagtccaatgcaccaatcatggatgaggaaagagagattcccgaacggtcatggaactctggccacgagtgggtgacagacttcaagggtaagaccgtgtggtttgtccctagcatcaaaactgggaatgatatcgccgcttgcctaaggaagaacggcaagaaggtaattcaactgagtcgcaaaacattcgactccgaatatataaagacccgtacgaatgattgggactttgtggttactacagatatcagcgagatgggcgcgaacttcaaggccgagagagtgattgacccacggaggtgtatgaaacccgtcatcctcaccgatggcgaagaacgcgtgattttagcagggcctatgccggttacccattcttcagctgcccagcgaagaggacgggtgggtaggaatccaaagaacgaaaatgaccagtacatctacatgggcgagcccctggaaaacgatgaggactgcgcacactggaaagaggccaagatgcttctggacaatataaacactcctgaagggatcattccctccatgtttgagccagaacgcgagaaagtcgatgctatcgacggagaatatagactcaggggcgaggcccggaagacattcgtggatttgatgcgtcgcggtgacctgcctgtatggctcgcgtaccgagtggcagccgaggggattaactatgctgatagaaggtggtgttttgacggcgttaaaaataaccaaatcctggaagagaatgtcgaagtggagatatggaccaaggagggagaacggaagaaacttaagccccgctggctagatgccagaatttacagtgacccactggctttgaaagagttcaaggagttcgcagccggcaggaagtcgttaacactgaacctcatcactgagatggggcggctgcctacgtttatgacccagaaggctaagaatgcccttgataacctggcagtgctccatacagcggaagccggaggtcgagcttataatcacgccttgagcgagctgccggagactctagaaaccctgctccttctgacattattggcaaccgtcactggcgggattttcctgtttctcatgtctggaaaaggcatcggtaagatgacgctggggatgtgctgcataatcaccgcttccattcttctgtggtacgcccagatccagccccactggattgcagccagcatcatactcgagttctttttgattgttctgttaatcccagaacctgagaaacaaagaacaccccaggacaaccagctaacttatgtggtaatcgctattctgaccgtggtcgcggccacaatggcaaatgaaatgggcttcctcgagaagaccaaaaaggattttggacttggctcaatcactacacagcaaccagagagtaacatactggacattgatttgcgccctgcttctgcctggacgctgtacgccgtggcaaccactttcatcacacccatgctcaggcattccattgaaaatagctcagttaacgtgagtctgaccgctatcgccaatcaggcgaccgtccttatggggctcggaaagggttggccgctgagcaaaatggacataggcgtaccattgctggctatcgggtgttactcccaggtgaaccctattacattaactgccgcactactgctccttgttacgcactatgccatcattggacccggcctgcaggctaaggcaacccgggaggcccaaaaacgtgcggctgccggtatcatgaagaatccaacagtggacgggatgactgtcattgatttggaccccatcccttacgatccgaaatttgaaaagcagctgggccaggtgatgctcctggtcctttgcgtgacccaggttttaatgatgagaacaacctgggcactgtgtgaggccctcactttggctacgggacccatatctacactgtgggaaggcaacccagggaggttctggaataccactattgccgtgagcatggcaaacatctttcgcggatcctatctagctggcgccggtctactcttctcaatcatgaagaacaccgcgaatacacggcgagggactggaaacattggcgagacccttggtgagaaatggaagaatagactgaacgccttgggcaaatctgaatttcaaatatacaagaaaagtgggatccaggaggtagacaggacactggcaaaggaaggaattaaacgcggcgagacggatcatcacgctgtgtcgcgggggagcgccaagctcagatggttcgtcgagcgtaatctggttacccctgaaggaaaggtggtcgacttaggctgcggtagagggggatggtcctattactgtggcggtcttaaaaacgtgaaggaggtaaaaggcctgactaaagggggacccggccatgaagaacctatcccaatgtctacatatgggtggaatctcgtgcggctacagtcaggagttgatgtgttctttacaccccctgaaaaatgcgacactctgttgtgtgatattggcgagagctccccaaaccccacagtcgaggcaggtcgcaccctgcgagtgctcaatcttgtcgaaaactggctgaataacaatacgcaattctgcatcaaggtgttgaacccgtacatgcctagtgttatagagaagatggaagctctgcagagaaaatacgggggagccctcgtaaggaatccattatctcggaacagcacccacgagatgtattgggtgtcaaacgcctccggcaatatcgtcagtagcgtgaacatgatttctcgcatgctgatcaatagatttacaatgaggcacaagaaagcgacttacgaacccgacgttgatcttggctccgggacccgaaacattggaatcgagtcagagacacctaatctggacataattggtaagcggatcgagaagatcaagcaggagcatgaaactagctggcactatgatcaggaccatccatacaagacctgggcttatcacggctcgtacgagacaaaacaaaccgggtctgcaagttccatggtgaacggagtcgtgcgtctactcactaagccctgggacgtaattccgatggtgacgcagatggccatgacagataccactcctttcggccagcagagagtttttaaagaaaaggtcgacacccgcacacaagagcccaaagagggtacgaagaagctgatgaaaataaccgctgaatggttgtggaaggagctggggaaaaagaaaactccaaggatgtgtacacgggaagagttcaccagaaaggtgcgcagcaatgccgcactcggagccatctttactgatgagaacaaatggaagtcagctagggaagcggtggaggactccggcttctgggaacttgtcgataaggagcgaaatctgcacttagaaggcaaatgcgagacatgtgtttataacatgatggggaagcgggagaaaaagctgggagaatttggtaaagccaagggctctagagcaatttggtacatgtggttgggggctaggttcctcgagtttgaagccctgggattcctaaatgaggaccattggtttagccgcgaaaacagtctttccggcgtggagggtgaggggctgcacaagctcggatacatcctgcgtgatgtaagcaaaaaggaaggcggcgcaatgtatgccgacgataccgctgggtgggacacacggattactttggaggatctgaaaaatgaagagatggtgaccaaccatatggaaggagagcacaagaaactcgccgaggcgatcttcaaacttacgtaccagaataaggtcgtgagagttcagaggcctacaccccgcggtacagtgatggacataatctctcgacgggaccagagaggctcagggcaagtcgtgacttatggactgaacaccttcacaaacatggaagcacagttaattaggcagatggagggcgaaggtgtatttaaaagtatccaacagctgactgttaaggaggagattgccgtgaaaaattggttgatccgcgtcgggagagaacggctctccaggatggctattagcggagatgactgcgtggtgaagccactggatgaccgtttcgcctctgcactaaccgctcttaacgatatgggcaaagtccgaaaggacatacagcagtgggagccctcgcgcggctggaatgattggacgcaagttcctttttgctcacatcacttccacgaactgatcatgaaggacgggagagtgctcgtagtgccatgtcggaaccaggatgagctgattggaagggcccgcatcagccagggtgctggctggtccttgagagaaacagcctgcttagggaaaagttacgcacagatgtggtctctgatgtattttcatcggagggacctccgacttgcggccaatgctatctgtagcgccgtcccgtcccactgggtgcccacctcacgtactacatggagtattcatgcaacccacgagtggatgactaccgaggatatgctgacagtttggaacagagtgtggatacaagaaaatccttggatggaggacaagacgccagtcgaatcttgggaggaaatcccctacctaggaaaacgcgaggatcagtggtgcggcagcctgattggtctcacctcccgggctacttgggccaagaacatccagacagcaattaatcaggtgaggtcattgatcgggaacgaggaatataccgactacatgcctagcatgaaaagattccgccgggaggaagaggaagccggagtactgtggtga

SEQ ID NO: 14991 - RNA, 9876 nt, synthetic construct
  misc_feature 1..9876: note = derived and/or modified CDS sequence (opt3) from DENV-2__JN851116__SS-prME
  source 1..9876: mol_type = other RNA
accgccggaatcattataatgatgatccccaccgtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgttgcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgaggtgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacaccctgcgacgctgcggaagtactgcgtggaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaaggtcgttcagcctgaaaacctagagtatacaatcgtgattaccccacactccggagaagagaatgccgtaggtaacgatactggcaaacatgggaaggagataaaagtgacgccgcagtcaagtatcacagaagcagagctcaccggatacggcactgtcaccatggaatgtagccccaggacaggtctggacttcaatgagatggtgcttctgcagatggaaaacaaggcttggttggttcaccggcaatggtttctcgatctgcctttaccatggctgcccggggccgacacccagggctctaactggattcagaaagagactctcgtgacattcaagaatcctcacgcgaagaaacaggatgtcgtggtacttggatcccaagagggcgccatgcatacggcactgaccggggctactgaaatccagatgtcaagcggaaacttgctatttacaggtcacctgaagtgccgtctccgcatggacaaactgcagcttaagggcatgagttattctatgtgtaccgggaaattcaaggttgtgaaggagatagccgaaacacaacatggaactattgtcatcagagtgcagtacgagggcgacggttccccatgcaaaatccccttcgagattatggatctggaaaagaggcacgtcttggggcggctcatcaccgtgaatccgattgttacggagaaagacagccctgtgaacatagaagctgagcccccatttggcgattcgtacatcattatcggagtagaacctggccagctgaagttatcttggttcaaaaaggggtcctcaatcggacagatgtttgagaccacaatgcgaggtgccaagcgcatggcaattctgggcgacactgcctgggatttcgggagtctaggaggcgtctttaccagcataggtaaagctctccatcaagtgttcggggcgatctatggcgcagccttttccggagtttcttggacaatgaagattctgatcggcgtggtcattacttggatcgggatgaatagcagatcaaccagtctttccgtgagcttggtactggtgggagttgtcacgctctacctgggcgtgatggtgcaggctgactctggttgtgtcgtttcatggaaaaacaaggagcttaaatgcgggagtggaatattcatcacagataatgtgcacacctggactgaacagtataagtttcagcccgagagcccatccaagctggcctctgcaattcaaaaagcccacgaagagggcatctgtggtattaggtcggtgacacggttggaaaacctcatgtggaagcagatcacccccgagctgaatcatatattaactgagaacgaagtaaaactgaccattatgacaggcgacatcaaggggattatgcaggctggaaaacgcagcctaagacctcagccaacggagctcaagtactcctggaaagcctggggcaaggcaaagatgctgtcaaccgaacttcacaatcatactttcttgatcgatgggccggagacagcggaatgccccaacaccaatagggcttggaacagtctggaggtcgaggactatggatttggcgtgttcacaactaatatatggctcaaactgaaggaacgtcaagatgtattttgtgactctaaattaatgagcgccgcaatcaaggacaaccgggccgtgcacgctgatatgggttactggattgagtccgccctgaacgacacctggaaaatcgaaaaggcatcattcattgaggtcaagagctgccactggcctaaatctcatacgctttggtccaatggggtgttggagagtgaaatgatcataccaaagaacttcgctggacccgttagccagcacaattatcgacctggctaccatacacagaccgccggtccatggcacctcggcagactggagatggattttgacttctgtgaagggactaccgtggtagtcacagaggattgcggaaacaggggcccctctctacgcactaccacagcgtccgggaaactgattacggaatggtgctgtcggtcatgcaccctcccgcctctgagatacaggggagaggacggctgttggtatggtatggagatccgcccacttaaggaaaaagaggaaaatttggtgaacagtctggtgactgccgggcatggacagatcgataattttagcttaggcgtcctcggtatggctctgttccttgaggaaatgctgcgaacacgggttggcaccaagcacgcaattttgctcgtggccgtatcgtttgtgactctgatcacagggaacatgtccttccgtgacctaggaagagtcatggtgatggttggcgctaccatgacggatgacattgggatgggagtgacttacctggccctcctggcagcgtttaaggtcaggcccaccttcgccgctggccttttgctgcgcaaattaacatctaaggagctcatgatgaccactataggtatcgtgctgcttagccaatcaacaattcctgagagtatcctggaactaaccgatgccctcgcactggggatgatggttttgaaaattgtgcggaatatggagaagtatcagctggctgtcacaatcatggccatattatgcgtacccaacgcagtgatcctccagaatgcctggaaagtttcctgtactattctggctgtggtctctgtgagcccacttctgttgacctcctcacaacagaaggcggactggatccctctcgccctgacgattaagggactaaaccccacagcaatctttctgaccactcttagcagaaccagtaaaaagaggtcttggccactcaatgaagctataatggccgtaggcatggtgtccattctggccagctcgttgctgaaaaacgatatcccgatgacaggccctttagtcgctgggggactcctgactgtttgctacgtgcttaccggtcgatcagcagacctggagttggaacgcgccgcggacgtgcggtgggaggagcaggctgaaatctctggcagttcccccattctcagcataacgatctctgaggatgggagcatgtccattaagaatgaagaggaggaacagacactgaccatcctaattagaactggactgcttgtcatctcaggcctcttcccagtgagtatacccatcacagccgcagcctggtatctgtgggaggttaaaaagcaaagggctggtgtattgtgggacgtgcctagcccaccccctgtcgggaaagcagaattagaggatggagcctaccgtattaagcagaagggcatcctgggctattctcagattggggcgggagtgtacaaagaaggtacctttcacactatgtggcatgttacacgcggcgctgtgctcatgcacaaggggaaacggatcgagccgtcctgggccgacgtcaagaaagatctgatatcatacggaggcggttggaaacttgagggggaatggaaggagggagaagaggtgcaggtactggcattggaaccaggcaaaaaccccagagccgtccaaaccaagcctggcctattcaaaacgaacactgggaccattggagctgtgagtctggactttagcccaggtacatccggctctcccatcgttgataagaaagggaaggtggtcggactctatggcaatggtgtggttaccaggtcggggacatacgtgagcgccatcgcacagactgagaagtcaattgaggacaaccctgaaatcgaggatgacatattcagaaagaaacggctgaccattatggatcttcatccgggagctggcaaaacgaagcgctatttacccgccatcgtcagagaagcgattaaaaggggcctgcggacactcatcttggccccaactcgagtggtagcagctgagatggaagaggccctgagagggctccctatacgctaccagacccccgctattagggcagagcacacaggacgtgaaatcgtggacctgatgtgtcatgccaccttcactatgcggcttctgtccccaatcagagttcctaattataacttgattatcatggatgaggcccactttaccgaccccgctagtattgcggcaaggggttacatatctacacgcgtcgaaatgggcgaggccgctgggatcttcatgacggccactccaccgggaagccgagacccttttccccagtccaatgcaccaattatggatgaggaaagagagatccccgaacggtcatggaactctggccacgagtgggtgaccgacttcaagggtaagacagtgtggtttgtccctagcatcaaagccgggaatgatattgctgcgtgcctaaggaagaacggcaagaaggtaatacaactgagtcgcaaaaccttcgactccgaatatatcaagactcgtacaaatgattgggactttgtggttaccacggatattagcgagatgggcgccaacttcaaggcagagagagtgatcgacccacggaggtgtatgaaacccgtcattctcactgatggcgaagaacgcgtgatcttagctgggcctatgccggttacacattcttcagccgcacagcgaagaggacgggtgggtaggaatccaaagaacgaaaatgaccagtacatatacatgggcgagcccctggaaaacgatgaggactgcgcccactggaaagaggctaagatgcttctggacaatatcaacacccctgaagggattatcccctccatgtttgagccagaacgcgagaaagtcgatgccattgacggagaatatagactcaggggcgaggcgcggaagaccttcgtggatttgatgcgtcgcggtgacctgcctgtatggctcgcataccgagtggccgctgaggggatcaactatgccgatagaaggtggtgttttgacggcgttaaaaataaccaaatactggaagagaatgtcgaagtggagatttggactaaggagggagaacggaagaaacttaagccccgctggctagatgctagaatctacagtgacccactggcattgaaagagttcaaggagttcgccgctggcaggaagtcgttaacactgaacctcattaccgagatggggcggctgcctacatttatgactcagaaggccaagaatgcacttgataacctggcggtgctccatacggccgaagctggaggtcgagcctataatcacgcattgagcgagctgccggagaccctagaaacactgctccttctgactttattggctaccgtcacaggcgggatcttcctgtttctcatgtctggaaaaggcataggtaagatgaccctggggatgtgctgcatcattactgcctccatccttctgtggtacgcacagattcagccccactggatcgccgctagcataattctcgagttctttttgatcgttctgttaatcccagaacctgagaaacaaagaacgccccaggacaaccagctaacctatgtggtaattgcgatcctgacagtggtcgccgcaactatggctaatgaaatgggcttcctcgagaagaccaaaaaggattttggacttggctcaataacaacccagcaaccagagagtaacattctggacatcgatttgcgccctgcctctgcctggactctgtacgcagtggctacaacgttcattacccccatgctcaggcattccatcgaaaatagctcagttaacgtgagtctgactgccatagcgaatcaggctacagtccttatggggctcggaaagggttggccgctgagcaaaatggacatcggcgtaccattgctggccattgggtgttactcccaggtgaaccctatcaccttaaccgcagccctactgctccttgttgctcactatgcaattatcggacccggcctgcaggccaaggcgacacgggaggctcaaaaacgtgccgcagccggtattatgaagaatccaactgtggacgggatgacggtcatcgatttggaccccataccttacgatccgaaatttgaaaagcagctgggccaggtgatgctcctggtcctttgcgtgacccaggttttaatgatgagaacaacttgggctctgtgtgaggccctcaccttggcaacaggacccatttctaccctgtgggaaggcaacccagggaggttctggaatactacgatcgctgtgagcatggccaacatctttcgcggatcctatctagcgggcgccggtctactcttctcaattatgaagaacacagcaaatacccggcgagggactggaaacaccggcgagacacttggtgagaaatggaagaatagactgaacgctttgggcaaatctgaatttcaaatatacaagaaaagtgggatccaggaggtagacaggactctggccaaggaaggaattaaacgcggcgagaccgatcatcacgcagtgtcgcgggggagcgctaagctcagatggttcgtcgagcgtaatctggttacacctgaaggaaaggtggtcgacttaggctgcggtagagggggatggtcctattactgtggcggtcttaaaaacgtgaaggaggtaaaaggcctgacgaaagggggacccggccatgaagaacctatcccaatgtctacctatgggtggaatctcgtgcggctacagtcaggagttgatgtgttctttactccccctgaaaaatgcgacacactgttgtgtgatattggcgagagctccccaaaccccaccgtcgaggccggtcgcactctgcgagtgctcaatcttgtcgaaaactggctgaataacaatacacaattctgcatcaaggtgttgaacccgtacatgcctagtgttatagagaagatggaagccctgcagagaaaatacgggggagcgctcgtaaggaatccattatctcggaacagcacccacgagatgtattgggtgtcaaacgcttccggcaatatcgtcagtagcgtgaacatgatttctcgcatgctgatcaatagatttacgatgaggcacaagaaagcaacctacgaacccgacgttgatcttggctccgggacacgaaacattggaatcgagtcagagactcctaatctggacataattggtaagcggatcgagaagatcaagcaggagcatgaaaccagctggcactatgatcaggaccatccatacaagacatgggcctatcacggctcgtacgagactaaacaaaccgggtctgctagttccatggtgaacggagtcgtgcgtctactcacaaagccctgggacgtaattccgatggtgacccagatggccatgactgatacgacacctttcggccagcagagagtttttaaagaaaaggtcgacacccgcactcaagagcccaaagagggtaccaagaagctgatgaaaataacagcagaatggttgtggaaggagctggggaaaaagaaaacgccaaggatgtgtacccgggaagagttcactagaaaggtgcgcagcaatgccgctctcggagcgatctttacagatgagaacaaatggaagtcagccagggaagcagtggaggactccggcttctgggaacttgtcgataaggagcgaaatctgcacttagaaggcaaatgcgagacctgtgtttataacatgatggggaagcgggagaaaaagctgggagaatttggtaaagctaagggctctagagccatttggtacatgtggttgggggcaaggttcctcgagtttgaagccctgggattcctaaatgaggaccattggtttagccgcgaaaacagtctttccggcgtggagggtgaggggctgcacaagctcggatacatcctgcgtgatgtaagcaaaaaggaaggcggcgctatgtatgccgacgatactgcggggtgggacacacggattaccttggaggatctgaaaaatgaagagatggtgacaaaccatatggaaggagagcacaagaaactcgcagaggccatcttcaaacttacttaccagaataaggtcgtgagagttcagaggcctacaccccgcggtacggtgatggacataatctctcgacgggaccagagaggctcagggcaagtcgtgacctatggactgaacacattcactaacatggaagctcagttaattaggcagatggagggcgaaggtgtatttaaaagtatccaacagctgaccgttaaggaggagattgccgtgaaaaattggttgatccgcgtcgggagagaacggctctccaggatggcaattagcggagatgactgcgtggtgaagccactggatgaccgtttcgcttctgccctaacagctcttaacgatatgggcaaagtccgaaaggacatacagcagtgggagccctcgcgcggctggaatgattggactcaagttcctttttgctcacatcacttccacgaactgatcatgaaggacgggagagtgctcgtagtgccatgtcggaaccaggatgagctgattggaagggcccgcatcagccagggtgcaggctggtccttgagagaaaccgcgtgcttagggaaaagttacgcccagatgtggtctctgatgtattttcatcggagggacctccgacttgctgccaatgcaatctgtagcgctgtcccgtcccactgggtgcccacgtcacgtacaacctggagtattcatgccactcacgagtggatgacaaccgaggatatgctgactgtttggaacagagtgtggatacaagaaaatccttggatggaggacaagaccccagtcgaatcttgggaggaaatcccctacctaggaaaacgcgaggatcagtggtgcggcagcctgattggtctcacatcccgggcaacgtgggccaagaacatccagaccgcgattaatcaggtgaggtcattgatcgggaacgaggaatatactgactacatgcctagcatgaaaagattccgccgggaggaagaggaagctggagtactgtggtga

SEQ ID NO: 14992 - RNA, 9876 nt, synthetic construct
  misc_feature 1..9876: note = derived and/or modified CDS sequence (opt3) from DENV-2__GU370051__SS-prME
  source 1..9876: mol_type = other RNA
accgccggaatcattataatgatgatccccaccgtgatggctttccacctgactacgcgaaacggggaacctcatatgattgtcagcaggcaggaaaagggaaaatccctcctttttaagaccgagaatggtgttaacatgtgcacactgatggcaatggacttgggagaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgttgcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgaggtgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacaccctgcgacgctgcggaagtactgcgtggaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaaggtcgttcagcctgaaaacctagagtatacaatcgtgattaccccacactccggagaagagaatgccgtaggtaacgatactggcaaacatgggaaggagataaaagtgacgccgcagtcaagtatcacagaagcagagctcaccggatacggcactgtcaccatggaatgtagccccaggacaggtctggacttcaatgagatggtgcttctgcagatggaaaacaaggcttggttggttcaccggcaatggtttctcgatctgcctttaccatggctgcccggggccgacacccagggctctaactggattcagaaagagactctcgtgacattcaagaatcctcacgcgaagaaacaggatgtcgtggtacttggatcccaagagggcgccatgcatacggcactgaccggggctactgaaatccagatgtcaagcggaaacttgctatttacaggtcacctgaagtgccgtctccgcatggacaaactgcagcttaagggcatgagttattctatgtgtaccgggaaattcaaggttgtgaaggagatagccgaaacacaacatggaactattgtcatcagagtgcagtacgagggcgacggttccccatgcaaaatccccttcgagattatggatctggaaaagaggcacgtcttggggcggctcatcaccgtgaatccgattgttacggagaaagacagccctgtgaacatagaagctgagcccccatttggcgattcgtacatcattatcggagtagaacctggccagctgaagttatcttggttcaaaaaggggtcctcaatcggacagatgtttgagaccacaatgcgaggtgccaagcgcatggcaattctgggcgacactgcctgggatttcgggagtctaggaggcgtctttaccagcataggtaaagctctccatcaagtgttcggggcgatctatggcgcagccttttccggagtttcttggacaatgaagattctgatcggcgtggtcattacttggatcgggatgaatagcagatcaaccagtctttccgtgagcttggtactggtgggagttgtcacgctctacctgggcgtgatggtgcaggctgactctggttgtgtcgtttcatggaaaaacaaggagcttaaatgcgggagtggaatattcatcacagataatgtgcacacctggactgaacagtataagtttcagcccgagagcccatccaagctggcctctgcaattcaaaaagcccacgaagagggcatctgtggtattaggtcggtgacacggttggaaaacctcatgtggaagcagatcacccccgagctgaatcatatattaactgagaacgaagtaaaactgaccattatgacaggcgacatcaaggggattatgcaggctggaaaacgcagcctaagacctcagccaacggagctcaagtactcctggaaagcctggggcaaggcaaagatgctgtcaaccgaacttcacaatcatactttcttgatcgatgggccggagacagcggaatgccccaacaccaatagggcttggaacagtctggaggtcgaggactatggatttggcgtgttcacaactaatatatggctcaaactgaaggaacgtcaagatgtattttgtgactctaaattaatgagcgccgcaatcaaggacaaccgggccgtgcacgctgatatgggttactggattgagtccgccctgaacgacacctggaaaatcgaaaaggcatcattcattgaggtcaagagctgccactggcctaaatctcatacgctttggtccaatggggtgttggagagtgaaatgatcataccaaagaacttcgctggacccgttagccagcacaattatcgacctggctaccatacacagaccgccggtccatggcacctcggcagactggagatggattttgacttctgtgaagggactaccgtggtagtcacagaggattgcggaaacaggggcccctctctacgcactaccacagcgtccgggaaactgattacggaatggtgctgtcggtcatgcaccctcccgcctctgagatacaggggagaggacggctgttggtatggtatggagatccgcccacttaaggaaaaagaggaaaatttggtgaacagtctggtgactgccgggcatggacagatcgataattttagcttaggcgtcctcggtatggctctgttccttgaggaaatgctgcgaacacgggttggcaccaagcacgcaattttgctcgtggccgtatcgtttgtgactctgatcacagggaacatgtccttccgtgacctaggaagagtcatggtgatggttggcgctaccatgacggatgacattgggatgggagtgacttacctggccctcctggcagcgtttaaggtcaggcccaccttcgccgctggccttttgctgcgcaaattaacatctaaggagctcatgatgaccactataggtatcgtgctgcttagccaatcaacaattcctgagagtatcctggaactaaccgatgccctcgcactggggatgatggttttgaaaattgtgcggaatatggagaagtatcagctggctgtcacaatcatggccatattatgcgtacccaacgcagtgatcctcgaaaatgcctggaaagtttcctgtactaccctggctgtggtctctgtgagcccacttctgttgacgtcctcacagcaaaaggcggactggattcctctcgccctgacaatcaagggactaaaccccaccgcaatttttctgactacccttagcagaacaagtaaaaagaggtcttggccactcaatgaggctatcatggccgtaggcatggtgtccatactggccagctcgttgctgaaaaacgatattccgatgactggccctttagtcgctgggggactcctgaccgtttgctacgtgcttacgggtcgatcagcagacctggaattggagcgcgccgcggacgtgcggtgggaggaacaggctgagatctctggcagttcccccatcctcagcattacaatatctgaagatgggagcatgtccatcaagaatgaggaggaagaacagaccctgactattctaatcagaacaggactgcttgtcatttcaggcctcttcccagtgagtatccccataaccgccgcagcctggtatctgtgggaagttaaaaagcagagggctggtgtattgtgggacgtgcctagcccaccccctgtcgggaaagcagagttagaagatggagcctaccgtatcaagcaaaagggcattctgggctattctcagatcggggcgggagtgtacaaagagggtacttttcacacaatgtggcatgttacccgcggcgctgtgctcatgcacaaggggaaacggattgagccgtcctgggccgacgtcaagaaagatctgatctcatacggaggcggttggaaacttgaaggggagtggaaggaaggagaggaagtgcaggtactggcattggagccaggcaaaaaccccagagccgtccagacgaagcctggcctattcaaaactaacaccgggacaataggagctgtgagtctggactttagcccaggtacctccggctctcccattgttgataagaaagggaaggtggtcggactctatggcaatggtgtggttacaaggtcggggacttacgtgagcgccatcgcacaaaccgagaagtcaatcgaagacaaccctgatattgaggacgatatcttcagaaagaaacggctgacgataatggaccttcatccgggagctggcaaaacaaagcgctatttacccgccattgtcagagaagcgatcaaaaggggcctgcggactctcattttggccccaacccgagtggtagcagctgagatggaagaggccctgagagggctccctatccgctaccagacacccgctataagggcagagcacaccggacgtgaaattgtggatctgatgtgtcatgccactttcaccatgcggcttctgtccccaatcagagttcctaattataacttgatcattatggacgaggcccactttacagaccccgctagtatcgcggcaaggggttacatttctacgcgcgtcgaaatgggcgaggccgctgggatattcatgactgccaccccaccgggaagccgagatccttttccccagtccaatgcaccaatcatggacgaggaaagagagattcccgaacggtcatggaactctggccacgagtgggtgacagatttcaagggtaagaccgtgtggtttgtccctagcatcaaagccgggaatgacatcgctgcgtgcctaaggaagaacggcaagaaggtaattcagctgagtcgcaaaactttcgattccgaatatataaagacacgtaccaatgactgggattttgtggttacgactgacatcagcgagatgggcgccaacttcaaggcagagagagtgattgatccacggaggtgtatgaaacccgtcatcctcacagacggcgaagaacgcgtgattttagctgggcctatgccggttacccattcttcagccgcacaacgaagaggacgggtgggtaggaatccaaagaacgataatgaccagtacatctacatgggcgaacccctggagaacgacgaagattgcgcccactggaaagaggctaagatgcttctggacaatataaacacccctgaggggatcattccctccatgtttgaaccagagcgcgaaaaagtcgatgccatcgacggagagtatagactcaggggcgaagcgcggaagactttcgtggatttgatgcgtcgcggtgacctgcctgtatggctcgcataccgagtggccgctgaggggattaactatgccgatagaaggtggtgttttgacggcgttaaaaataaccagatcctggaggaaaatgtcgaggtggaaatatggacaaaggagggagagcggaagaaacttaagccccgctggctagatgctagaatttacagtgacccactggcattgaaagagttcaaggagttcgccgctggcaggaagtcgttaaccctgaacctcatcacagaaatggggcggctgcctacttttatgacgcaaaaggccaagaatgcacttgataacctggcggtgctccataccgccgaggctggaggtcgagcctataatcacgcattgagcgaactgccggagacactagagactctgctccttctgaccttattggctacagtcaccggcgggattttcctgtttctcatgtctggaaaaggcatcggtaagatgactctggggatgtgctgcataatcacggcctccattcttctgtggtacgcacagatccagccccactggattgccgctagcatcatactcgagttctttttgattgttctgttaatcccagagcctgaaaaacagagaacaccccaagacaaccagctaacatatgtggtaatcgcgattctgactgtggtcgccgcaaccatggctaatgagatgggcttcctcgaaaagaccaagaaggattttggacttggctcaatcaccactcagcagccagagagtaacatactggacattgacttgcgccctgcctctgcctggacactgtacgcagtggctacgaccttcatcactcccatgctcaggcattccattgagaatagctcagttaacgtgagtctgacagccatcgcgaatcaagctaccgtccttatggggctcggaaagggttggccgctgagcaaaatggatataggcgtaccattgctggccatcgggtgttactcccaggtgaaccctattaccttaacagcagccctactgctccttgttgctcactatgcaatcattggacccggcctgcaggccaaggcgactcgggaagctcagaaacgtgccgcagccggtatcatgaagaatccaacggtggacgggattaccgtcatcgatttggaccccataccttacgatccgaaatttgagaagcaactgggccaggtgatgctcctggtcctttgcgtgacacaggttttaatgatgagaactacctgggctctgtgtgaagccctcacattggcaaccggacccatttctactctgtgggagggcaacccagggaggttctggaatacgacaatcgctgtgagcatggccaacatctttcgcggatcctatctagcgggcgccggtctactcttctcaattatgaagaacaccgcaaatactcggcgagggaccggaaacacaggcgaaactcttggtgagaaatggaagaatagactgaacgctttgggcaaatctgagtttcagatatacaagaaaagtgggatccaagaagtagacaggaccctggccaaggagggaattaaacgcggcgaaacagatcatcacgcagtgtcgcgggggagcgctaagctcagatggttcgtcgagcgtaatctggttacgcctgagggaaaggtggtcgacttaggctgcggtagagggggatggtcctattactgtggcggtcttaaaaacgtgaaggaagtaaaaggcctgaccaaagggggacccggccatgaggaacctatcccaatgtctacttatgggtggaatctcgtgcggctacagtcaggagttgatgtgttctttacaccccctgagaaatgcgacaccctgttgtgtgatattggcgaaagctccccaaaccccactgtcgaggccggtcgcacactgcgagtgctcaatcttgtcgagaactggctgaataacaatacccagttctgcatcaaggtgttgacgccgtacatgcctagtgttatagaaaagatggaggccctgcaaagaaaatacgggggagcgctcgtaaggaacccattatctcggaatagcacccacgaaatgtattgggtgtcaaacgcttccggcaacatcgtcagtagcgtgaatatgatttctcgcatgctgatcaacagatttacaatgaggcacaagaaagcaacttacgagcccgacgttgatcttggctccgggacccgaaatattggaatcgaatcagagacacctaacctggacataattggtaagcggatcggcaaaatcaagcaggagcatgaaactagctggcactatgaccaggatcatccatacaagacctgggcctatcacgggtcgtacgagacaaaacagaccggatctgctagttccatggtgaatggcgtcgtgcgtctactcactaagccctgggacgtaattccgatggtgacgcaaatggccatgacagataccactcctttcggtcagcagagagtttttaaagaaaaggtcgacacccgcacacaggagcccaaagaagggacgaagaagctgatgaaaataaccgcagagtggttgtggaaggagctgggcaaaaagaaaactccaaggatgtgtacacgggaagagttcaccagaaaggtgcgcagcaacgccgctctcggcgcgatctttactgatgaaaataaatggaagtcagccagggaggcagtggaggactccggcttctgggaacttgtcgataaggagcgaaacctgcacttagaagggaaatgcgagacatgtgtttataatatgatgggaaagcgggagaaaaagctgggtgagtttggcaaagctaaggggtctagagccatttggtacatgtggttgggagcaaggttcctcgagtttgaagccctgggcttcctaaacgaggaccattggtttagccgcgaaaatagtctttccggtgtggagggggaaggactgcacaagctcggctacatcctgcgtgatgtaagcaaaaaggagggcggggctatgtatgccgacgataccgcgggatgggacacacggattactttggaggacctgaaaaacgaagagatggtgaccaatcatatggaaggtgagcacaagaaactcgcagaagccatcttcaaacttacgtaccaaaacaaggtcgtgagagttcagaggcctacaccccgcggcacagtgatggatataatctctcgacgggaccagagagggtcaggacaggtcgtgacttatggcctgaataccttcacaaacatggaggctcaattaattaggcagatggagggtgaaggggtatttaaaagtatccagcaactgactgttaaggaggaaattgccgtggagaactggttgatgcgcgtcggaagagagcggctctccaggatggcaatcagcggcgatgactgcgtggtgaaaccactggatgaccgtttcgcttctgccctaaccgctcttaatgatatgggcaaggtccgaaaagacattcagcagtgggaaccctcgcgcgggtggaacgattggacgcaggttcctttttgctcacatcacttccacgagctgataatgaaggacggaagagtgctcgtagtgccatgtcggaatcaagatgaactgatcggtagggcccgcattagccagggcgcagggtggtccttgagagagacagcgtgcttaggaaagagttacgcccagatgtggtctctgatgtattttcatcggagggacctccgacttgctgccaacgcaatctgtagcgctgtcccgtcccactgggtgcccacctcacgtactacatggagtatccatgccacccacgaatggatgactaccgaggatatgctgacagtttggaatagagtgtggattcaggagaacccttggatggaagacaaaacgccagtcgagtcttgggaagagataccctacctaggcaagcgcgaagaccaatggtgcggtagcctgatcgggctcacctcccgggcaacttgggccaaaaatattcagacagcgatcaaccaggtgaggtcattgattggaaatgaggagtataccgattacatgcctagcatgaagagattccgccgggaagaggaagaggctggcgtactgtggtga

SEQ ID NO: 14993 - RNA, 9876 nt, synthetic construct
  misc_feature 1..9876: note = derived and/or modified CDS sequence (opt3) from DENV-2__EU359009__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcaatcgccccatctatgacaatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacaccctgcgacgctgcggaagtactgcatcgaagcaaaacttaccaacacaactaccgcctcccgctgtccaacacagggggagccctctttgaatgaggaacaagataagcgatttgtgtgcaaacatagcatggtcgacagaggatggggcaacggttgtgggctgttcggaaagggcggcatcgtgacttgcgctatgtttacctgcaagaaaaatatggaggggaagattgtgcagcctgaaaacctagagtatacaatagtcatcaccccacactccggagaagagaatgccgttggtaacgatactggcaaacatgggaaggagattaaagtgacgccgcagtcaagtatcacagaagcagagctcaccggatacggcactgtaaccatggaatgtagccccaggacaggtctggacttcaatgagatggtgcttctgcagatggaaaacaaggcttggttggtccaccggcaatggtttctcgatctgcctttcccatggttacccggggccgacacccagggctctaactggatacagaaagagactctggtgacatttaagaatcctcacgcgaagaaacaggatgttgtggtcctcggatcccaagagggcgccatgcatacggcacttaccggggctactgaaattcagatgtcaagcggaaacctgttgttcacaggtcacctaaagtgccgtctgcgcatggacaaactccagctgaagggcatgagttattctatgtgtaccgggaaattcaaggtggtaaaggagatcgccgaaacacaacatggaactatcgttattagagtgcagtacgagggcgacggttccccatgcaaaatcccctttgagattatggatcttgaaaagaggcacgtcctggggcggttgataaccgtgaatccgatcgtcacggagaaagacagccctgtgaacattgaagctgagcccccattcggcgattcgtacatcatcattggagttgaacctggccagctcaagctgtcttggtttaaaaaggggtcctcaataggacagatgttcgagaccacaatgcgaggtgccaagcgcatggcaatcttaggcgacactgcctgggattttgggagtctgggaggcgtgttcaccagcattggtaaagctctacatcaagtatttggggcgatctatggcgcagccttctccggagtctcttggacaatgaagattctcatcggcgtggttataacttggatcgggatgaatagcagatcaaccagtctgtccgtgagccttgtcttggtgggagtagtgacgctgtacctcggcgttatggtccaggctgactctggttgtgtggtgtcatggaaaaacaaggagctgaaatgcgggagtggaatttttatcacagataatgtccacacctggactgaacagtataagttccagcccgagagcccatccaagcttgcctctgcaattcaaaaagcccacgaagagggcatctgtggtataaggtcggttacacggctggaaaacttgatgtggaagcagattacccccgagctcaatcatatcctgagcgagaacgaagtgaaattaactattatgaccggcgacatcaaggggataatgcaggctggaaaacgctccctgagacctcagccaacagagctaaagtactcatggaaagcctggggcaaggcaaagatgctcagtacggaactgcacaatcatacctttcttatcgatgggccggagactgcggaatgccccaacacaaatagggcttggaactctttggaggtggaggactatggattcggcgtatttaccacaaatatttggctgaaactcaaggaacgtcaagatgtcttctgtgacagcaaactgatgtccgccgcaatcaaggacaaccgggccgtgcacgctgatatgggttactggattgagtcagccttaaacgacacttggaaaatcgaaaaggcaagcttcatagaggttaagtcttgccactggcctaaatcccataccctgtggagtaatggggtgcttgagagcgaaatgattatcccaaagaactttgctggacccgtctctcagcacaattatcgacctggctaccatacgcagacagccggtccatggcacttgggcagactcgagatggatttcgacttttgtgaagggaccactgtggttgtgaccgaggattgcggaaacaggggcccctccctgcgcacaactaccgcgtcagggaaactaatcacagaatggtgctgtcggagttgcacgctgccgcctctcagatacaggggagaggacggctgttggtatggtatggagattcgcccactgaaggaaaaagaggaaaatcttgtaaacagcttggtcaccgccgggcatggacagatcgataatttctcgctgggcgtgttaggtatggctctctttctggaggaaatgcttcgaactcgggtgggcacaaagcacgcaattctgttggtcgccgtttccttcgtgaccctcataactgggaacatgtcttttcgtgacctgggaagagtaatggtgatggtcggcgctacaatgaccgatgacatcgggatgggagtgacgtacctagccctgctcgcagcgttcaaggttaggcccacttttgccgctggcctgcttttgcgcaaactgaccagcaaggagttaatgatgacaaccattggtatcgtgctcctgtcacaaagtactattcctgagacaatccttgaactgaccgatgccctagcactcgggatgatggtcctgaaaatagtgcggaatatggagaagtatcagttggctgttacaatcatggccattctgtgcgtgcccaacgcagtcatcttacagaatgcctggaaagtatcctgtactaccctcgctgtggtttctgtgagcccactgcttctgacgtcctcacaacagaaggcggactggattcctttggccctcacaatcaagggactgaaccccaccgcaatattcctaactaccctgagcagaacaagtaaaaagaggtcttggccacttaatgaagctattatggccgtcggcatggtgtccatcctcgccagctcgctgttgaaaaacgatatcccgatgactggccctctggtagctgggggattactcaccgtgtgctacgtcctgacgggtcgatcagcagaccttgagctggaacgcgccgcggacgttcggtgggaggagcaggctgaaatttctggcagttcccccatattgagcatcacaatttctgaggatgggagcatgtccatcaagaatgaagaggaggaacagaccctcactattctgatcagaacaggactactggtgatatcaggcctttttccagtgagtatccccattaccgccgcagcctggtatctctgggaggtcaaaaagcaaagggctggtgtgctgtgggacgttcctagcccaccccctgtagggaaagcagaattggaggatggagcctaccgtatcaagcagaagggcattttaggctattctcagatcggggcgggagtgtacaaagaaggtactttccacacaatgtggcatgtcacccgcggcgctgtgctgatgcacaaggggaaacggatagagccgtcctgggccgacgttaagaaagatctcatttcatacggaggcggttggaagctggagggggaatggaaggagggagaagaggtgcaggtccttgcactggaaccaggcaaaaaccccagagccgtgcaaacgaagcctggcttgtttaaaactaacaccgggacaatcggagctgtaagtctagacttcagcccaggtacctccggctctcccatcgtcgataagaaagggaaggtggttggactgtatggcaatggtgtggtcacaaggtcggggacttacgtgagcgccattgcacagaccgagaagtcaatcgaggacaaccctgaaatagaggatgacattttccgaaaaaagcggctcacgatcatggatctgcatccgggagctggcaaaacaaagcgctatcttcccgccattgttagagaagcgatcaaaaggggcttacggactctgatactcgccccaacccgagtggtcgcagctgagatggaagaggccttgagagggctgcctattcgctaccagacacccgctatcagggcagagcacaccggacgtgaaatcgtggacctcatgtgtcatgccacttttaccatgcggctgctttccccaattagagtacctaattataacctgatcattatggatgaggcccacttcacagaccccgctagtatagcggcaaggggttacatctctacgcgcgtggaaatgggcgaggccgctgggatttttatgactgccaccccaccgggaagccgagaccctttcccccagtccaatgcaccaatcatggatgaggaaagagagatccccgaacggtcatggaactctggccacgagtgggttacagactttaagggtaagaccgtctggttcgtgcctagcattaaagccgggaatgatatagctgcgtgcttgaggaagaacggaaaaaaggtgatccaactaagtcgcaaaacttttgacacagaatatattaagacccgtacgaatgattgggacttcgtcgtaactacagatatctccgagatgggcgccaactttaaggcagagagagtgattgacccacggaggtgtatgaaacccgttatcctgaccgatggcgaagagcgcgtgatactcgctgggcctatgccggtcacccatagctctgccgcacagcgaagaggacgggtgggtaggaatccaaagaacgaaaatgaccagtacatctacatgggcgagcccttagaaaacgatgaggactgcgcccactggaaagaggctaagatgctgcttgacaatattaacactcctgaagggatcattccctcaatgttcgagccagaacgcgagaaagttgatgccatcgacggagaatatagactgaggggcgaggcgcggaagacatttgtggatctcatgcgtcgcggtgacttgcctgtctggctggcataccgagtggccgctgaggggataaactatgccgatagaaggtggtgtttcgacggcgtaaaaaataaccaaattctcgaagagaatgtggaagttgagatctggaccaaggagggagaacggaagaaactgaagccccgctggcttgatgctagaatttactccgacccactagcactgaaagagttcaaggaatttgccgctggcaggaaaagtttgacattaaacctgatcactgagatggggcggctccctacgttcatgacccagaaggcccgaaatgcactggataaccttgcggtcctgcatacagccgaagctggaggtagagcctataatcacgcactcagcgagttgccggagactctggaaaccctactgctccttacactgttagctaccgtgactggcgggatatttttgttcctgatgtcgggaaagggcatcggtaaaatgacgctcgggatgtgctgcattatcaccgcctctattctgctttggtacgcacagatccagccccactggatagccgcttccattatcctggagtttttcctcatcgtgttgctgattccagaacctgagaagcaacgcacaccccaggacaaccagttaacttatgtcgttatcgcgatactaaccgtggtagccgcaacaatggctaatgaaatgggctttctggagaaaaccaagaaagatttcggactcggcagcattactacacagcaaccagagtcaaacatccttgacattgatctgaggcctgccagtgcctggacgttgtacgcagtggctaccacttttatcacacccatgctgcggcattctatagaaaattccagcgtcaacgtgtcactcaccgccatcgcgaatcaggctaccgttctgatggggcttggaaagggttggccgctcagtaagatggacattggcgtgccactgttggccatcgggtgttacagccaggtcaaccctattacactgactgcagccttactactgctcgtagctcactatgcaatcattggacccggccttcaggccaaagcgacgcgtgaggctcaaaagagagccgcagccggtatcatgaaaaatccaaccgtggacgggataacagttattgatctggaccccatcccttacgatccgaagttcgaaaaacagttgggccaggtgatgctgctcgtcctgtgcgtgactcaggtccttatgatgaggaccacatgggctttatgtgaggccctgaccctcgcaactggacccatctccacgttgtgggaaggcaacccagggcgcttttggaatacaaccattgctgtgtctatggccaacatattccggggaagctatctggcgggcgccggtctactgttttccatcatgaagaacactgcaaatacccgaagagggacaggaaacactggcgagaccctcggtgagaagtggaaaaataggcttaacgctctgggcaagtcagaattccaaatttacaaaaagtctgggatccaggaggttgaccgcacattggccaaagaaggaattaagcggggcgagacggatcatcacgcagtgagtagagggtcggctaaactgcgttggttcgtagagaggaatctcgtgacccctgaaggaaaggtcgttgacctgggctgcggtcgggggggatggagctattactgtggcggtttaaagaacgtgaaagaggtcaagggccttactaaagggggacccggccatgaagagcctatcccaatgtccacatatgggtggaatctggtgcgcctccagtctggagtagatgtgtttttcaccccccctgaaaagtgcgacactctactgtgtgatataggcgagtcaagcccaaaccccacagttgaggccggtcgaaccttgagagtgctgaatctcgtcgaaaactggcttaataacaatacgcaattttgcatcaaagtgctgaacccgtacatgccttccgtcattgagaagatggaagccttgcagaggaagtacgggggagcgctggtgcggaatccactcagtcgcaactctacccacgagatgtattgggttagcaacgcttcaggcaatatcgtatccagtgtgaacatgattagcagaatgttaatcaataggttcacaatgcgacacaaaaaggcaacttacgaacccgacgtcgatctgggctctgggacccggaacataggaattgagtccgagacacctaatcttgacatcatcggtaaacgtattgaaaagataaaacaggagcatgaaacttcatggcactatgatcaggaccatccatacaagacctgggcctatcacggcagctacgagacaaagcaaaccgggtcggcttctagtatggtgaacggagttgtgagactgctaactaaaccctgggacgtcatcccgatggtgacgcagatggccatgacagataccactccttttggccagcagcgcgtattcaaggaaaaagtggacaccaggacacaagagcccaaggagggtacgaaaaagctcatgaagattaccgcagaatggctgtggaaagagttggggaagaaaaagactccacggatgtgtacaagagaagagtttacccgcaaagttaggtccaatgccgctctgggagcgatcttcactgatgagaacaagtggaaaagcgcccgagaagcagtcgaggactcaggcttttgggaactcgtggataaggagcggaatcttcacctggaaggcaagtgcgagacatgtgtgtataacatgatggggaaaagagagaagaaattaggagaattcggtaaggctaaaggctccagggccatttggtacatgtggctgggggcacgctttttggagttcgaagccctcggatttctgaatgaggaccattggttctctcgtgaaaacagcctaagtggcgtcgagggtgaggggcttcacaagctgggatacatcctccgggatgtttccaagaaagaaggcggcgctatgtatgccgacgataccgcggggtgggacacaagaataactctggaggatttgaagaatgaagagatggtgaccaaccatatggaaggagagcacaaaaagctggcagaggccatcttcaggctcacgtaccagaataaagtagtgcgcgtccagcgacctaccccccggggtacagtgatggacattatcagcagaagggaccagcgcggctctgggcaagttgtgacttatggacttaacacctttacaaacatggaagctcagctgattagacagatggagggcgaaggtgtcttcaagtcaatccaacatttaactgtgaccgaggagattgccgtaaagaattggctggttcgggtggggagggaacgtttgagtcgaatggcaatatccggagatgactgcgtcgtgaaaccactcgatgaccgctttgctagcgccctgacggctctaaacgatatgggcaaggtgagaaaagacatccagcagtgggagccctctcggggctggaatgattggacacaggtccctttctgctcgcaccactttcatgaacttattatgaaggacgggagggttctggtggtaccatgtcgcaaccaagatgagctcatcggaagagcccggatctcacagggtgcaggctggagcctgagggaaaccgcgtgcttggggaaatcctacgcccagatgtggagtttaatgtatttccaccgacgtgacctgagactcgctgccaatgcaatttgttctgctgtgccgagccattgggtccccacttcccgcacaacctggtcaatacacgccactcacgagtggatgaccacagaggatatgcttacggtgtggaaccgggtttggatccaggaaaatccttggatggaggacaagaccccagtggaaagttgggaggaaattccctacctgggaaagagggaggatcaatggtgcggctctctaatcggtctgactagcagagcaacatgggccaaaaacattcagaccgcgatcaatcaggtccgctccctcatagggaacgaggaatatactgactacatgccttcaatgaagcggtttaggcgagaggaagaggaagctggagtgttgtggtga

SEQ ID NO: 14994 - RNA, 9876 nt, synthetic construct
  misc_feature 1..9876: note = derived and/or modified CDS sequence (opt3) from DENV-2__KC131142__SS-prME
  source 1..9876: mol_type = other RNA
accgcaggaatcattataatggtgatccccaccgtcatggctttccacctgactacgcgaaacggggagcctcatatgattgttagcaggcaggaaaagggaaaatccctcctttttaagaccgagaatggtctgaacatgtgcacattgatggcaatggacttaggcgaactgtgtgaggatactatcacctacaattgcccattactccggcaaaacgaaccggaggacattgattgttggtgcaattctacatcaacctgggtgacttatgggacatgtaccgccacgggagagcaccgccgagaaaaacgtagtgtagcgctggtgccccatgtcggcatgggtcttgagactagaaccgaaacatggatgagctccgagggggcttggaagcacgcccagaggatcgagacttgggtgctgcggcatcctggattcaccataatggcagccatcttggcttacacaattggcaccacgtattttcagcgcgttctcatcttcattctgctgactgcaatcgccccatctatgacaatgcggtgcataggcatttcgaacagggactttgtggaaggggtctcaggaggtagctgggtggatatcgtactcgagcacggcagttgtgttaccactatggctaaaaataagcccacattagacttcgaactgattaagaccgaggccaaacaccctgcgacgcttcggaagtactgcatcgaagcaaaattgaccaacacaactaccgcctcccgctgtccaacacagggggagccctctctgaatgaggaacaagataagcgatttgtgtgcaaacatagcatggtcgacagaggatggggcaacggttgtgggctattcggaaagggcggcatcgtgacttgcgctatgtttacctgcaagaaaaatatggaggggaagattgtgcagcctgaaaacctcgagtatacaatagtcatcaccccacactccggagaagagaatgccgttggtaacgatactggcaaacatgggaaggagattaaagtgacgccgcagtcaagtatcacagaagcagagctgaccggatacggcactgtaaccatggaatgtagccccaggacaggtcttgacttcaatgagatggtgctgttgcagatggaaaacaaggcttggctcgtccaccggcaatggtttctggatttacctctgccatggctccccggggccgacacccagggctctaactggatacagaaagagactcttgtgacattcaagaatcctcacgcgaagaaacaggatgttgtggtcctgggatcccaagagggcgccatgcatacggcattgaccggggctactgaaattcagatgtcaagcggaaacctactgtttacaggtcacctcaagtgccgtctgcgcatggacaaacttcagctgaagggcatgagttattctatgtgtaccgggaaattcaaggtggtaaaggagatcgccgaaacacaacatggaactatcgttattagagtgcagtacgagggcgacggttccccatgcaaaatccccttcgagattatggatttggaaaagaggcacgtcctcgggcggctgataaccgtgaatccgatcgtcacggagaaagacagccctgtgaacattgaagctgagcccccatttggcgattcgtacatcatcattggagttgaacctggccagttaaagctgtcttggttcaaaaaggggtcctcaataggacagatgtttgagaccacaatgcgaggtgccaagcgcatggcaatcctaggcgacactgcctgggatttcgggagtctcggaggcgtgtttaccagcattggtaaagctctgcatcaagtattcggggcgatctatggcgcagccttttccggagtctcttggacaatgaagattcttatcggcgtggttataacttggatcgggatgaatagcagatcaaccagtttgtccgtgagcctggtcctcgtgggagtagtgacgctgtaccttggcgttatggtccaggctgactctggttgtgtggtgtcatggaaaaacaaggagctgaaatgcgggagtggaattttcatcacagataatgtccacacctggactgaacagtataagtttcagcccgagagcccatccaagttggcctctgcaattcaaaaagcccacgaagagggcatctgtggtataaggtcggttacacggctcgaaaacctgatgtggaagcagattacccccgagttaaatcatatcctgagcgagaacgaagtgaaactaactattatgaccggcgacatcaaggggataatgcaggctggaaaacgctccctcagacctcagccaacagagctgaagtactcatggaaagcctggggcaaggcaaagatgcttagtacggaattgcacaatcataccttcctgatcgatgggccggagactgcggaatgccccaacacaaatagggcttggaactctctcgaggtggaggactatggatttggcgtattcaccacaaatatttggctgaaattaaaggaacgtcaagatgtcttttgtgacagcaaactgatgtccgccgcaatcaaggacaaccgggccgtgcacgctgatatgggttactggattgagtcagcccttaacgacacttggaaaatcgaaaaggccagcttcatagaggttaagtcttgccactggcctaaatcccataccttgtggagtaatggggtgctcgagagcgaaatgattatcccaaagaacttcgctggacccgtctctcagcacaattatcgacctggctaccatacgcagacagccggtccatggcacctgggcagactagagatggattttgacttctgtgaagggaccactgtggttgtgaccgaggattgcggaaacaggggcccctccctgcgcacaactaccgcgtcagggaaactcatcacagaatggtgctgtcggagttgcacgctgccgcctcttagatacaggggagaggacggctgttggtatggtatggagattcgcccattgaaggaaaaagaggaaaatctggtaaacagcttagtcaccgccgggcatggacagatcgataatttttcgctcggcgtgctgggtatggctcttttcctggaggaaatgttgcgaactcgggtgggcacaaagcacgcaattctcctggtcgccgtttcctttgtgaccctaataactgggaacatgtctttccgtgacctgggaagagtaatggtgatggtcggcgctacaatgaccgatgacatcgggatgggagtgacgtacctcgccctgcttgcagcgtttaaggttaggcccactttcgccgctggcttgctgttacgcaaactcaccagcaaggagctgatgatgacaaccattggtatcgtgcttctgtcacaaagtactattcctgagacaatcctagaactcaccgatgccctggcattggggatgatggtcctgaaaatagtgcggaatatggagaagtatcagttagctgttacaatcatggccattctctgcgtgcccaacgcagtcatcctgcagaatgcctggaaagtatcctgtactacccttgctgtggtttctgtgagcccactgttgctcacgtcctcacaacagaaggcggactggattcctctggccctaacaatcaagggactgaaccccaccgcaatatttcttactaccctcagcagaacaagtaaaaagaggtcttggccactgaatgaagctattatggccgtcggcatggtgtccatcttggccagctcgctgctaaagaacgatatcccgatgactggccctctcgtagctgggggactgcttaccgtgtgctacgtcctgacgggtcgatcagcagacttggagctcgaacgcgccgcggacgttcggtgggaggagcaggctgaaatttctggcagttcccccatactgagcatcacaatttctgaggatgggagcatgtccatcaagaatgaagaggaggaacagaccctaactattctgatcagaacaggacttctcgtgatatcaggcctgttcccagtgagtatccccattaccgccgcagcctggtatttgtgggaggtcaaaaagcaaagggctggtgtgttatgggacgttcctagcccaccccctgtagggaaagcagaactggaggatggagcctaccgtatcaagcagaagggcattctcggctattctcagatcggggcgggagtgtacaaagaaggtacttttcacacaatgtggcatgtcacccgcggcgctgtgctgatgcacaaggggaaacggatagagccgtcctgggccgacgttaagaaagatcttatttcatacggaggcggttggaagctggagggggaatggaaggagggagaagaggtgcaggtcttggcactagaaccaggcaaaaaccccagagccgtgcaaacgaagcctggcctgttcaaaactaacaccgggacaatcggagctgtaagtctcgactttagcccaggtacctccggctctcccatcgtcgataagaaagggaaggtggttggactgtatggcaatggtgtggtcacaaggtcggggacttacgtgagcgccattgcacagaccgagaagtcaatcgaggacaaccttgaaatagaggatgacattttccggaaaaagagattaacggttatggatctgcatcctggagctggcaaaacaaagcgctatctcccggccatcgtgagagaagcgattaaaaggggcttgcggactctgatcctcgcccccacccgagtcgtggcagctgagatggaagaggccctgagagggcttccaatacgctaccagacccctgctattagggcagagcacacaggacgtgaaatcgtagacctgatgtgtcatgccactttcaccatgcggttgctatcccccatcagagtgccaaattataacctgattatcatggatgaggcccactttacagaccctgctagtattgcggcaaggggttacatatctacgcgcgttgaaatgggcgaggccgctgggatcttcatgactgccacacccccaggaagccgagacccgtttcctcagtccaatgcacccattatggatgaggaaagagagatcccagaacggtcatggaactctggccacgagtgggtcacagacttcaagggtaagaccgtgtggtttgtgcccagcatcaaagccgggaatgatattgctgcgtgcctcaggaagaacggcaaaaaggtcatacaattaagtcgcaaaactttcgacacagaatatatcaagacccgtacgaatgattgggactttgtagtgactacagatatttccgagatgggcgccaacttcaaggcagagagagttatcgaccctcggaggtgtatgaaaccagtgattctgaccgatggcgaagaacgcgtcatccttgctgggcccatgcctgtgacccatagctctgccgcacagcgaagaggacgggttggtaggaatccgaagaacgaaaatgaccagtacatatacatgggcgagccactggaaaacgatgaggactgcgcccactggaaagaggctaagatgctcttggacaatatcaacactcccgaagggattatcccttcaatgtttgagcccgaacgcgagaaagtggatgccattgacggagaatatagactgaggggcgaggcgcggaagacattcgtcgatctcatgcgtcgcggtgacctgccagtgtggcttgcataccgagtagccgctgaggggatcaactatgccgatagaaggtggtgttttgacggcgtgaaaaataaccaaatactagaagagaatgttgaagtcgagatttggaccaaggagggagaacggaagaaactgaagcctcgctggttggatgctagaatctactccgaccccttagcactgaaagagttcaaggagttcgccgctggcaggaaaagtctcacactgaaccttattactgagatggggcggctgccaacgtttatgacccagaaggcccgaaatgcactcgataacttggcggtgctgcatacagccgaagctggaggtagagcctataatcacgcactaagcgagctgcctgagactctcgaaacccttctgttattgacactgctcgctaccgtgactggcgggatcttcctgtttcttatgtcgggaaagggcataggtaaaatgacgctggggatgtgctgcatcattaccgcctctatcctcttgtggtacgcacagattcagccgcactggatcgccgcttccataattctggagttctttttaatcgtcctactgatccccgaaccagagaagcaacgcacacctcaggacaaccagctcacttatgttgtgattgcgatccttaccgtagtggccgcaacaatggctaatgaaatgggcttcctggagaaaaccaagaaagattttggattgggcagcataactacacagcaacccgagtcaaacattctggacatcgatctcaggccagccagtgcctggacgctgtacgcagtcgctaccactttcattacacctatgcttcggcattctatcgaaaattccagcgtgaacgtttcactcaccgccatagcgaatcaggctaccgtgctgatggggttgggaaagggttggcccctgagtaagatggacatcggcgtcccgttactagccattgggtgttacagccaggtaaacccaatcacactgactgcagccctccttctgttggtggctcactatgcaattatcggacctggcctgcaggccaaagcgacgcgtgaggctcaaaagagagccgcagccggtattatgaaaaatcccaccgttgacgggatcacagtgatagatctcgacccaattccctacgatcctaagtttgaaaaacagctgggccaggtcatgcttttagtgctgtgcgtcactcaggtgctcatgatgaggaccacatgggctttgtgtgaggccctgaccctagcaactggaccgatctccacgctgtgggaaggcaaccccgggcgcttctggaatacaaccatcgctgtttctatggccaacatttttcggggaagctatctcgcgggcgccggtcttctgttctccataatgaagaacactgcaaatacccgaagagggacaggaaacactggcgagaccttgggtgagaagtggaaaaataggctgaacgctctcggcaagtcagaatttcaaatctacaaaaagtctgggattcaggaggtggaccgcacactggccaaagaaggaatcaagcggggcgagacggatcatcacgcagtaagtagagggtcggctaaattacgttggttcgtggagaggaatcttgtcaccccagaaggaaaggttgtggacctgggctgcggtagagggggatggagctattactgtggcggtctcaagaacgtcaaagaggtgaagggcctaactaaagggggacctggccatgaggaacccattcctatgtccacatatgggtggaatctggtacgcttgcagtctggagtggatgttttctttaccccacccgaaaagtgcgacactctgctctgtgatatcggcgagtcaagccctaacccaacagtggaggccggtcgaacccttagagtcctgaatttggtggaaaactggctgaataacaatacgcaattctgcataaaagtcctcaacccctacatgccgtccgtgatcgagaagatggaagccttacagaggaagtacgggggagcgctggttcggaatcctcttagtcgcaactctacccacgagatgtattgggtaagcaacgcttcaggcaatattgtgtccagtgtcaacatgatcagcagaatgctgattaataggtttacaatgcgacacaaaaaggcaacttacgaaccagacgtggatctaggctctgggacccggaacatcggaatagagtccgagacacccaatctcgacattatcggtaaacgtatcgaaaagattaaacaggagcatgaaacttcatggcactatgatcaggaccatccttacaagacctgggcctatcacggcagctacgagacaaagcaaaccgggtcggcttctagtatggttaacggagtggtcaaactgttgactaagccatgggacgtgatacccatggtaacgcagatggccatgacagataccactccgttcggccagcagagagtgtttaaagaaaaggttgacacccgcacacaagagcctaaagagggtacgaagaagctgatgaaaatcaccgcagaatggctctggaaggagcttgggaaaaagaaaactcccaggatgtgtacacgggaagagttcaccagaaaggtccgctccaatgccgctctgggagcgatttttactgatgagaacaaatggaaaagcgccaggggcgcagtggaagactcaggcttctgggagttagtggataaggaacgaaatctgcacttggaggggaaatgcgaaacatgtgtctataacatgatgggaaagcgggagaaaaagctcggtgagtttggcaaagctaaggggtccagagccatctggtacatgtggctgggagcaaggttcctagaatttgaggcccttggcttcctgaatgaagaccattggttttctcgcgagaacagcctcagtggtgttgaaggggagggactgcacaagttgggctacattctgcgtgatgtgtccaaaaaggagggcggggctatgtatgccgacgataccgcgggatgggacacacggatcactctcgaagatcttaaaaatgaggaaatggtaaccaaccatatggagggtgtgcacaagaaactggcagaagccatattcagattaacgtaccagaataaggtcgtgagggttcagcgcccaacccctcgaggcacagtgatggacatcattagccggagagaccagagggggtctggacaagtcgtgacttatggcctgaacaccttcacaaacatggaggctcagttgatccgccagatggagggtgaaggggtatttaagtcaattcaacatctcactgttaccgaggaaatcgccgtgaaaaattggctggtcagagtgggacgggagaggctaagtcgtatggcaatttccggcgatgactgcgtggtcaagccccttgatgaccgattcgctagcgccctgacggctctcaacgatatgggcaaagttcgcaaggacatacagcagtgggagccatctagagggtggaatgattggacacaggtgcccttttgctcgcaccacttccatgaactgatcatgaaagacggacgggtattggtggtcccttgtaggaaccaagatgagttaattggtcgcgccagaatctcacagggcgcagggtggagcctgcgggaaaccgcgtgcctcggaaagtcctacgcccagatgtggagtcttatgtattttcacaggcgagacctgcgtctagctgccaatgcaatctgttctgctgtgccaagccattgggttccgacttccagaacaacctggtcaattcacgccactcacgagtggatgaccacagaagatatgctgacggtgtggaaccgcgtctggatacaggagaatccctggatggaggacaagacccctgtggaaagttgggaggaaatcccatacctcggcaaacgggaggatcaatggtgcggttctttgattgggctgactagcagggcaacatgggccaagaacatccagaccgcgattaatcaggtaagatcccttatcggaaacgaagagtatactgactacatgccctcaatgaaacgcttccggagggaggaagaggaagctggcgttctgtggtga

SEQ ID NO: 14995 - RNA, 9876 nt, synthetic construct
  misc_feature 1..9876: note = derived and/or modified CDS sequence (opt3) from DENV-2__AY858035__SS-prME
  source 1..9876: mol_type = other RNA
accgccggaatcattataatgatgatccccactgtgatggctttccacctgactacgcgaaacggggagcctcatatgattgtcagcaggcaggaaaagggaaagtccctcctttttaagaccgagaatggtgttaacatgtgcacactgatggcaatggacttgggcgaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtggccccatctatgacaatgaggtgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaacaccctgcgacgctgcggaagtactgcattgaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaagatcgtccagcctgaaaacctagagtatacaattgttataaccccacactccggagaagagaatgccgtgggtaacgatactggcaaacatgggaaggagatcaaagtaacgccgcagtcaagtattacagaagcagagctcaccggatacggcactgtgaccatggaatgtagccccaggacaggtctggacttcaatgagatggtccttctgcagatggaaaacaaggcttggttggtgcaccggcaatggtttctcgatctgcctttaccatggctgcccggggccgacacccagggctctaactggatccagaaagagactctcgttacattcaagaatcctcacgcgaagaaacaggatgtggtcgtgcttggatcccaagagggcgccatgcatacggcactgaccggggctactgaaatacagatgtcaagcggaaacttgctatttacaggtcacctgaagtgccgtctccgcatggacaaactgcagcttaagggcatgagttattctatgtgtaccgggaaattcaaggtagttaaggagattgccgaaacacaacatggaactatcgtgatcagagtccagtacgagggcgacggttccccatgcaaaattcccttcgagatcatggatctggaaaagaggcacgtgttggggcggctcattaccgtcaatccgatagtgacggagaaagacagccctgttaacatcgaagctgagcccccatttggcgattcgtacattatcatcggagtggaacctggccagctgaagttatcttggttcaaaaaggggtcctcaattggacagatgtttgagaccacaatgcgaggtgccaagcgcatggcaatactgggcgacactgcctgggatttcgggagtctaggaggcgtatttaccagcatcggtaaagctctccatcaagtcttcggggcgatttatggcgcagccttttccggagtgtcttggacaatgaagatcctgattggcgttgtgatcacttggatagggatgaatagcagatcaaccagtctttccgtcagcttggtgctggtaggagtggttacgctctacctgggcgtcatggtgcaggctgactctggttgtgtggtctcatggaaaaacaaggagcttaaatgcgggagtggaatcttcattacagataatgttcacacctggactgaacagtataagtttcagcccgagagcccatccaagctggcctctgcaatccaaaaagcccacgaagagggcatttgtggtatcaggtcggtgacacggttggaaaacctcatgtggaagcagataacccccgagctgaatcatattttaagcgagaacgaagtgaaactgactatcatgaccggcgacattaaggggatcatgcaggctggaaaacgctccctaagacctcagccaacagagctcaagtactcatggaaaacgtggggcaaggccaagatgctgagtaccgaacttcacaatcatactttcttgatagatgggccggagacagcagaatgccccaacaccaatagggcgtggaactctctggaggtagaggactatggatttggcgtcttcacaactaatatctggctcaaactgaaggaacgtcaagatgtgttttgtgacagcaaattaatgtccgctgccattaaggacaaccgggcagttcacgccgatatgggttactggatcgagtcagctctgaacgacacctggaaaattgaaaaggccagcttcatcgaggtgaagtcttgccactggcctaaatcccatacgctttggagtaatggggtcttggagagcgaaatgataattccaaagaacttcgcaggacccgtgtctcagcacaattatcgacctggctaccatacacagaccgctggtccatggcacctcggcagactggagatggattttgacttctgtgaagggactaccgttgtggtaacagaggattgcggaaacaggggcccctccctacgcactaccacagcctcagggaaactgatcacggaatggtgctgtcggagttgcaccctcccgcctctgagatacaggggagaggacggctgttggtatggtatggagatccgcccacttaaggaaaaagaggaaaatttggtcaacagcctggtgactgcggggcatggacagattgataatttttcgttaggcgtgctcggtatggccctgttccttgaggaaatgctgcgaacacgggtcggcaccaagcacgctatcttgctcgttgcagtgtcctttgtaactctgattacagggaacatgtctttccgtgacctaggaagagtgatggtcatggtgggcgccaccatgacggatgacatagggatgggagttacttacctggctctcctggccgcatttaaggtgaggcccaccttcgcggccggccttttgctgcgcaaattaacaagcaaggagctcatgatgaccactatcggtattgtcctgctttcacaaagtacaatccctgagaccattctggaactaacagatgctctcgccctggggatgatggtgttgaaaatcgttcggaatatggagaagtatcagctggcagtgactataatggctatcttatgcgtccccaacgccgtaattctccagaatgcatggaaagtgtcctgtaccacgctggccgttgtgtctgtcagcccacttctgttgacatcctcacaacagaaggctgactggatccctctcgcgctgaccattaagggactaaaccccactgccatctttctgaccacacttagcagaacaagtaaaaagaggtcttggccactcaatgaagcaataatggctgtgggcatggtatccattctggccagctcgttgctgaaaaacgatatcccgatgaccggccctttagtggccgggggactcctgacggtctgctacgttcttacaggtcgatcagctgacctggagttggaacgcgcagccgacgtgcggtgggaggagcaggcggaaatctctggcagttcccccattctcagcataaccatctctgaggatgggagcatgtccattaagaatgaagaggaggaacagactctgacaatcctaattagaaccggactgcttgtggtctcaggcctcttcccagtgagtatccccataactgctgccgcatggtatctgtgggaggttaaaaagcaaagggccggtgtattgtgggacgtgcctagcccaccccctgtcgggaaagctgaattagaggatggagcataccgtatcaagcagaagggcattctgggctattctcagatcggggccggagtgtacaaagaaggtacatttcacaccatgtggcatgttacgcgcggcgcggtgctcatgcacaaggggaaacggattgagccgtcctgggctgacgtcaagaaagatctgatctcatacggaggcggttggaaacttgagggggaatggaaggagggagaagaggtgcaggtactggccttggaaccaggcaaaaaccccagagcagtccaaactaagcctggcctattcaaaaccaacacagggaccataggagccgtgagtctggactttagcccaggtacatccggctctcccattgttgataagaaagggaaggtggtcggactctatggcaatggtgtggttactaggtcggggacctacgtgagcgctatcgcccagacggagaagtcaatcgaggacaaccctgaaattgaggatgacatcttcagaaagaagcggctgacaataatggatcttcatccgggagcaggcaaaactaagcgctatttacccgctattgtcagagaagccatcaaaaggggcctgcggaccctcattttggcgccaacacgagtggtagccgcagagatggaagaggctctgagagggctccctatccgctaccagacccccgccataagggctgagcacactggacgtgaaattgtggacctgatgtgtcatgcaaccttcacaatgcggcttctgtccccaatcagagttcctaattataacttgatcattatggatgaggcccactttacggaccccgccagtatcgctgcgaggggttacatttctactcgcgtcgaaatgggcgaggcagccgggatattcatgaccgctacaccaccgggaagccgagacccttttccccagtccaatgccccaatcatggatgaggaaagagagattcccgaacggtcatggaactctggccacgagtgggtgaccgacttcaagggtaagactgtgtggtttgtccctagcatcaaagcagggaatgatatcgccgcttgcctaaggaagaacggcaagaaggtaattcaactgagtcgcaaaacattcgactccgaatatataaagacccgtacgaatgattgggactttgtggttactacagatatcagcgagatgggcgcgaacttcaaggccgagagagtgattgacccacggaggtgtatgaaacccgtcatcctcaccgatggcgaagaacgcgtgattttagcagggcctatgccggttacccattcttcagctgcccagcgaagaggacgggtgggtaggaatccaaagaacgaaaatgaccagtacatctacatgggcgagcccctggaaaacgatgaggactgcgcacactggaaagaggccaagatgcttctggacaatataaacactcctgaagggatcattccctccatgtttgagccagaacgcgagaaagtcgatgctatcgacggagaatatagactcaggggcgaggcccggaagacattcgtggatttgatgcgtcgcggtgacctgcctgtatggctcgcgtacaaagtggcagccgaggggattaactatgctgatcgaagatggtgttttgacggcgttaagaataaccaaatcctggaagagaatgtcgaagtggagatatggaccaaggagggagaaaggaagaaacttaaaccccggtggctagatgcccgcatttacagtgacccactggctttgaaagagttcaaagagttcgcagccggcagaaagagcttaacactgaacctcatcactgagatggggaggctgcctacgtttatgacccagaaggctcggaatgcccttgataacctggcagtgctccatacagcggaagccggaggtcgagcttataatcacgccttgtcggagctgccggagactctagaaaccctgctccttctgacattattggcaaccgtcactggcgggattttcctgtttctcatgtctggaaaaggcatcggtaagatgacgctggggatgtgctgcataatcaccgcttccattcttctgtggtacgcccagatccagccccactggattgcagccagcatcatactcgagttctttttgattgttctgttaatcccagaacctgagaaacaaagaacaccccaggacaaccagctaacttatgtggtaatcgctattctgaccgtggtcgcggccacaatggcaaatgaaatgggcttcctcgagaagaccaaaaaggattttggacttggctcaatcactacacagcaaccagagagtaacatactggacattgatttgcgccctgcttctgcctggacgctgtacgccgtggcaaccactttcatcacacccatgctcaggcattccattgaaaatagctcagttaacgtgagtctgaccgctatcgccaatcaggcgaccgtccttatggggctcggaaagggttggccgctgagcaaaatggacataggcgtaccattgctggctatcgggtgttactcccaggtgaaccctattacattaactgccgcactactgctccttgttgcccactatgctatcattggacccggcctgcaggcaaaggccacgcgggaggcgcaaaaacgtgctgccgcaggtatcatgaagaatccaaccgtggacgggattacagtcatcgatttggaccccataccttacgatccgaaatttgaaaagcagctgggccaggtgatgctcctggtcctttgcgtgactcaggttttaatgatgagaaccacatgggccctgtgtgaggctctcaccttggccactggacccatttctacgctgtgggaaggcaacccagggaggttctggaatacaaccatcgcagtgagcatggctaacatctttcgcggatcctatctagccggcgcgggtctactcttctcaattatgaagaacactgccaatacccggcgagggacaggaaacactggcgagacccttggtgagaaatggaagaatagactgaacacattgggcaaatctgaatttcaaatatacaagaaaagtgggatccaggaggtagacaggacgctggcaaaggaaggaattaaacgcggcgagaccgatcatcacgctgtgtcgcgggggagcgccaagctcagatggttcgtcgagcgtaatctggttactcctgaaggaaaggtggtcgacttaggctgcggtagagggggatggtcctattactgtggcggtcttaaaaacgtgaaggaggtaaaaggcctgacaaaagggggacccggccatgaagaacctatcccaatgtctacctatgggtggaatctcgtgcggctacagtcaggagttgatgtgttctttactccccctgaaaaatgcgacacactgttgtgtgatattggcgagagctccccaaaccccaccgtcgaggcaggtcgcacgctgcgagtgctcaatcttgtcgaaaactggctgaataacaatacccaattctgcatcaaggtgttgaacccgtacatgcctagtgttatagagaagatggaagctctgcagagaaaatacgggggagccctcgtaaggaatccattatctcggaacagcacacacgagatgtattgggtgtcaaacgcctccggcaatatcgtcagtagcgtgaacatgatttctcgcatgctgatcaatagatttactatgaggcacaagaaagcgacctacgaacccgacgttgatcttggctccgggacacgaaacattggaatcgagtcagagatacctaatctggacattatcggtaagcggatcgagaagattaagcaggagcatgaaactagctggcactatgatcaggaccatccatacaagacctgggcttatcacggctcgtacgagacaaaacaaaccgggtctgcaagttccatggtgaacggagtcgtgcgtctactcactaagccctgggacgtaataccgatggtgacgcagatggccatgacagataccactcctttcggccagcagagagtttttaaagaaaaggtcgacacccgcacacaagagcccaaagagggtacgaagaagctgatgaaaatcaccgctgaatggttgtggaaggagctggggaaaaagaaaactaggcggatgtgtacaagagaagagttcacccgcaaggtgaggagcaatgccgcactcggagccatttttactgatgagaacaaatggaagtcagctcgagaagcggtggaggactccggcttctgggaacttgtcgataaggagcggaatctgcacttagaaggcaaatgcgagacatgtgtttataacatgatggggaagagagagaaaaagctgggagaatttggtaaagccaagggctctagggcaatctggtacatgtggttgggggctcgcttcctcgagtttgaagccctgggattcctaaatgaggaccattggtttagccgtgaaaacagtctttccggcgtggagggtgaggggctgcacaagctcggatacattctgcgggatgtaagcaaaaaggaaggcggcgcaatgtatgccgacgataccgctgggtgggacacaagaatcactttggaggatctgaaaaatgaagagatggtgaccaaccatatggaaggagagcacaagaaactcgccgaggcgatattcaaacttacgtaccagaataaggtcgtgagggttcagcgcccaacccctcgaggtacagtgatggacatcatttctcggagagaccagaggggctcagggcaagtcgtgacttatggactgaacaccttcacaaacatggaagcacagttaatccgccagatggagggcgaaggtgtatttaaaagtattcaacagctgactgttaccgaggagatcgccgtgaagaattggttggaaagagtcgggcgggagaggctctcccgtatggctattagcggagatgactgcgtggtgaaacccctggatgaccgattcgcctctgcactaacggctcttaacgatatgggcaaggtccgcaaagacatacagcagtgggaaccatcgagaggctggaatgattggacacaagttcccttttgctcacatcacttccacgagctgatcatgaaggacgggcgggtgctcgtagtgccttgtaggaaccaggatgaactgattggacgcgccagaatcagccagggtgctggctggtccttgcgggagaccgcctgcttagggaagagttacgcacagatgtggtctctgatgtattttcataggcgagacctccgtcttgcggccaatgctatctgtagcgccgtcccatcccactgggtgccgacttcaagaacaacctggagtattcatgcaactcacgagtggatgaccacagaagatatgctgacggtttggaaccgcgtgtggatacaagagaatccctggatggaagacaaaacccctgtcgagtcttgggaagagatcccatacctaggaaagcgggaggatcagtggtgcggcagcctgattggtctcacttccagggctacatgggccaaaaacatccagaccgcaattaatcaggtgagatcattgatcgggaacgaagagtatactgactacatgcccagcatgaagcgcttccggagggaagaggaagaggccggagtactgtggtga

SEQ ID NO: 14996 - RNA, 9873 nt, synthetic construct
  misc_feature 1..9873: note = derived and/or modified CDS sequence (opt3) from DENV-2__JX567951__SS-prME
  source 1..9873: mol_type = other RNA
accgcaggcgtgatcgtaatgctgattcccacagctatggcattccacctcactacgaggaacggggagcctcatatgatagttggaaggcaggaaaagggtaaaagccttctgtttaagaccgaggacggcgtgaatatgtgcacattgatggcaatcgatttaggggaactgtgtgaggacactattacctacaaatgcccactactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagacccggacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataaacttcaactgaaagggatgagctacagtatgtgtactggaaagttcaagatcgtcaaagaaatcgctgagacccagcacggcacgattgtgatcagagtacagtatgagggtgacgggtctccatgcaagattcccttcgaaataaccgatttggagaaaaggcatgttctcggccggctgatcacagtgaacccgattgtcactgaaaaggactcccctgtgaacatcgaggccgaacccccatttggagatagctacatcattgtcggcgtggagcctgggcagttaaaactgaattggttcaagaagggatcgtctataggtcaaatgtttgagaccacaatgcgaggcgctaaacgcatggccatcctaggggacactgcatgggatttcggatccctcggcggtgtttttacctcaattgggaaggccctgcaccaggtgttcggcgctatctacggagcggcatttagtggcgtaagctggacgatgaaaattcttatcggggtcataatcacatggattggaatgaactccagatctaccagcttgtcagtgagtctggttctcgtgggcgtcgtgactctgtatcttggtgccatggtacaggctgactccgggtgtatcgtgagctggaagaataaagaactgaagtgcggatctggcattttcatcacagataacgttcacacctggactgagcagtacaagtttcaacccgaatcaccaagtaaattggccagcgcaatacagaaggcccatgaggaaggtatttgtggcatcaggtccgtcacccggctcgagaatctgatgtggaaacagattacacccgagttaaaccacatcctgtctgaaaatgaggtgaagctaacgataatgaccggggacatcaaaggaattatgcaggctggcaagcgctcgctcagacctcaaccaactgaactgaaatatagctggaagacatgggggaaggccaaaatgctttccaccgagtcacataaccagacattcttgatcgatggaccggaaactgcagagtgccccaataccaacagggcgtggaatagtctggaggtggaagactacggctttggtgtcttcacgacaaacatttggctcaagctgcgtgagaaacaggacgtattttgtgattctaagttaatgagcgctgccatcaaagacaatcgggcagtgcacgccgatatggggtattggatagaatccgctctgaacgacacctggaagatggagaaggcctcattcattgaggtgaaaagctgccactggcctaagtctcatactctttggtccaatggagtattggaaagtgagatgatcatccccaagaatttcgcaggccccgtcagccagcacaactaccgacctggttatcatacccaaacagctggcccatggcacctcgggaagctggaaatggattttgacttctgtgagggaactaccgtggttgtgacagaagattgcggcaatagagggccctctctaaggacgaccactgcctccggaaaactgattacagagtggtgctgtcgctcatgcaccctcccgcctctgcggtacagaggcgaggacggttgttggtacgggatggaaatcaggccacttaaggagaaggaagagaacttggtcaatagtctggtgactgcgggacatggccagattgataactttagcttaggtgttctcggcatggccctgttccttgaagagatgctgcgcacacgagtggggaccaaacacgctatattgctcgtagcactgtcgtttgtcacgctaatcactggaaatatgtccttccgggacctgggccgtgtgatggtgatggtcggggccaccatgacagatgacattggaatgggcgttacctatctcgctctgcttgccgcatttaaggtgagacccactttcgcggccggtttgctgttaaggaaactcacatctaaggagctgatgatggctaccatcgggattgcccttctgagccagtcaacactacctgaaactatcctcgagctgaccgatgcattggctctgggaatgatggccttaaaaatagtacgcaacatggaaaagtaccaactcgcagtgacgatcatggccattagttgcgtccccaatgctgtgatcctgcagaacgcgtggaaggtttcctgtacaattcttgccgcagtgtctgtcagcccactgttgctcacctcctcacagcagaaagctgactggatccctctggccctaactataaagggcctgaatcccaccgccatttttcttacaactctcagccggaccagtaaaaagagatcttggccactgaacgaggctatcatggcagtgggcatggtttccatcttggccagctcgctgctaaagaatgacattccgatgacggggcctctcgtggcgggaggtctgcttacagtctgctatgtactgaccggcaggtcagctgatttggaactcgagcgagccgcagacgtgaagtgggaggatcaagccgaaatatctgggagttcccccatcctgagcattactatctctgaggacggaagcatgtccattaaaaacgaagaggaggaacagacactaaccatcctgatacgcactggccttctcgttatctcaggtgtgttcccagtcagtattcccatcacagctgcagcctggtacctgtgggaggtgaagaagcagcgggcgggggtattgtgggatgtgcctagcccaccccctgtcggaaaagctgaattagaggacggcgcctatagaattaagcagaggggcatcctggggtactctcaaataggagccggtgtttataaagaaggcacctttcacacgatgtggcatgtgactcgtggggcagtgctcatgcaccgcggaaagcggattgagccgtcctgggctgatgtcaaaaaggacctgatctcatacggcggtgggtggaaacttgagggagaatggaaagagggcgaagaggtgcaggttctggccttggaaccaggcaagaatcccagagcagtacagaccaaacctgggatcttcaagacaaacaccggaacaattggtgctgtgagtctagattttagcccaggcacttccgggtctcccatcgtcgacaggaaaggaaaggtggttggcctgtacggtaatggggtggtcacccgatcgggagcctatgtgagcgcgatagcccagacggagaagtcaattgaggataaccctgaaatcgaggacgatattttccggaaaaagcgcctcacaatcatggacctgcatccgggcgcaggcaaaactaagagataccttcccgctatagtaagggaagccattaaacgggggttacgaaccctgatcctcgctccaacaagagtcgtggcagccgagatggaagaggccttgcgcggactgcctatcaggtatcaaacccccgctattcgtgcggagcacactggtcgggaaatcgttgacctcatgtgtcatgcaaccttcacaatgagactgctttccccagtgagggtccctaactacaatctgattataatggatgaggcccactttacggaccccgctagtatcgccgcacgcggctatatttctactcgagtggaaatgggggaggccgctggaatcttcatgaccgcgacaccaccgggcagcagagatccttttccccagtccaacgccccaatcatggacgaggaacgggagattcccgaaaggtcatggaactctggtcacgagtgggttaccgatttcaaggggaagactgtgtggtttgtccctagcataaaagcaggaaacgacatcgctgcctgcttgcgcaagaatggcaaaaaggtgattcagctaagtcgtaaaacattcgattccgaatacgtaaagaccagagcaaacgactgggattttgtggttacgactgacatcagcgagatgggcgccaatttcaaggctgagcgggtcattgatccaaggcgctgtatgaaacccgtgatcctgacagacggggaagaacgagtgatactcgccggacctatgccggtcacccattcttcagcggcacaaagacggggtaggatcggccgcaacccaaagaatgaaaacgaccagtatatttacatgggggagcccttagaaaatgatgaggactgcgcccactggaaagaggctaagatgctgcttgataacatcaatacccctgaaggaattatcccctccatgtttgagccagaaagagagaaagtagacgccatagatggcgaatacaggctgcggggtgaggctcgtaagactttcgtggacctcatgcgccgaggggatttgcctgtttggctggcatataaagtggccgctgagggcattaactacgccgacagaaagtggtgttttgatggaatcaagaataaccagattctcgaagagaacgtcgaagtggagatctggacaaaagagggcgaaaggaagaaactgaagccccggtggcttgacgcacgcatatatagtgatccactagcgctgaaagagttcaaggagttcgccgctgggagaaagagcttgaccttaaatctgatcacagagatgggaaggctccctacttttatgacgcagaaagcccggaacgcactggacaatcttgctgttctgcataccgccgaagtgggtggcaaggcatacacacacgccctctcggagttgccggagactctggaaaccctactgctccttacactgttagctgcggtcaccgggggaattttcttgtttctgatgtctggcaaaggtatcgggaagatgactctcggcatgtgctgcattatcacggcctccatactgctttggtatgcacaaattcagccccactggatcgctgccagcatcattctggagttctttctcatcgtgttgctgataccagaacctgagaaacagcgaaccccacaggataaccaattaacatacgtagtgattgccatcctaactgttgtcgcagctaccatggccaatgaaatgggattcctggagaagacaaagaaagacctcggctttgggtcaattaccactcaggagagtgaatctaacatccttgacatagatctgagaccagcgtccgcttggacattgtatgccgtggcaacgaccttcgtgactcctatgctgcgccatagcatcgaaaattcaagtgtcaacgttagcctcacagccattgctaatcaggcaaccgtgctgatgggacttggtaagggctggcccctctccaaaatggacatcggggtaccgctgttggccattggatgttactctcaggtgaacccaatcaccctgacagcggctttactactgctcgtcgcccactacgcaattatcggccctggtcttcaagccaaggctactagggaagcccagaaacgggcagctgccgggataatgaagaatcccacggtggatggcattaccgttatcgacctggagccaatcccctatgatcctaagtttgaaaaacagttgggacaggtgatgctgctcattctgtgcgtcacacaagtacttatgatgcgtactacctgggcgttatgtgaggccctgacactcgcaaccggcccgataagcactttgtgggaggggaaccccggaagattctggaatacgacaatcgctgtgtccatggccaacatttttaggggctcatacctggccggtgctgggctactgttctctatcatgaagaataccactaacacccgccggggaacaggcaatgttggtgaaactctcggcgagaaatggaagagtcgacttaacgccctggggaaatcggaatttcagatttataagaaaagcggaatccaggaggtggacagaaccttggccaaggagggcataaagagaggggaaacagatcatcacgcggtctcccgcggatctgctaaactgcggtggttcgtggagagaaacatggtcacgccagaaggcaaggtggttgacctcggttgcgggcgtggaggctggtcatactattgtggtggcctgaaaaatgtgagggaggtaaaggggttaaccaaaggaggccctgggcatgaggaacccatccctatgagcacttacggatggaaccttgtgcggctgcaatccggcgtcgatgttttctttacaccacccgagaagtgcgacaccctcctatgtgatattggtgaaagttctcctaatccaactatcgaggcagggcgcacactgcgagtgttgaacctggtcgaaaattggctcaacaataacacccagttctgcattaaggtgcttaatccctatatgccgagcgtaatcgagaaaatggaaacgctgcagagaaagtacggaggcgccttggtgaggaaccctctgtcaagaaattccacccacgagatgtactgggttagtaacgctacaggcaatatagtgagctctgtcaacatgatttcccgcatgctcatcaatagatttactatgaaacacaagaaagccacctatgagccagacgtggatttagggtcaggaacaaggaacatcggtattgaaagcgagatacccaacctggacatcattggcaagcgaatcgaaaagattaaacaggagcatgaaacttcgtggcactacgaccaagatcatccttataagacctgggcataccacgggtcttatgagacaaaacagaccggaagtgcctccagcatggtcaatggcgtggttcggcttctgactaagccatgggacgtagtgcccatggtcacgcagatggctatgacagataccactccgttcggtcagcaacgtgtgtttaaagagaaggttgacaccagaacacaggaacctaaggaggggacgaaaaagctaatgaaaatcaccgcggaatggctctggaaggagctgggaaaagagaagactccccgcatgtgtacaagggaagagttcacccggaaagtgagatcaaacgccgcattgggcgctgtctttactgatgaaaataagtggaagtccgcccgcgaggcagtggaagacggcaggttctgggagctggtagatcgagagcggaacctccaccttgaagggaaatgcgagacatgtgtgtacaatatgatgggaaagagagagaaaaagctgggtgagtttggcaaagccaaggggtctagggctatatggtatatgtggttaggagcccgcttcctggaatttgaggcgttgggcttcctcaacgaggaccattggtttagccgtggtaatagtctgtccggggttgaaggagagggcctacaccggcttggctacatcctgagagaagtcgggaagaaagagggaggtgcaatgtacgccgatgacaccgctggctgggatacaaggattactctcgaagacctgaagaacgaggagatggtgaccaatcatatgaaaggggaacacaagaaattggccgaggcaatcttcaagctgacgtatcagaacaaggtggtccgcgttcagcgaccaacccctcggggaacagtgatggacattatcagcagaaaagatcaaaggggctctggtcaggtagggacttacggactcaataccttcacaaacatggaagctcagcttattcgccaaatggagggcgagggcatatttaagtcaatccagcatctgactgccaccgaagagattgctgtgcagaattggttagccagagtcgggcgggaaaggctgagtcgtatggcaatctccggagacgattgcgtggttaaacccatcgacgatcgattcgcgagcgccttgacggctctcaacgacatgggtaaggtgcgcaaagatattcagcaatgggagccatctagaggctggaatgactggacacaggtccccttttgctcgcaccacttccatgaactggtgatgaaggatgggcgggtcttagttgtgccttgtaggaaccaggacgagcttataggacgcgccagaatctcacagggcgcaggttggagcctgaaggagaccgcttgcctcgggaaatcctatgcccaaatgtggactctgatgtactttcaccggagggatttgcgattagcagccaacgcgatttgtagtgctgtcccatctcattgggtgccgacaagccgtaccacttggtccatccacgccaagcacgaatggatgaccacagaggacatgctggcagtgtggaatagagtctggattcaggaaaacccctggatggaggataaaacgcctgttgaatcatgggaggaggtgccatatctcggaaagcgcgaagaccagtggtgcggcagtcttatcggcctgacctctcgggccacttgggctaaaaatatacagacagccatcaaccaagtaaggagcctaattgggaatgagggatacaccgactatatgccctccatgaagagattccgccgggaagaggaagaggccggtgtgctgtgg

SEQ ID NO: 14997 - RNA, 9873 nt, synthetic construct
  misc_feature 1..9873: note = derived and/or modified CDS sequence (opt3) from DENV-2__JX567950__SS-prME
  source 1..9873: mol_type = other RNA
accgcaggagtgatcgtcatgctgattcccactgctatggcattccacctcactacgaggaacggggagcctcatatgatagttggaaggcaggaaaagggtaagagccttctgtttaagaccgaggacggcgtgaatatgtgcaccttgatggcaatcgatttaggggaactgtgtgaggacactattacctacaaatgcccacttctccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggagaagagatcaaaattacaccgcagtcctcaatcaccgaagccgagcttactggctatggtaccgtaacaatggaatgtagtcccaggaccgggctggatttcaacgagatggtgttgctccagatggaggacaaggcatggctggtccaccggcaatggtttttagatctgcctctcccatggcttcccggcgctgacactcagggaagcaattggatacagaaagaaacactggtgacgttcaagaaccctcatgccaagaaacaggacgttgtggtcttgggctctcaagagggggcgatgcacaccgccctaactggagcaacagaaattcagatgtcctcaggtaatctgctctttaccggccatctgaagtgccgtcttcgcatggataaactgcagttgaaggggatgagctacagtatgtgtacaggaaaattcaagatcgtgaaggagatcgctgagactcaacacggcaccattgtaatcagagttcagtatgaaggtgacgggtctccatgcaaaattcccttcgagataacggatctcgaaaagaggcatgtgctgggccggttaatcaccgtcaacccgattgtgacagagaaagactcccctgtcaacatcgaagccgagcccccatttggagatagctacatcattgtgggcgttgagcctgggcagctgaagctaaattggttcaaaaagggatcgtctataggtcagatgtttgaaactaccatgcgaggcgctaagcgcatggccatcctcggggacacagcatgggatttcggatccctgggcggtgtgtttacttcaattgggaaagcccttcaccaagtattcggcgctatctacggagcggcatttagtggcgtcagctggaccatgaagattttgatcggggtgataatcacgtggattggaatgaactccagatctacaagcctgtcagttagtctcgtgctggtcggcgtggtaaccctttatctgggtgccatggtgcaggctgactccgggtgtatcgttagctggaaaaataaggagttgaaatgcggatctggcattttcatcactgataacgtccacacatggaccgaacagtacaagtttcagcccgagtcaccaagtaagctcgccagcgcaatacaaaaagcccatgaagagggtatttgtggcatcaggtccgtgactcggctggagaatttaatgtggaagcagattacccccgaactgaaccacatcctatctgagaatgaagtgaaactcacaataatgacgggggacatcaagggaattatgcaggctggcaaacgctcgctgagacctcagccaaccgagcttaagtatagctggaaaacttgggggaaggccaagatgttgtccacagaatcacataaccaaaccttcctgatcgatggaccggagacagcagagtgccccaatactaacagggcgtggaatagtctcgaagtcgaggactacggctttggtgttttcaccacgaacatttggctgaaattacgtgaaaagcaggacgtgttttgtgattctaaactgatgagcgctgccatcaaggacaatcgggcagtgcacgccgatatggggtattggatagagtccgctcttaacgacacatggaaaatggagaaggcctcattcattgaagtaaagagctgccactggcctaaatctcataccttgtggtccaatggagtcctcgagagtgaaatgatcatcccaaagaacttcgcaggccccgtgagccagcacaactaccgacctggttatcatactcagaccgctggcccatggcacctggggaaactagagatggattttgacttctgtgaaggaacaactgttgtggtcaccgaggattgcggcaatagagggccctctctgaggacaacgaccgcctccggaaagctcattactgagtggtgctgtcgctcatgcacactgccgcctcttcggtacagaggcgaagacggttgttggtacgggatggagatcaggccattgaaagaaaaggaggaaaacctggtgaatagtttagttaccgcgggacatggccaaattgataactttagcctcggtgtgctgggcatggcccttttcctggaggagatgttgcgcactcgagtagggacaaagcacgctatactcctggtcgcactatcgtttgtgaccctgatcacgggaaatatgtccttccgggacctcggccgtgtgatggtcatggttggggccactatgaccgatgacattggaatgggcgtgacatatctggctcttttggccgcatttaaagtaagacccaccttcgcggccggtctgttactcaggaagctgacttctaaagaacttatgatggctacaatcgggattgccctgctaagccagtcaaccctccctgagacaatcctggaattgactgatgcactggctttaggaatgatggccctcaagatagtgcgcaacatggagaaataccagctggcagtcaccatcatggccattagttgcgtgcccaatgctgttatccttcaaaacgcgtggaaggtgtcctgtacgattctggccgcagtctctgtgagcccattgctcctgacatcctcacagcagaaggctgactggatccctctagccctgaccataaaaggccttaatcccactgccatttttctcaccacactgagccggacaagtaagaaaagatcttggccattgaacgaagctatcatggcagttggcatggtgtccatcctggccagctcgttactcaagaatgacattccgatgaccgggcctctggtcgcgggaggtcttctgacggtatgctatgtgttgacaggcaggtcagctgatctcgagctggagcgagccgcagacgttaaatgggaagatcaggccgagatatctgggagttcccccatcctaagcgtgaccatttctgaagacggaagcatgtccatcaagaacgaggaggaagaacaaactctgacaattcttatccgcaccggcctcctggtcatatcaggtgtgttcccagtaagtatccccattactgctgcagcctggtacttgtgggaagtgaaaaagcagcgggcgggggtcttatgggatgttcctagcccaccccctgtgggaaaggctgagctggaagacggcgcctatagaatcaaacagaggggcattctcgggtactctcagatcggagccggtgtgtataaggagggcacatttcacaccatgtggcatgtcacgcgtggggccgtgctgatgcaccgcggaaaacggatagagccgtcctgggctgatgttaagaaagaccttatttcatacggcggtgggtggaagctggaaggagagtggaaggaaggcgaggaagtacaagtgttggccctagagccaggcaaaaatcccagagcagtccagactaagcctgggatcttcaaaaccaacacaggaaccatcggtgctgtgagtctggattttagcccaggcacatccgggtctcccattgttgacaggaagggaaaagtggtcggcctctacggtaatggggtggtaactcgatcgggagcctatgtcagcgcgatcgcccagaccgagaagtcaatagaagataaccctgagattgaagacgatatcttccggaagaaacgcctgacgattatggaccttcatccgggcgcaggcaagacaaaaagatacttacccgctatcgtgagggaggccataaagcgggggctgcgaactctcattttggctccaaccagagttgtggcagccgaaatggaggaggccctgcgcggactccctatcaggtatcagacacccgctatccgtgcggaacacaccggtcgggagattgtcgacctgatgtgtcatgcaactttcaccatgagacttctgtccccagtgagggttcctaactacaatttgatcattatggatgaagcccactttagtgaccccgcttctatagccgcacgcggctatatcagcacacgagtggagatgggggaggccgctggaattttcatgacggcgactccaccgggctccagagatccttttccccaatcaaacgccccaatcatggacgaagaacgggaaatccccgagaggtcttggaatagcggtcacgaatgggtcaccgatttcaaagggaagacagtgtggtttgtacctagtattaaggcaggaaacgacatagctgcctgcctacgcaaaaatggcaagaaagtgatccagctgtcccgtaagaccttcgatagcgagtacgttaaaactagagcaaacgactgggattttgtcgtgacaaccgacatttctgagatgggcgccaatttcaaggctgaacgggtgatcgatccaaggcgctgtatgaagcccgtcattctcacggacggggaggaacgagtaatcttagccggacctatgccggtgactcattcatccgcggcacagagacggggtaggataggccgcaaccccaagaatgagaacgaccaatatatctacatgggggaacccctggagaatgatgaggactgcgcccactggaaggaagctaaaatgcttctggataacattaatacacctgagggaatcattcccagtatgtttgaaccagagagagaaaaggttgacgccatcgatggcgagtacaggctccggggtgaggctcgtaaaaccttcgtggacttgatgcgccgaggggatctgcctgtctggctcgcatataaggtggccgctgaaggcataaactacgccgacagaaaatggtgttttgatggaattaagaataaccagatcctggaggaaaacgttgaggtggagatttggaccaaggaaggcgagaggaagaaacttaaaccccggtggctagacgcacgcatctatagcgatccactggcgttgaaagagttcaaagagttcgccgctgggagaaagtcgttaactctgaatctcataacagaaatgggaaggctgcctacctttatgacacagaaggcccggaacgcacttgacaatctggctgtcctccatactgccgaggtgggtggcaaagcatacacgcacgccttgaacgagctgccggaaaccctagagacactgctccttctgactttattggctgcggtaaccgggggaatcttcctgtttctcatgtctggcaagggtattgggaaaatgacactgggcatgtgctgcatcattaccgcctccatccttctgtggtatgcacagatacaaccccactggattgctgccagcatcatcctcgagttctttttgattgtgctgttaatcccagagcctgaaaagcagcgaactccccaggataatcagctaacgtacgttgtcatagccattctgaccgtggtggcagctacaatggccaacgagatgggattcctcgagaaaactaagaagtatcttggcctggggtcaatcaccacacaagaaagtgagtctaatattttggacatcgacctgagaccagcgtccgcttggaccctctacgccgtcgcaactacatttgttacgcctatgctgcgccatagcatagtgaactcaagtgtaaatgtgacccttactgccatcgctaaccaggcaacagtcctcatgggactgggtaaaggctggcccttgagcaagatggatattggggtgccgctgttagccatcggatgttactcccaggttaatccaattaccctaaccgcggctctgctccttctggtggcccactatgcaatcattggccctggtttgcaggccaaagctacaagggaagcccaaaagcgggcagctgccgggatcatgaaaaaccccactgtcgacggcataacggtaattgatctggagccaatcccctacgaccctaagttcgaaaagcagctcggacaggtgatgctgcttatcttatgcgttacccaggtgctgatgatgcgtacaacttgggcgctctgtgaggccttgaccctggcaacaggcccgatttctaccctatgggaggggaatcccggaagattttggaacactacgatagctgtcagcatggccaatatcttcaggggctcctatctggccggtgctgggctcctattttcaattatgaaaaacacaaccaatactcgccggggaaccggcaacgtgggtgaaacactgggcgagaagtggaaatctcgattgaacgccctggggaagaatgagttccaaatctacaaaaagagtggcattcaggaggtcgatagaactctcgccaaagagggcatcaagagaggggaaaccgaccatcacgcggtgtcgcgcggaagcgctaagctgcggtggtttgttgagagaaacatggtgacaccagaaggcaaagtagtggatttaggttgcgggcgtggaggctggtcctattactgtggtggccttaagaatgtcagggaggttaaagggctgacgaagggaggccctgggcatgaagaaccaatacctatgtctacctatggatggaacctcgtgcggctacagtcaggcgtcgacgtgttcttcactccacccgagaaatgcgatacactgttgtgtgacatcggtgaaagctcccctaatccaaccattgaggcagggcgcactctgcgagtactcaaccttgccgaaaattggctgaacaataacacacaattttgcatcaaggtgttgaatccctacatgccgagtgttattgagaagatggaaaccctgcagagaaaatacggaggcgctctcgtgaggaaccctttatctcggaatagcacgcacgagatgtattgggtctcaaacgccaccggcaatatcgtgtccagtgtcaacatgataagccgcatgctgattaacagattcacaatgaagcacaaaaaggcaacttacgagccagatgtggaccttgggtctggaaccaggaatatcggtatcgaatccgagattcccaacctggatataatcggcaaacgaattgaaaagatcaagcaggagcatgaaacatcatggcactatgaccaggaccatccttacaaaacttgggcctatcacgggagctacgagaccaagcaaacaggatcggcttctagtatggttaatggcgtagtgcggctactcaccaaaccatgggatgtcgtgcccatggttactcagatggcgatgacggacacaaccccgtttggtcagcagcgtgtgttcaaggagaaagtcgatactagaacccaagaacctaaggaggggacaaagaaactgatgaagattacggccgaatggttgtggaaagagctgggaaaggagaaaacaccccgcatgtgtactagggaagagtttacacggaaggtgagatccaacgcagctctcggcgccgtattcaccgacgaaaataaatggaaaagcgcacgcgaggccgtggaagatggcaggttttgggagcttgttgaccgagagcggaacctgcacttagaagggaagtgcgagacttgtgtctataatatgatgggaaaaagagaaaagaaactgggtgagttcggcaaggctaaagggtcaagggccatctggtacatgtggttgggagcgcgctttctcgagttcgaggcactgggctttctaaacgaggatcattggttctcccgtgaaaattctcttagcggtgtggagggggaaggactgcaccggctcggctacatactgagagacgtgagtaagaaggagggcggggccatgtatgctgatgacacagccggatgggataccaggatcacattggaagacctgaaaaacgaggagatggtcactaatcatatgaagggtgaacacaaaaagctcgcagaggctatttttaaacttacctaccagaacaaggttgtgcgcgtacagcgaccaacgcctcggggcaccgtgatggacatcatttccagaagggatcagcgcgggagcggacaagtcggcacatatggtctgaatactttcaccaacatggaagcccagttaatcagacagatggagggggagggaattttcaagtctatacaacatctgacagctactgaagagatcgccgtgcagaattggttggcacgggttggcagggaacgtctctcacgaatggcgattagtggcgacgattgcgtggtcaaacccatcgacgatcgctttgcctccgctctgaccgccctaaacgacatggggaaggtgagaaaagatatccagcagtgggagccaagccggggatggaacgactggacgcaagtacccttctgctctcaccactttcatgaacttgttatgaaggatggtagggtgctggtcgtgccttgtcgcaatcaggacgagctcattggcagagcacggatatcgcagggggctggatggtcactgaaagagacagcctgcttgggcaagagctacgcacagatgtggaccttaatgtatttccacaggcgagatctgcgtctcgccgcgaacgctatctgttccgccgtgccaagtcattgggtcccgacttctagaacaacctggagcattcacgcaaagcacgaatggatgactaccgaggacatgcttgccgtttggaatcgcgtgtggatccaagaaaacccctggatggaggataaaacacctgtagaatcctgggaggagattccatacctgggtaagcgggaagaccagtggtgcgggtcactaatcggactgacgagtagggctacctgggccaaaaatatacagactgcaatcaaccaggtgagatctctcattggcaatgagggctatacagactacatgcccagcatgaagcgctttcggagggaagaggaagaggctggggtcttgtgg

SEQ ID NO: 14998 - RNA, 9873 nt, synthetic construct
  misc_feature 1..9873: note = derived and/or modified CDS sequence (opt3) from DENV-2__HQ012538__SS-prME
  source 1..9873: mol_type = other RNA
accgccggcgtgatcattatgctgatacccacggctatggctttccacctcactacgagaaatggggaacctcatatgatcgtcggaagacaggaaaagggtaaaagccttctgtttaagaccgaggacggcgttaatatgtgcacattgatggccattgatttaggggaactgtgtgaggacactatcacctacaaatgcccacttctccggcaaaacgaaccggaggatattgactgttggtgcaattccacatctacctgggtgacttatggaacatgtaccacgactggcgagcaccgccgagaaaagcgttcagttgcgctggtgccccatgtcggtatggggcttgagaccagaacagaaacttggatgagtagcgagggagcttggaaacacgtgcagaggatcgagacctggatactgcggcatcctggcttcgccatcatggcagccattttggcttacacaatcggcaccacgcactttcagcgcgcactcattttcatcctgctgactgccgttgctccatccatgacaatgagatgcatagggatttctaacagggattttgtggaaggagtctcgggtggctcatgggtggacatcgtgctcgagcacgggagctgtgttaccactatggccaagaataagcccacattagatttcgaactgattaaaaccgaggcgaagcagcctgcaacgcttcggaaatattgcatcgaagccaagttgaccaacacaactaccgagagtcgctgtccaacacaaggagagccctccctgaatgaagaacaggacaaacgatttatctgcaagcattctatggtggatagaggctggggtaacgggtgtggactattcggcaagggcgggattgtcacttgcgctatgtttacctgcaaaaagaatatggaaggaaaagtggtgctccctgagaacctggaatacacaatagtcatcaccccacacagcggtgaggagcatgccgttggcaatgacactgggaagcacggagaagagattaaaatcacgccgcagtcctcaataacagaagcagagcttaccggctatggtactgtgaccatggaatgtagtcccaggacagggctggatttcaacgagatggtattgctccagatggaggaaaaggcttggctggtgcaccggcaatggtttttagacctgcctctcccatggcttcccggcgccgatacccagggaagcaattggattcagaaagagactctggtcacattcaagaaccctcatgcgaagaaacaggacgtggttgtgttgggctctcaagaaggggccatgcacacggcactaaccggagctactgagatccagatgtcctcaggtaatctgctctttacaggccatctgaagtgccgtcttcgcatggacaaactgcagttgaaggggatgagctacagtatgtgtaccggaaaattcaagatcgtcaaggagattgccgaaacacaacacggcactatcgtgattagagtacagtatgagggtgatgggtctccatgcaaaatacccttcgaaatcatggacctcgagaagaggcatgttctgggccggttaattaccgtgaacccgatcgtcacggaaaaagattcccctgtgaacatcgaggctgagcccccatttggagacagctacattataatcggcgtcgaacctgggcagctgaagctaaattggttcaaaaagggatcgtctattggtcagatgtttgagaccacaatgcgaggcgccaagcgcatggcaatcctcggggatactgcctgggacttcggatccctgggcggtgtgtttacctcaattgggaaagcacttcaccaagttttcggcgcgatctacggagcagcctttagtggcgtgagctggacaatgaagatattgatcggggtaattatcacttggattggaatgaactccagatctaccagcctgtcagtcagtctcgtgctggttggcgtggtcacgctttatctgggtgctatggtgcaggccgattccgggtgtgtagtgagctggaaaaataaggaattgaaatgcggatctggcatcttcataacagacaacgttcacacctggactgagcagtacaagtttcagcccgaatcaccaagtaagctcgcaagcgccattcaaaaagctcatgaggagggtatctgtggcattaggtccgtcacacggctggaaaatttaatgtggaagcagatcacccccgagctgaaccacatactatctgaaaatgaggtgaaactcactatcatgaccggggatattaagggaatcatgcaggccggcaaacgctcgctgagacctcagccaacagaacttaagtatagctggaaaacgtgggggaaggcaaagatgttgtccaccgagtcacataaccaaactttcctgattgacggaccggagacagcggaatgccccaataccaacagggcttggaatagtctcgaggtggaagattacggctttggtgtcttcacaactaacatctggctgaaattacgtgagaagcaggacgtattttgtgactctaaactgatgagcgccgcaataaaggataatcgggccgtgcacgctgacatggggtattggattgagtccgcccttaacgatacctggaaaatggaaaaggcatcattcatcgaggtaaagagctgccactggcctaaatctcatacgttgtggtccaatggagtactcgaaagtgagatgatcattccaaagaacttcgctggccccgtcagccagcacaactaccgacctggttatcatacacagaccgccggcccatggcacctggggaaactagaaatggactttgatttctgtgagggaactaccgtggttgtgacagaggactgcggcaatagagggccctctctgaggactaccacagcgtccggaaagctcatcacggaatggtgctgtcgctcatgcaccctgccgcctcttcggtacagaggcgaggatggttgttggtacgggatggaaattaggccattgaaagagaaggaagagaacctggtcaatagtttagtgactgccggacatggccaaatagacaactttagcctcggtgttctgggcatggctcttttcctggaggaaatgttgcgcacacgagtggggaccaagcacgcaatcctcctggtagccgtctcgtttgtgactctaattacaggaaatatgtccttccgggatctgggccgtgtgatggtcatggttggggtgaccatgacggacgatatcggaatgggcgtaacttatctcgctctgcttgccgcatttaaagtgagacccaccttcgcggccggtttgctgttaaggaagctcacatctaaagagctgatgatggctaccattgggatcgcccttctgagccagtcaactatacctgaaacaatcctagagctcaccgacgcactggctttgggaatgatggtcctgaagattgtgcgcaacatggaaaaataccagttagccgttacaatcatggcaattagttgcgtgcccaatgccgtcatcctcctgaacgcttggaaggtgtcctgtactatacttgcggccgtttctgtgagcccactgttgctcacctcctcacaacagaagacggattggattcctctggcactaacaatcaaaggcctgaatcccaccgctatctttcttactaccctcagccggacaagtaagaaaagatcttggccactgaacgaggccgtcatggccgtaggcatggtgtccattttggctagctcgctgttaaagaatgacataccgatgactgggcctctcgttgcaggaggtctgcttaccgtgtgctatgtcctgacgggcaggtcagccgacttggagctcgaacgagcggctgatgtgaaatgggaggaccaggccgaaatctctgggagttcccccattctgagcatcacaatttctgaggatggaagcatgtccatcaagaacgaggaagaggaacagaccctaactatactgatccgcacaggccttctcgtaatttcaggtgtgttcccagtcagtatccccattaccgcagccgcttggtacctgtgggaggttaaaaagcaacgggcaggggtgttgtgggacgtgcctagcccaccccctgtcgaaaaggccgagttagaggatggagcgtatagaatcaaacagaggggcatactgggctactctcagattggggctggagtgtataaggaaggtacttttcacacaatgtggcatgttacccgtggcgccgtactcatgcaccgcgggaaacggatcgagccgtcctgggcagacgtgaagaaagatctgatctcatacggaggcggttggaaacttgaaggggagtggaaggaaggagaggaggtccaggtgctggccttggaaccaggcaaaaatcccagagctgttcaaacgaagcctggcctattcaaaactaacaccgggacaattggagccgtgagtctggactttagcccaggtacctccggctctcccatcgtcgataggaaggggaaagtggtaggactctacggcaatggtgtcgtgacacgatcgggggcatatgttagcgctatagcccagactgagaagtcaattgaagacaaccctgagatcgaagatgacattttccggaagaaacgcctgaccatcatggatcttcatccgggagcgggcaagacgaaaagatacttacccgccatagtgagggaggcaattaagcggggcctgcgaacactcatcttggctccaactagagtcgtggccgctgagatggaagaggcactgcgcgggctccctatcaggtatcagacccccgccattcgtgccgaacacacaggacgggagatcgttgacctgatgtgtcatgctaccttcactatgagacttctgtccccagtgagggtccctaactacaatttgattataatggacgaggcgcactttaccgatcccgcaagtatcgccgctcgcggttatatttctacacgagtggaaatgggcgaggccgcagggatcttcatgacggccactccaccgggaagcagagacccttttccccagtccaacgctccaatcatggatgaagaacgggaaattcccgagaggtcatggaactctggccacgagtgggtaaccgacttcaaaggtaagacagtgtggtttgttcctagcataaaggcggggaacgatatcgccgcatgcctacgcaaaaatggaaagaaagtcattcaactgagtcgtaagaccttcgactccgaatacgtgaaaactagagctaacgattgggactttgtggtcacaaccgatatcagcgagatgggcgccaatttccgggcagaaagggtaattgacccacgccgatgtatgaagcccgtgatcctcacggatggcgaggaaagagttatattagccgggcctatgccggtgactcattcttcagctgcccagcggaggggacgcatcggtagaaacccaaagaatgagaacgaccagtatatttacatgggcgagcccctggaaaatgacgaggattgcgcgcactggaaagaagcaaagatgcttctggacaacatcaatacacctgaggggattatcccctccatgtttgaaccagagagggagaaagtcgatgccatagacggagaataccggctccgtggcgaggctcgcaagaccttcgtggatttgatgcgaagaggtgacctgcctgtttggctcgcctatagggtggctgcagaagggattaactacgccgatcggcgctggtgttttgacggcatcaaaaataaccaaattctggaggagaacgtcgaagtggagatctggaccaaggaaggagagaggaagaaacttaagcccaggtggctagatgctcggatatatagtgacccactggccttgaaagagttcaaggagttcgcagcgggccgaaagagcttaactctgaatctcatcacagagatggggagactgcctacctttatgacacagaaggcccgcgatgctcttgacaacctggccgtactccatactgcagaagctggaggtagggcctacaatcacgcattgtcggagctgccggaaacgctagagaccctgctccttctgacattattggccactgtgaccggcgggattttcctgtttctcatgtctggaaaaggcatcggtaagatgacactggggatgtgctgcattatcaccgcttccatacttctgtggtatgcgcagattcagccccactggatcgccgcaagcatcattctcgagttctttttgatcgttctgttaataccagagcctgagaagcaacggactccccaggataaccagctaacgtacgtcgtgattgctatcctgaccgtggtcgccgccacaatggcaaatgaaatgggcttcctcgagaaaactaagaaagaccttggactgggctcaattaccacacaggaaagtgagtctaacatcttggacatagatctgcgtccagcttccgcctggaccctctatgcggttgctactacatttgtgacgcctatgctgagacatagcatcgaaaattcaagtgtaaacgtgagccttaccgccattgcaaatcaagccactgtcctcatggggctgggaaagggttggcccttgtccaaaatggacatcggcgtgccgctgttagctattgggtgttactctcaggttaacccaatcacactaaccgcagccctgctccttctggtggcgcactacgctattatcggacctggcttgcaggccaaggcaaccagggaggcccagaagcgcgctgccgcaggtataatgaaaaatcccacagtcgatgggattactgtaatcgacctggagccaatcccctatgatcctaagttcgaaaaacaactcggccaggtgatgctgcttattttatgcgttacacaggtgctgatgatgcggaccacatgggctctctgtgaggccttgactctggcgaccggaccgataagcacactatgggaaggcaaccccgggcgattttggaataccactatcgccgtctccatggcaaacattttcagaggatcatacctggctggcgccggtctcctattttctatcatgaagaatacgacaaacaccaggcgcgggactggaaatattggcgagaccctgggtgagaaatggaagagtcggttgaacgcactgggcaagtcggagttccagatctataaaaagagcgggatacaagaggtggacagaacactcgctaaagaaggaatcaagcgtggcgagactgatcatcacgccgtctccagggggtctgccaaactgcggtggtttgtggaacgcaacatggttaccccagagggaaaggtggtagacttaggctgcggtcgagggggatggtcatactattgtggcggtcttaaaaatgtgagagaggtcaagggcctgacaaaaggcgggcctgggcatgaagaacccattcctatgagcacgtacgggtggaacctcgttaggctacagtccggagtggatgtcttcttcaccccacccgaaaaatgcgacactctgttgtgtgatatcggcgagagttctcctaatccaacaattgaagcgggtcggaccctgcgcgtgctcaaccttgtagagaattggctgaacaataacactcagttttgcatcaaggtgttgaatccctatatgccgagcgttatagagaaaatggaaacactgcaaagaaagtacgggggagctctcgtgaggaaccctttatcacgaaattccacccacgagatgtactgggtcagtaacgcaacgggcaatattgtgagctctgtcaacatgatctcccggatgctgatcaatcgtttcaccatgaaacacaagaaggccacatatgaaccagacgtggatcttggctcagggactagaaacattggaatagagagcgaaatccccaacctggacattatcggtaaacgcattgagaagatcaaacaggagcatgaaacctcgtggcactacgaccaggatcatccttataagacatgggcttaccacggctcttatgagactaaacagaccgggagtgcctccagcatggttaatggagtagtgaggctactcacaaagccatgggacgtcgtgcccatggttacccaaatggcaatgactgatacgacaccgtttggccagcagcgggtgttcaaggaaaaagtcgacaccagaactcaggagcctaaggagggtaccaaaaagctgatgcgcataacagccgaatggttgtggaaagagctggggaagaagaaaacgcccaggatgtgtacccgagaagagtttactcggaaggtgagatcaaacgctgcgctcggagccatcttcacagatgaaaataaatggaagtccgcaagggaggctgtagaggactctcgcttttgggaacttgtggatcgtgagcggaacctgcacttagaaggcaaatgcgagacctgtgtttacaatatgatgggcaagagagagaagaagctgggggagttcggaaaggccaaaggtagcagggcaatttggtatatgtggttgggcgcccgctttctcgagttcgaagctctggggtttctaaacgaggaccattggttcagtcgaggaaattcccttagcggcgtcgaaggtgaggggctgcaccggctcggatacatcctgagagatgtgtctaagaaagaaggcggcgccatgtacgcggacgatactgcagggtgggacacaaggattaccttggaggacctgaagaacgaggaaatggtgacaaatcatatgaaaggagagcacaagaagctcgccgaagctatctttaaacttacttatcaaaacaaggtcgttcgcgtgcagagaccaacccctcggggtacggtaatggatattatatcaaggcgtgaccagcgaggcagtggacaggtgggaacctacggcctgaatacattcactaacatggaggcccaattaatccgccagatggagggtgaagggattttcaaatccatccagcatctgaccgtcacagaggaaatcgcagtgcaaaattggttggctagagttggacgggagaggctcagccgcatggccatttctggcgatgactgcgtggtcaagcccctggatgacagatttgcttcggccctaactgcacttaacgatatgggcaaagtgcggaaggacatacagcagtgggaaccatcaagggggtggaatgattggacccaggtacccttctgcagccaccactttcatgagctggttatgaaggacggacgagtgctcgtcgtgccttgtcgtaaccaagatgagctgatcggtagagcgcgcatttcccagggcgccgggtggagtttgaaagaaacggcttgcttaggaaagtcttatgcccagatgtggacactgatgtacttccaccggagggacctcagacttgcagctaacgccatctgtagcgcagtgccatcccattgggtcccgacctcacgcactacatggagtattcacgccaaacacgagtggatgaccactgaagatatgctggcggtttggaatcgggtgtggatccaggagaacccctggatggaagacaagacccctgtagagtcttgggaggaagtgccatatctaggcaaaagggaggaccaatggtgcggtagcctgatagggctcacatcccgagctacgtgggccaagaatatccagaccgcaattaaccaggtcagatcattgatcggaaatgaagagtacactgattatatgcccagcatgaagcggtttaggcgcgaagaggaggaagccggcgtgctgtgg

SEQ ID NO: 14999 - RNA, 9873 nt, synthetic construct
  misc_feature 1..9873: note = derived and/or modified CDS sequence (opt3) from DENV-2__HQ012533__SS-prME
  source 1..9873: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcgccatcatggcagccattttggcttacacaatcggcaccacgcactttcagcgcgcactcattttcatcctgctgactgccgttgctccatccatgacaatgagatgcatagggatttctaacagggattttgtggaaggagtctcgggtggctcatgggtggacatcgtactcgagcacgggagctgtgttaccactatggccaagaataagcccacattagatttcgaactgattaaaaccgaggcgaagcagcctgcaacgcttcggaaatattgcatcgaagccaagttgaccaacacaactaccgagagtcgctgtccaacacaaggagagccctccctgaatgaagagcaggacaaacgatttatctgcaagcattctatggtggatagaggctggggtaacgggtgtggactattcggcaagggcgggattgtcacttgcgctatgtttacctgcaaaaagaatatggaaggaaaagtggtgctccctgagaacctggaatacacaatagtcatcaccccacacagcggtgaggagcatgccgttggcaatgacactgggaagcacggagaagagattaaaatcacgccgcagtcctcaataacagaagcagagcttaccggctatggtactgtgaccatggaatgtagtcccaggacagggctggatttcaacgagatggtattgctccagatggaggaaaaggcttggctggtgcaccggcaatggtttttagacctgcctctcccatggcttcccggcgccgatacccagggaagcaattggattcagaaagagactctggtcacattcaagaaccctcatgcgaagaaacaggacgtggttgtgttgggctctcaagaaggggccatgcacacggcactaaccggagctactgagatccagatgtcctcaggtaatctgctctttacaggccatctgaagtgccgtcttcgcatggacaaactgcagttgaaggggatgagctacagtatgtgtaccggaaaattcaagatcgtcaaggagattgccgaaacacaacacggcactatcgtgattagagtacagtatgagggtgatgggtctccatgcaaaatacccttcgaaatcatggacctcgagaagaggcatgttctgggccggttaattaccgtgaacccgatcgtcacggaaaaagattcccctgtgaacatcgaggctgagcccccatttggagacagctacattataatcggcgtcgaacctgggcagctgaagctaaattggttcaaaaagggatcgtctattggtcagatgtttgagaccacaatgcgaggcgccaagcgcatggcaatcctcggggatactgcctgggacttcggatccctgggcggtgtgtttacctcaattgggaaagctcttcaccaagttttcggcgcgatctacggagcagcctttagtggcgtgagctggacaatgaagatattgatcggggtaattatcacttggattggaatgaactccagatctaccagcctgtcagtcagtctcgtgctggttggcgtggtcacgctttatctgggtgctatggtgcaggccgattccgggtgtgtagtgagctggaaaaataaggaattgaaatgcggatctggcatcttcataacagacaacgttcacacctggactgagcagtacaagtttcagcccgaatcaccaagtaagctcgcaagcgccattcaaaaagctcatgaggagggtatctgtggcattaggtccgtcacacggctggaaaatttaatgtggaagcagatcacccccgagctgaaccacatactatctgaaaatgaggtgaaactcactatcatgaccggggatattaagggaatcatgcaggccggcaaacgctcgctgagacctcagccaacagaacttaagtatagctggaaaacgtgggggaaggcaaagatgttgtccaccgagtcacataaccaaactttcctgattgacggaccggagacagcggaatgccccaataccaacagggcttggaatagtctcgaggtggaagattacggctttggtgtcttcacaactaacatctggctgaaattacgtgagaagcaggacgttttttgtgactctaaactgatgagcgccgcaataaaggataatcgggccgtgcacgctgacatggggtattggattgagtccgcccttaacgatacctggaaaatggaaaaggcatcattcatcgaggtgaagagctgccactggcctaaatctcatacgttgtggtccaatggagtactcgaaagtgagatgatcattccaaagaacttcgctggccccgtcagccagcacaactaccgacctggttatcatacacagaccgccggcccatggcacctggggaaactagaaatggactttgatttctgtgagggaactaccgtggttgtgacagaggactgcggcaatagagggccctctctgaggactaccacagcgtccggaaagctcatcacggaatggtgctgtcgctcatgcaccctgccgcctcttcggtacagaggcgaggatggttgttggtacgggatggaaattaggccattgaaagagaaggaagagaacctggtcaatagtttagtgactgccggacatggccaaatagacaactttagcctcggtgttctgggcatggctcttttcctggaggaaatgttgcgcacacgagtggggaccaagcacgcaatcctcctggtagccgtctcgtttgtgactctaattacaggaaatatgtccttccgggatctgggccgtgtgatggtcatggttggggtgaccatgacggacgatatcggaatgggcgtaacttatctcgctctgcttgccgcatttaaagtgagacccaccttcgcggccggtttgctgttaaggaagctcacatctaaagagctgatgatggctaccattgggatcgcccttctgagccagtcaactatacctgaaacaatcctagagctcaccgacgcactggctttgggaatgatggtcctgaagattgtgcgcaacatggaaaaataccagttagccgttacaatcatggcaattagttgcgtgcccaatgccgtcatcctcctgaacgcttggaaggtgtcctgtactatacttgcggccgtttctgtgagcccactgttgctcacctcctcacaacagaagacggattggattcctctggcactaacaatcaaaggcctgaatcccaccgctatctttcttactaccctcagccggacaagtaagaaaagatcttggccactgaacgaggccgtcatggccgtaggcatggtgtccattttggctagctcgctgttaaagaatgacataccgatgactgggcctctcgttgcaggaggtctgcttaccgtgtgctatgtcctgacgggcaggtcagccgacttggagctcgaacgagcggctgatgtgaaatgggaggaccaggccgaaatctctgggagttcccccattctgagcatcacaatttctgaggatggaagcatgtccatcaagaacgaggaagaggaacagaccctaactatactgatccgcacaggccttctcgtaatttcaggtgtgttcccagtcagtatccccattaccgcagccgcttggtacctgtgggaggttaaaaagcaacgggcaggggtgttgtgggacgtgcctagcccaccccctgtcggaaaggccgaattagaggatggcgcgtatagaatcaaacagaggggcatactggggtactctcagattggagctggtgtgtataaggagggcacttttcacacaatgtggcatgttacccgtggggccgtactcatgcaccgcggaaaacggatcgaaccgtcctgggcagacgtgaagaaagatctgatctcatacggcggtgggtggaagcttgagggagaatggaaggagggcgaagaggtccaggtgctggccttggagccaggcaaaaatcccagagctgttcaaacgaagcctgggctattcaaaactaacaccggaacaattggtgccgtgagtctggactttagcccaggcacctccgggtctcccatcgtcgataggaagggaaaagtggtaggcctctacggtaatggggtcgtgacacgatcgggagcatatgttagcgctatagcccagactgaaaagtcaattgaggacaaccctgaaatcgaggatgacattttccggaagaaacgcctgaccatcatggatcttcatccgggcgcgggcaagacgaaaagatacttacccgccatagtgagggaagcaattaagcgggggctgcgaacactcatcttggctccaactagagtcgtggccgctgagatggaggaagcactgcgcggactccctatcaggtatcagacccccgccattcgtgccgagcacacaggtcgggaaatcgttgacctgatgtgtcatgctaccttcactatgagacttctgtccccagtgagggtccctaactacaatttgattataatggacgaggcgcactttaccgatcccgcaagtatcgccgctcgcggctatatttctacacgagtggagatgggggaagccgcaggaatcttcatgacggccactccaccgggcagcagagacccttttccccagtccaacgctccaatcatggatgaggaacgggagattcccgaaaggtcatggaattctggtcacgagtgggtaaccgacttcaaagggaagacagtgtggtttgttcctagcataaaggcgggaaacgatatcgccgcatgcctacgcaaaaatggcaagaaagtcattcaactgagtcgtaagaccttcgactccgagtacgtgaaaactagagctaacgattgggactttgtggtcacaaccgatatcagcgaaatgggcgccaatttccgggcagagagggtaattgacccacgccgatgtatgaagcccgtgatcctcacggatggggaagagagagttatattagccggacctatgccggtgactcattcttcagctgcccagcggaggggtcgcatcggcagaaacccaaagaatgaaaacgaccagtatatttacatgggggagcccctggagaatgacgaagattgcgcgcactggaaagaggcaaagatgcttctggacaacatcaatacacctgaaggaattatcccctccatgtttgagccagaaagggagaaagtcgatgccatagacggcgagtaccggctccgtggtgaagctcgcaagaccttcgtggatttgatgcgaagaggggacctgcctgtttggctcgcctatagggtggctgcagagggcattaactacgccgatcggcgctggtgttttgacggaatcaaaaataaccaaattctggaagagaacgtcgaggtggaaatctggaccaaggagggcgaaagaaaaaagcttaagcccaggtggctagatgctcggatatatagtgacccactggccttgaaagagttcaaggaattcgcagcggggcgaaaaagcttaactctgaatctcatcacagagatgggaagactgcctacctttatgacacagaaggcccgcgatgctcttgacaacctggccgtactccatactgcagaggctggtggcagggcctacaatcacgcattgtcggaactgccggagacgctagaaaccctgctccttctgacattattggccactgtgaccgggggaattttcctgtttctcatgtctggcaaaggtatcgggaagatgacactgggcatgtgctgcattatcaccgcttccatacttctgtggtatgcgcagattcagccccactggatcgccgcaagcatcattctcgagttctttttgatcgttctgttaataccagaacctgagaagcaacggactccccaggataaccagctaacgtacgtcgtgattgctatcctgaccgtggtcgccgccacaatggcaaatgagatgggattcctcgaaaaaactaagaaagaccttggcctggggtcaattaccacacaggagagtgaatctaacatcttggacatagatctgcgtccagcttccgcctggaccctctatgcggttgctactacatttgtgacgcctatgctgagacatagcatcgagaattcaagtgtaaacgtgagccttaccgccattgcaaatcaagccactgtcctcatgggactgggtaagggctggcccttgtccaaaatggacatcggggtgccgctgttagctattggatgttactctcaggttaacccaatcacactaaccgcagccctgctccttctggtggcgcactacgctattatcggccctggtttgcaggccaaggcaaccagggaagcccagaagcgcgctgccgcagggataatgaaaaatcccacagtcgatggcattactgtaatcgacctggagccaatcccctatgatcctaagttcgagaaacaactcggacaggtgatgctgcttattttatgcgttacgcaggtgctgatgatgcggaccacatgggctctctgtgaagccttgactctggcgaccggcccgataagcacactatgggaggggaaccccggacgattttggaataccactatcgccgtctccatggcaaacattttcagaggctcatacctggctggtgccgggctccttttttctatcatgaagaatacgacaaacaccaggcgcggaactggcaatattggtgaaaccctgggcgagaaatggaagagtcggttgaacgcactggggaagtcggagttccagatctataaaaagagcggaatacaagaagtggacagaacactcgctaaagagggcatcaagcgtggggaaactgatcatcacgccgtctccaggggatctgccaaactgcggtggtttgtggagcgcaacatggttaccccagaaggcaaggtggtagacttaggttgcgggcgaggaggctggtcatactattgtggtggccttaaaaatgtgagagaggtcaaggggctgacaaagggaggccctgggcatgaggaacccattcctatgagcacgtacggatggaacctcgttaggctacagtccggcgtggatgtcttcttcaccccacccgagaaatgcgacactctgttgtgtgatatcggtgaaagttctcctaatccaacaattgaggcggggcggaccctgcgcgtgctcaaccttgtagaaaattggctgaacaataacactcagttttgcatcaaggtgttgaatccctatatgccgagcgttatagagaaaatggagacactgcaaagaaagtacggaggcgctctcgtgaggaaccctttatcacgaaattccacccacgaaatgtactgggtcagtaacgcaacgggcaatattgtgagctctgtcaacatgatctcccggatgctgatcaatcgtttcaccatgaaacacaagaaggccacatatgagccagacgtggatcttgggtcaggaactagaaacattggtatagaaagcgagatccccaacctggacattatcggcaaacgcattgaaaagatcaaacaggagcatgagacctcgtggcactacgaccaggatcatccttataagacatgggcttaccacgggtcttatgaaactaaacagaccggaagtgcctccagcatggttaatggcgtagtgaggctactcacaaagccatgggacgtcgtgcccatggttacccaaatggcaatgactgatacgacaccgtttggtcagcagcgggtgttcaaggagaaagtcgacaccagaactcaggaacctaaggaggggaccaaaaagctgatgcgcataacagccgagtggttgtggaaagaactgggaaagaagaaaacgcccaggatgtgtacccgagaggaatttactcggaaggtgagatcaaacgctgcgctcggcgccatcttcacagatgagaataaatggaagtccgcaagggaagctgtagaggactctcgcttttgggagcttgtggatcgtgaacggaacctgcacttagagggcaaatgcgaaacctgtgtttacaatatgatggggaagagagagaaaaagctgggagaattcggtaaggccaaaggcagcagggcaatttggtatatgtggttgggggcccgctttctcgagttcgaggctctgggatttctaaacgaagaccattggttcagtcgaggcaattcccttagcggtgtcgagggggaaggactgcaccggctcggctacatcctgagagatgtgtctaagaaagagggcggggccatgtacgcggacgatactgcaggatgggacacaaggattaccttggaagacctgaagaacgaggagatggtgacaaatcatatgaaaggtgaacacaagaagctcgccgaggctatctttaaacttacttatcaaaacaaggtcgttcgcgtgcagagaccaacccctcggggcacggtaatggatattatatcaaggcgtgaccagcgagggagtggacaggtgggcacctacggtctgaatacattcactaacatggaagcccaattaatccgccagatggagggggagggaattttcaaatccatccagcatctgaccgtcacagaagagatcgcagtgcaaaattggttggctagagttggccgggaaaggctcagccgcatggccatttctggcgatgactgcgtggtcaagcccctggatgacagatttgcttcggccctaactgcacttaacgatatggggaaagtgcggaaggacatacagcagtgggagccatcaaggggatggaatgattggacccaggtacccttctgcagccaccactttcatgaactggttatgaaggacggtcgagtgctcgtcgtgccttgtcgtaaccaagatgagctgatcggcagagcgcgcatttcccagggggccggatggagtttgaaagagacggcttgcttaggcaagtcttatgcccagatgtggacactgatgtacttccaccggagggacctcagacttgcagctaacgccatctgtagcgcagtgccatcccattgggtcccgacctcacgcactacatggagtattcacgccaaacacgaatggatgaccactgaggatatgctggcggtttggaatcgggtgtggatccaggaaaacccctggatggaggacaagacccctgtagaatcttgggaggaggtgccatatctaggtaaaagggaagaccaatggtgcgggagcctgataggactcacatcccgagctacgtgggccaagaatatccagaccgcaattaaccaggtcagatcattgatcggcaatgaggaatacactgattatatgcccagcatgaagcggtttaggcgcgaggaagaggaggccggcgtgctgtgg

SEQ ID NO: 15000 - RNA, 9873 nt, synthetic construct
  misc_feature 1..9873: note = derived and/or modified CDS sequence (opt3) from DENV-2__HQ012534__SS-prME
  source 1..9873: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcgccatcatggcagccattttggcttacacaatcggcaccacgcactttcagcgcgcactcattttcatcctgctgactgccgttgctccatccatgacaatgagatgcatagggatttctaacagggattttgtggaaggagtctcgggtggctcatgggtggacatcgtactcgagcacgggagctgtgttaccactatggccaagaataagcccacattagatttcgaactgattaaaaccgaggcgaagcagcctgcaacgcttcggaaatattgcatcgaagccaagttgaccaacacaactaccgagagtcgctgtccaacacaaggagagccctccctgaatgaagagcaggacaaacgatttatctgcaagcattctatggtggatagaggctggggtaacgggtgtggactattcggcaagggcgggattgtcacttgcgctatgtttacctgcaaaaagaatatggaaggaaaagtggtgctccctgagaacctggaatacacaatagtcatcaccccacacagcggtgaggagcatgccgttggcaatgacactgggaagcacggagaagagattaaaatcacgccgcagtcctcaataacagaagcagagcttaccggctatggtactgtgaccatggaatgtagtcccaggacagggctggatttcaacgagatggtattgctccagatggaggaaaaggcttggctggtgcaccggcaatggtttttagacctgcctctcccatggcttcccggcgccgatacccagggaagcaattggattcagaaagagactctggtcacattcaagaaccctcatgcgaagaaacaggacgtggttgtgttgggctctcaagaaggggccatgcacacggcactaaccggagctactgagatccagatgtcctcaggtaatctgctctttacaggccatctgaagtgccgtcttcgcatggacaaactgcagttgaaggggatgagctacagtatgtgtaccggaaaattcaagatcgtcaaggagattgccgaaacacaacacggcactatcgtgattagagtacagtatgagggtgatgggtctccatgcaaaatacccttcgaaatcatggacctcgagaagaggcatgttctgggccggttaattaccgtgaacccgatcgtcacggaaaaagattcccctgtgaacatcgaggctgagcccccatttggagacagctacattataatcggcgtcgaacctgggcagctgaagctaaattggttcaaaaagggatcgtctattggtcagatgtttgagaccacaatgcgaggcgccaagcgcatggcaatcctcggggatactgcctgggacttcggatccctgggcggtgtgtttacctcaattgggaaagctcttcaccaagttttcggcgcgatctacggagcagcctttagtggcgtgagctggacaatgaagatattgatcggggtaattatcacttggattggaatgaactccagatctaccagcctgtcagtcagtctcgtgctggttggcgtggtcacgctttatctgggtgctatggtgcaggccgattccgggtgtgtagtgagctggaaaaataaggaattgaaatgcggatctggcatcttcataacagacaacgttcacacctggactgagcagtacaagtttcagcccgaatcaccaagtaagctcgcaagcgccattcaaaaagctcatgaggagggtatctgtggcattaggtccgtcacacggctggaaaatttaatgtggaagcagatcacccccgagctgaaccacatactatctgaaaatgaggtgaaactcactatcatgaccggggatattaagggaatcatgcaggccggcaaacgctcgctgagacctcagccaacagaacttaagtatagctggaaaacgtgggggaaggcaaagatgttgtccaccgagtcacataaccaaactttcctgattgacggaccggagacagcggaatgccccaataccaacagggcttggaatagtctcgaggtggaagattacggctttggtgtcttcacaactaacatctggctgaaattacgtgagaagcaggacgttttttgtgactctaaactgatgagcgccgcaataaaggataatcgggccgtgcacgctgacatggggtattggattgagtccgcccttaacgatacctggaaaatggaaaaggcatcattcatcgaggtgaagagctgccactggcctaaatctcatacgttgtggtccaatggagtactcgaaagtgagatgatcattccaaagaacttcgctggccccgtcagccagcacaactaccgacctggttatcatacacagaccgccggcccatggcacctggggaaactagaaatggactttgatttctgtgagggaactaccgtggttgtgacagaggactgcggcaatagagggccctctctgaggactaccacagcgtccggaaagctcatcacggaatggtgctgtcgctcatgcaccctgccgcctcttcggtacagaggcgaggatggttgttggtacgggatggaaattaggccattgaaagagaaggaagagaacctggtcaatagtttagtgactgccggacatggccaaatagacaactttagcctcggtgttctgggcatggctcttttcctggaggaaatgttgcgcacacgagtggggaccaagcacgcaatcctcctggtagccgtctcgtttgtgactctaattacaggaaatatgtccttccgggatctgggccgtgtgatggtcatgctcggggttcccatgaccgacgatatcggaatgggcgtgacgtatctggctcttttggccgcatttaaagtaagacctactttcgcggccggtctgttactcaggaagctgacctctaaagagcttatgatggctacaattgggatcgccctgctaagccagtcaaccatacccgaaactatcctcgagctgacagacgcattggctctgggaatgatggtgttaaagattgtccgcaacatggaaaaataccagctcgccgtgaccatcatggcaattagttgcgttccaaatgccgtgatcctgcttaacgcttggaaggtctcctgtacaatactggcggccgtgtctgttagccctttgctcctgacttcctcacaacagaagaccgattggattcccctagcactgacgatcaaaggccttaatccaacagctatctttctcaccactctgagccggaccagtaagaaaagatcttggccgttgaacgaggccgtgatggccgtcggcatggtatccattctggctagctcgttactcaagaatgacatacctatgacagggcccctggtggcaggaggtcttctgactgtttgctatgtgttgaccggcaggtcagccgacctcgagctggaacgagcggctgatgtcaaatgggaggaccaggccgaaatctctgggagttccccaattctaagcatcacgatttctgaggatggaagcatgtccatcaagaacgaggaagaggaacagacactgaccatacttatccgcactggcctcctggtgatttcaggtgtattccccgtgagtatccctattacagcagccgcttggtacttgtgggaggtcaaaaagcaacgggcaggggttttatgggacgtgccaagcccccctccggtgggaaaggccgaactggaggatggcgcgtatagaatcaaacagaggggcatactcgggtactctcagattggagctggtgtctataaggagggcacctttcacactatgtggcatgtgacacgtggggccgttctgatgcaccgcggaaaacggatcgaaccatcctgggcagacgtaaagaaagatcttatctcatacggcggtgggtggaagctggagggagaatggaaggagggcgaagaggtgcaggtcttggccctagagcccggcaaaaatcctagagctgtgcaaaccaagccagggctgttcaaaacgaacactggaaccattggtgccgttagtctcgactttagccccggcacatccgggtctcctatcgtggataggaagggaaaagtcgtgggcctgtacggtaatggggtagtcacccgatcgggagcatatgtgagcgctatagcccagacagaaaagtcaattgaggacaacccggaaatcgaggatgacattttccggaagaaacgccttactatcatggatttacatcccggcgcgggcaagaccaaaagatacctgccagccatagttagggaagcaattaagcgggggctccgaacgttgatcctggctcctacaagagtggtcgccgctgagatggaggaagcactccgcggactgcccatcaggtatcagactccagccattcgtgccgagcacaccggtcgggaaatcgtggaccttatgtgtcatgctacattcaccatgagactgttgtcccctgttagggtgcccaactacaatctaattataatggacgaggcgcactttactgatccagcaagtatcgccgctcgcggctatatttctacccgagtcgagatgggggaagccgcaggaatcttcatgacagccacgccgcctggcagcagagacccctttccacagtccaacgctcccatcatggatgaggaacgggagattcctgaaaggtcatggaattctggtcacgagtgggtgactgacttcaaagggaagaccgtatggtttgtgccaagcataaaggcgggaaacgatatcgccgcatgcctgcgcaaaaatggcaagaaagttattcaactcagtcgtaagacattcgactccgagtacgtcaaaaccagagctaacgattgggactttgtggtgactacagatatcagcgaaatgggcgccaatttccgggcagagagggtcattgacccccgccgatgtatgaagcctgtaatcttaaccgatggggaagagagagtgatactggccggaccgatgccagttacgcattcttcagctgcccagcggaggggtcgcatcggcagaaaccccaagaatgaaaacgaccagtatatttacatgggggagcctcttgagaatgacgaagattgcgcgcactggaaagaggcaaagatgctgctcgacaacatcaatactcccgaaggaattatcccatccatgtttgagcctgaaagggagaaagtggatgccatagacggcgagtaccggttgcgtggtgaagctcgcaagacattcgtcgatctgatgcgaagaggggacctccccgtgtggctggcctatagggttgctgcagagggcattaactacgccgatcggcgctggtgttttgacggaatcaaaaataaccaaattcttgaagagaacgtggaggtcgaaatctggaccaaggagggcgaaagaaaaaagctaaagccaaggtggctggatgctcggatatatagtgaccctttggccttaaaagagttcaaggaattcgcagcggggcgaaaaagcctgaccctcaatctgatcactgagatgggaagacttccgacatttatgacccagaaggcccgcgatgctctggacaacctcgccgtgttgcatacagcagaggctggtggcagggcctacaatcacgcactgtcggaactacccgagactctggaaacgctccttctgttaaccttgctggccacagtaactgggggaattttcctctttctgatgtctggcaaaggtatcgggaagatgacccttggcatgtgctgcattatcacagcttccatactgctctggtatgcgcagattcagccacactggatcgccgcaagcatcattttggagttctttctgatcgtgttactaatacctgaacccgagaagcaacggaccccacaggataaccagctgacttacgttgtcattgctatcctcacggtggtggccgccaccatggcaaatgagatgggattccttgaaaaaacaaagaaagacctgggcttggggtcaattactacccaggagagtgaatctaacatcctggacatagatctccgtcctgcttccgcctggacactgtatgcggtcgctaccacttttgttacacccatgcttagacatagcatcgagaattcaagtgtgaacgtaagcctcacggccattgcaaatcaagccaccgtgctgatgggattgggtaagggctggccgctgtccaaaatggacatcggggtcccattactagctattggatgttactctcaggtgaaccctatcactctgacagcagccctccttctgttggttgcgcactacgctattatcggccccggtctgcaggccaaggcaaccagggaagcccagaagcgcgctgccgcagggataatgaaaaatccaaccgtggatggcattacagtcatcgacctcgagcccatcccttatgatccgaagttcgagaaacaactgggacaggtaatgcttttaattctgtgcgtgactcaggttctcatgatgcggacgacctgggctttgtgtgaagccctgacactagcgactggccccataagcaccctgtgggaggggaacccaggacgattttggaatacaaccatcgccgtgtccatggcaaacattttcagaggctcatacctcgctggtgccgggcttctgttttctatcatgaagaatactacgaacacaaggcgcggaaccggcaatattggtgaaactttgggcgagaaatggaagagtcggctgaacgcactcgggaagtcggagttccagatctataaaaagagcggaatacaagaagtcgacagaaccctggctaaagagggcatcaagcgtggggaaacagatcatcacgccgtgtccaggggatctgccaaattacggtggtttgtcgagcgcaacatggtgactcctgaaggcaaggttgtggaccttggttgcgggcgaggaggctggtcatactattgtggtggcctgaaaaatgtaagagaggtgaaggggctcaccaagggaggccccgggcatgaggaacctattccaatgagcacatacggatggaacctagtcaggctgcagtccggcgttgatgtgttcttcacgccccctgagaaatgcgacaccttgctgtgtgatatcggtgaaagttctccaaatcccactattgaggcggggcggacactccgcgtccttaacctggtggaaaattggttgaacaataacacccagttttgcatcaaggtactgaatccgtatatgcctagcgtgatagagaaaatggagactctccaaagaaagtacggaggcgctttagttaggaacccactgtcacgaaattccacacacgaaatgtactgggtgagtaacgcaaccggcaatattgtcagctctgtgaacatgatctcccggatgcttatcaatcgtttcacgatgaaacacaagaaggccacctatgagcccgacgtcgatctggggtcaggaacaagaaacattggtatagaaagcgagatccctaacctagacattatcggcaaacgcattgaaaagatcaaacaggagcatgagacttcgtggcactacgaccaggatcatccatataagacctgggcttaccacgggtcttatgaaacaaaacagactggaagtgcctccagcatggtgaatggcgttgtaaggctcctgaccaagccctgggacgtggtcccgatggtgacacaaatggcaatgaccgatactacgccttttggtcagcagcgggttttcaaggagaaagtggacacaagaacccaggaacccaaggaggggactaaaaagttgatgcgcataaccgccgagtggctgtggaaagaactcggaaagaagaaaacaccaaggatgtgtacgcgagaggaatttacccggaaggtcagatcaaacgctgcgcttggcgccatcttcactgatgagaataaatggaagtccgcaagggaagctgtggaggactctcgcttttgggagctggtagatcgtgaacggaacttacacctggagggcaaatgcgaaacatgtgtgtacaatatgatggggaagagagagaaaaagttgggagaattcggtaaggccaaaggcagcagggcaatttggtatatgtggctcggggcccgctttctggagttcgaggctctaggatttcttaacgaagaccattggttcagtcgaggcaattccctgagcggtgttgagggggaaggactccaccggctgggctacatcttgagagatgtctctaagaaagagggcggggccatgtacgcggacgataccgcaggatgggacactaggattacactggaagacctcaagaacgaggagatggtgaccaatcatatgaaaggtgaacacaagaagcttgccgaggctatctttaaactgacatatcaaaacaaggtggtccgcgttcagagacctactccccggggcaccgtgatggatattatatcaaggcgtgaccagcgagggagtggacaggtaggcacgtacggtttaaataccttcacaaacatggaagcccaactgatccgccagatggagggggagggaattttcaaatccatccagcatttgactgtgaccgaagagatcgcagtccaaaattggctcgctagagtgggccgggaaaggctgagccgcatggccatttctggcgatgactgcgttgtgaagccactagatgacagatttgcttcggcccttacagcactgaacgatatggggaaagtccggaaggacatacagcagtgggagccctcaaggggatggaatgattggactcaggtgcctttctgcagccaccactttcatgaactcgtaatgaaggacggtcgagttctggtggtcccatgtcgtaaccaagatgagttgatcggcagagcgcgcatttcccagggggccggatggagtttaaaagagaccgcttgcctgggcaagtcttatgcccagatgtggacgctcatgtacttccaccggagggaccttagactggcagctaacgccatctgtagcgcagtgccgtcccattgggtgcccacatcacgcaccacttggagtattcacgccaaacacgaatggatgacaaccgaggatatgctagcggtctggaatcgggtttggatccaggaaaacccttggatggaggacaagactccagtggaatcttgggaggaggtaccctatctgggtaaaagggaagaccaatggtgcgggagcctcataggattgacctcccgagctacatgggccaagaatatccagacggcaattaaccaggtgagatcactgatcggcaatgaggaatacaccgattatatgcctagcatgaagcggtttaggcgcgaggaagaggaggccggcgtcctttgg

SEQ ID NO: 15001 - RNA, 9873 nt, synthetic construct
  misc_feature 1..9873: note = derived and/or modified CDS sequence (opt3) from DENV-2__HQ012535__SS-prME
  source 1..9873: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcgccatcatggcagccattttggcttacacaatcggcaccacgcactttcagcgcgcactcattttcatcctgctgactgccgttgctccatccatgacaatgagatgcatagggatttctaacagggattttgtggaaggagtctcgggtggctcatgggtggacatcgtactcgagcacgggagctgtgttaccactatggccaagaataagcccacattagatttcgaactgattaaaaccgaggcgaagcagcctgcaacgcttcggaaatattgcatcgaagccaagttgaccaacacaactaccgagagtcgctgtccaacacaaggagagccctccctgaatgaagagcaggacaaacgatttatctgcaagcattctatggtggatagaggctggggtaacgggtgtggactattcggcaagggcgggattgtcacttgcgctatgtttacctgcaaaaagaatatggaaggaaaagtggtgctccctgagaacctggaatacacaatagtcatcaccccacacagcggtgaggagcatgccgttggcaatgacactgggaagcacggagaagagattaaaatcacgccgcagtcctcaataacagaagcagagcttaccggctatggtactgtgaccatggaatgtagtcccaggacagggctggatttcaacgagatggtattgctccagatggaggaaaaggcttggctggtgcaccggcaatggtttttagacctgcctctcccatggcttcccggcgccgatacccagggaagcaattggattcagaaagagactctggtcacattcaagaaccctcatgcgaagaaacaggacgtggttgtgttgggctctcaagaaggggccatgcacacggcactaaccggagctactgagatccagatgtcctcaggtaatctgctctttacaggccatctgaagtgccgtcttcgcatggacaaactgcagttgaaggggatgagctacagtatgtgtaccggaaaattcaagatcgtcaaggagattgccgaaacacaacacggcactatcgtgattagagtacagtatgagggtgatgggtctccatgcaaaatacccttcgaaatcatggacctcgagaagaggcatgttctgggccggttaattaccgtgaacccgatcgtcacggaaaaagattcccctgtgaacatcgaggctgagcccccatttggagacagctacattataatcggcgtcgaacctgggcagctgaagctaaattggttcaaaaagggatcgtctattggtcagatgtttgagaccacaatgcgaggcgccaagcgcatggcaatcctcggggatactgcctgggacttcggatccctgggcggtgtgtttacctcaattgggaaagctcttcaccaagttttcggcgcgatctacggagcagcctttagtggcgtgagctggacaatgaagatattgatcggggtaattatcacttggattggaatgaactccagatctaccagcctgtcagtcagtctcgtgctggttggcgtggtcacgctttatctgggtgctatggtgcaggccgattccgggtgtgtagtgagctggaaaaataaggaattgaaatgcggatctggcatcttcataacagacaacgttcacacctggactgagcagtacaagtttcagcccgaatcaccaagtaagctcgcaagcgccattcaaaaagctcatgaggagggtatctgtggcattaggtccgtcacacggctggaaaatttaatgtggaagcagatcacccccgagctgaaccacatactatctgaaaatgaggtgaaactcactatcatgaccggggatattaagggaatcatgcaggccggcaaacgctcgctgagacctcagccaacagaacttaagtatagctggaaaacgtgggggaaggcaaagatgttgtccaccgagtcacataaccaaactttcctgattgacggaccggagacagcggaatgccccaataccaacagggcttggaatagtctcgaggtggaagattacggctttggtgtcttcacaactaacatctggctgaaattacgtgagaagcaggacgttttttgtgactctaaactgatgagcgccgcaataaaggataatcgggccgtgcacgctgacatggggtattggattgagtccgcccttaacgatacctggaaaatggaaaaggcatcattcatcgaggtgaagagctgccactggcctaaatctcatacgttgtggtccaatggagtactcgaaagtgagatgatcattccaaagaacttcgctggccccgtcagccagcacaactaccgacctggttatcatacacagaccgccggcccatggcacctggggaaactagaaatggactttgatttctgtgagggaactaccgtggttgtgacagaggactgcggcaatagagggccctctctgaggactaccacagcgtccggaaagctcatcacggaatggtgctgtcgctcatgcaccctgccgcctcttcggtacagaggcgaggatggttgttggtacgggatggaaattaggccattgaaagagaaggaagagaacctggtcaatagtttagtgactgccggacatggccaaatagacaactttagcctcggtgttctgggcatggctcttttcctggaggaaatgttgcgcacacgagtggggaccaagcacgcaatcctcctggtagccgtctcgtttgtgactctaattacaggaaatatgtccttccgggatctgggccgtgtgatggtcatggttggggtgaccatgacggacgatatcggaatgggcgtaacttatctcgctctgcttgccgcatttaaagtgagacccaccttcgcggccggtttgctgttaaggaagctcacatctaaagagctgatgatggctaccattgggatcgcccttctgagccagtcaactatacctgaaacaatcctagagctcaccgacgcactggctttgggaatgatggtcctgaagattgtgcgcaacatggaaaaataccagttagccgttacaatcatggcaattagttgcgtgcccaatgccgtcatcctcctgaacgcttggaaggtgtcctgtactatacttgcggccgtttctgtgagcccactgttgctcacctcctcacaacagaagacggattggattcctctggcactaacaatcaaaggcctgaatcccaccgctatctttcttactaccctcagccggacaagtaagaaaagatcttggccactgaacgaggccgtcatggccgtaggcatggtgtccattttggctagctcgctgttaaagaatgacataccgatgactgggcctctcgttgcaggaggtctgcttaccgtgtgctatgtcctgacgggcaggtcagccgacttggagctcgaacgagcggctgatgtgaaatgggaggaccaggccgaaatctctgggagttcccccattctgagcatcacaatttctgaggatggaagcatgtccatcaagaacgaggaagaggaacagaccctaactatactgatccgcacaggccttctcgtaatttcaggtgtgttcccagtcagtatccccattaccgcagccgcttggtacctgtgggaggttaaaaagcaacgggcaggggtgttgtgggacgtgcctagcccaccccctgtcgaaaaggccgagttagaggatggagcgtatagaatcaaacagaggggcatactgggctactctcagattggggctggagtgtataaggaaggtacttttcacacaatgtggcatgttacccgtggcgccgtactcatgcaccgcgggaaacggatcgagccgtcctgggcagacgtgaagaaagatctgatctcatacggaggcggttggaagcttgaaggggagtggaaggaaggagaggaggtccaggtgctggccttggaaccaggcaaaaatcccagagctgttcaaacgaagcctggcctattcaaaactaacaccgggacaattggagccgtgagtctggactttagcccaggtacctccggctctcccatcgtcgataggaaggggaaagtggtaggactctacggcaatggtgtcgtgacacgatcgggggcatatgttagcgctatagcccagactgagaagtcaattgaagacaaccctgagatcgaagatgacattttccggaagaaacgcctgaccatcatggatcttcatccgggagcgggcaagacgaaaagatacttacccgccatagtgagggaggcaattaagcggggcctgcgaacactcatcttggctccaactagagtcgtggccgctgagatggaagaggcactgcgcgggctccctatcaggtatcagacccccgccattcgtgccgaacacacaggacgggagatcgttgacctgatgtgtcatgctaccttcactatgagacttctgtccccagtgagggtccctaactacaatttgattataatggacgaggcgcactttaccgatcccgcaagtatcgccgctcgcggttatatttctacacgagtggaaatgggcgaggccgcagggatcttcatgacggccactccaccgggaagcagagacccttttccccagtccaacgctccaatcatggatgaagagcgggaaattcccgagaggtcatggaattctggccacgagtgggtaaccgacttcaaaggtaagacagtgtggtttgttcctagcataaaggcggggaacgatatcgccgcatgcctacgcaaaaatggaaagaaagtcattcaactgagtcgtaagaccttcgactccgaatacgtgaaaactagagctaacgattgggactttgtggtcacaaccgatatcagcgagatgggcgccaatttccgggcagaaagggtaattgacccacgccgatgtatgaagcccgtgatcctcacggatggcgaggaaagagttatattagccgggcctatgccggtgactcattcttcagctgcccagcggaggggacgcatcggtagaaacccaaagaatgagaacgaccagtatatttacatgggcgagcccctggaaaatgacgaggattgcgcgcactggaaagaagcaaagatgcttctggacaacatcaatacacctgaggggattatcccctccatgtttgaaccagagagggagaaagtcgatgccatagacggagaataccggctccgtggcgaggctcgcaagaccttcgtggatttgatgcgaagaggtgacctgcctgtttggctcgcctatagggtggctgcagaagggattaactacgccgatcggcgctggtgttttgacggcatcaaaaataaccaaattctggaggagaacgtcgaagtggagatctggaccaaggaaggagagagaaaaaagcttaagcccaggtggctagatgctcggatatatagtgacccactggccttgaaagaattcaaggagttcgcagcgggccgaaaaagcttaactctgaatctcatcacagagatggggagactgcctacctttatgacacagaaggcccgcgatgctcttgacaacctggccgtactccatactgcagaagctggaggtagggcctacaatcacgcattgtcggagctgccggaaacgctagagaccctgctccttctgacattattggccactgtgaccggcgggattttcctgtttctcatgtctggaaaaggcatcggtaagatgacactggggatgtgctgcattatcaccgcttccatacttctgtggtatgcgcagattcagccccactggatcgccgcaagcatcattctcgaattctttttgatcgttctgttaataccagagcctgagaagcaacggactccccaggataaccagctaacgtacgtcgtgattgctatcctgaccgtggtcgccgccacaatggcaaatgaaatgggcttcctcgagaaaactaagaaagaccttggactgggctcaattaccacacaggaaagtgagtctaacatcttggacatagatctgcgtccagcttccgcctggaccctctatgcggttgctactacatttgtgacgcctatgctgagacatagcatcgaaaattcaagtgtaaacgtgagccttaccgccattgcaaatcaagccactgtcctcatggggctgggaaagggttggcccttgtccaaaatggacatcggcgtgccgctgttagctattgggtgttactctcaggttaacccaatcacactaaccgcagccctgctccttctggtggcgcactacgctattatcggacctggcttgcaggccaaggcaaccagggaggcccagaagcgcgctgccgcaggtataatgaaaaatcccacagtcgatgggattactgtaatcgacctggagccaatcccctatgatcctaagttcgaaaaacaactcggccaggtgatgctgcttattttatgcgttacgcaggtgctgatgatgcggaccacatgggctctctgtgaggccttgactctggcgaccggaccgataagcacactatgggaaggcaaccccgggcgattttggaataccactatcgccgtctccatggcaaacattttcagaggatcatacctggctggcgccggtctccttttttctatcatgaagaatacgacaaacaccaggcgcgggactggaaatattggcgagaccctgggtgagaaatggaagagtcggttgaacgcactgggcaagtcggaattccagatctataaaaagagcgggatacaagaggtggacagaacactcgctaaagaaggaatcaagcgtggcgagactgatcatcacgccgtctccagggggtctgccaaactgcggtggtttgtggaacgcaacatggttaccccagagggaaaggtggtagacttaggctgcggtcgagggggatggtcatactattgtggcggtcttaaaaatgtgagagaggtcaagggcctgacaaaggggggacctggccatgaagagcccattcctatgagcacgtacgggtggaacctcgttaggctacagtccggagtggatgtcttcttcaccccacccgaaaaatgcgacactctgttgtgtgatatcggcgagagttctcctaatccaacaattgaagcgggtcggaccctgcgcgtgctcaaccttgctgagaattggctgaacaataacactcagttttgcatcaaggtattgaatccctatatgccgagcgtgatagagaaaatggaaacactgcaaagaaagtacgggggagcactcgttaggaaccctttatcacgaaattccacccacgagatgtactgggtgagtaacgccacgggcaatattgtcagctctgtgaacatgatctcccggatgctgatcaatcgtttcaccatgaaacacaagaaggctacatatgaaccagacgtcgatcttggctcagggactagaaacattggaatagagagcgaaatccccaacctggacattatcggtaaacgcattgagaagatcaaacaggagcatgaaacctcgtggcactacgaccaggatcatccttataagacatgggcctaccacggctcttatgagactaaacagaccgggagtgcatccagcatggtgaatggagttgtaaggctactcacaaagccatgggacgtggtccccatggtgacccaaatggccatgactgatacgacaccgtttggccagcagcgggttttcaaggaaaaagtggacaccagaactcaggagcctaaggagggtaccaaaaagctgatgcgcataacagctgaatggttgtggaaagagctggggaagaagaaaacgcccaggatgtgtacccgagaagagtttactcggaaggtcagatcaaacgcggccctcggagcaatcttcacagatgaaaataaatggaagtccgctagggaggccgtggaggactctcgcttttgggaacttgtagatcgtgagcggaacctgcacttagaaggcaaatgcgagacctgtgtgtacaatatgatgggcaagagagaaaaaaagctgggggagttcggaaaggcaaaaggtagcagggccatttggtatatgtggttgggcgctcgctttctcgagttcgaagccctggggtttctaaacgaggaccattggttcagtcgaggaaattcccttagcggcgttgaaggtgaggggctgcaccggctcggatacatcctgagagatgtctctaagaaagaaggcggcgcgatgtacgcagacgatactgccgggtgggacacaaggattaccttggaggacctgaagaacgaggaaatggtgacaaatcatatgaaaggagagcacaagaagctcgctgaagccatctttaaacttacttatcaaaacaaggtggtccgcgttcagagaccaacccctcggggtacggtgatggatattatatcaaggcgtgaccagcgaggcagtgggcaggtaggaacctacggcctgaatacattcactaacatggaggcacaattaatccgccagatggagggtgaagggattttcaaatccatccagcatctgaccgtgacagaggaaatcgctgtccaaaattggttggccagagtgggacgggagaggctcagccgcatggctatttctggcgatgactgcgttgtgaagcccctggatgacagatttgcctcggcactaactgcgcttaacgatatgggcaaagtccggaaggacatacagcagtgggaaccatcaagggggtggaatgattggacccaggtgcccttctgcagccaccactttcatgagctggtaatgaaggacggacgagttctcgtggtcccttgtcgtaaccaagatgagctgatcggtagagcccgcatttcccagggcgctgggtggagtttgaaagaaacggcctgcttaggaaagtcttatgcacagatgtggacactgatgtacttccaccggagggacctcagacttgctgccaacgcaatctgtagcgccgtgccatcccattgggtgccgacctcacgcactacatggagtattcacgcgaaacacgagtggatgaccactgaagatatgctggctgtctggaatcgggtttggatccaggagaacccctggatggaagacaagacccctgtggagtcttgggaggaagtaccatatctaggcaaaagggaggaccaatggtgcggtagcctgatagggctcacatcccgagccacgtgggcaaagaatatccagaccgccattaaccaggtgagatcattgatcggaaatgaagagtacactgattatatgcccagcatgaagcggtttaggcgcgaagaggaggaagctggcgtcctgtgg

SEQ ID NO: 15002 - RNA, 9873 nt, synthetic construct
  misc_feature 1..9873: note = derived and/or modified CDS sequence (opt3) from DENV-2__HQ012536__SS-prME
  source 1..9873: mol_type = other RNA
accgccggagtgatcattatgctgatacccacagctatggcattccacctcactacgaggaacggggaacctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagttgcgctggtgccccatgtcggtatggggcttgagaccagaacagaaacttggatgagtagcgagggagcttggaaacacgtgcagaggatcgagacctggatactgcggcatcctggcttcgccatcatggcagccattttggcttacacaatcggcaccacgcactttcagcgcgcactcattttcatcctgctgactgccgttgctccatccatgacaatgagatgcatagggatttctaacagggattttgtggaaggagtctcgggtggctcatgggtggacatcgtactcgagcacgggagctgtgttaccactatggccaagaataagcccacattagatttcgaactgattaaaaccgaggcgaagcagcctgcaacgcttcggaaatattgcatcgaagccaagttgaccaacacaactaccgagagtcgctgtccaacacaaggagagccctccctgaatgaggaacaggacaaacgatttatctgcaagcattctatggtggatagaggctggggtaacgggtgtggactattcggcaagggcgggattgtcacttgcgctatgtttacctgcaaaaagaatatggaaggaaaagtggtgctccctgagaacctggaatacacaatagtcatcaccccacacagcggtgaggagcatgccgttggcaatgacactgggaagcacggaaaagaaattaagatcacgccgcagtcctcaataacagaggcagaacttaccggctatggtactgtgaccatggagtgtagtcccaggacagggctggatttcaacgaaatggtattgctccagatggaggagaaggcttggctggtgcaccggcaatggtttttagacctgcctctcccatggcttcccggcgccgatacccagggaagcaattggattcagaaggaaactctggtcacattcaagaaccctcatgcgaaaaagcaggacgtggttgtgttgggctctcaagagggggccatgcacacggcactaaccggagctactgaaatccagatgtcctcaggtaatctgctctttacaggccatctgaaatgccgtcttcgcctggacaagttgcagctcaaagggatgagctacagtatgtgtaccggaaagttcaagatcgtcaaagagattgccgagacacaacacggcactatcgtgattagagtacagtatgaaggtgatgggtctccatgcaagatacccttcgagatcatggacctggagaagaggcatgttttaggccggctgattaccgtgaacccgatcgtcacgggaaaggattcccctgtgaacatcgaggctgaacccccatttggcgacagctacattataatcggggtcgagcctggacagctaaaactcaattggttcaagaagggttcgtctattggccagatgtttgagaccacaatgcgaggggccaaacgcatggcaatcctgggagatactgcctgggacttcggctcccttggtggggtgtttacctcaattggcaaggctttgcaccaagttttcggagcgatctacggcgcagcctttagtggggtgagctggacaatgaaaatactgatcggagtaattatcacttggattggcatgaactccagatctaccagcctctcagtcagtctggtgcttgttggtgtggtcacgctgtatttgggggctatggtgcaggccgattccggatgtgtagtgagctggaagaataaagaactcaagtgcggctctggtatcttcataacagacaacgttcacacctggactgagcagtacaagtttcagcccgaatcaccaagtaaactggcaagcgccattcaaaaggctcatgaggaaggcatctgtgggattaggtccgtcacacggttagagaatctgatgtggaaacagatcacccccgagctaaaccacatactctctgaaaatgaggtgaagctgactatcatgaccggagatattaaaggcatcatgcaggccgggaagcgctcgcttagacctcagccaacagaattgaaatatagctggaagacgtggggaaaggcaaaaatgctgtccaccgagtcacataaccaaactttcctcattgacggcccggaaacagcggagtgccccaataccaacagggcttggaatagtctggaggtggaagattacggttttggggtcttcacaactaacatctggttaaagctgcgtgagaaacaggacgtattttgtgactctaaacttatgagcgccgcaataaaagataatcgggccgtgcacgctgacatgggatattggattgaatccgccttgaacggcacctggaagatggagaaggcatcattcatcgaggtgaaaagctgccactggcctaagtctcatacgctctggtccaatggtgtactggaaagtgagatgatcattcccaagaatttcgctggccccgtcagccagcacaactaccgacctgggtatcatacacagaccgccggaccatggcacctaggcaagctggaaatggattttgacttctgtgaggggactaccgtggttgtgacagaagattgcggaaatagaggcccctctctcaggactaccacagcgtccggtaaactgatcacggagtggtgctgtcgctcatgcacccttccgcctttgcggtacagaggggaggacggatgttggtacggcatggaaattaggccactgaaggagaaggaagagaacttagtcaatagtctcgtgactgccggtcatggccaaatagataactttagcctgggggttcttggaatggctctgttcttggaagagatgctccgcacacgagtgggcaccaaacacgcaatcctgctagtagccgtctcgtttgtgactctgattacagggaatatgtccttcaaggacctcggacgggtgatggtcatggttggcgtggctatgaccgatgacatcggtatgggggtaacgtatctggcccttttggcagcgtttaaagtgcgtcccactttcgccgctggactgttactcagaaagctgacctctaaagagcttatgatggccacaattggcatcaccctgctaagccagtcaactatacctgaaacaatcctcgagctgaccgatgcattggctctgggcatgatggtcttaaagattgtgaggaacatggaaaagtaccagctcgccgttacaatcatggcaattagttgcgtgcccaatgccgtcatcctgcttaacgcttggaaagtgtcctgtactatactggcggccgtttctgtgagcccattgctcctgacctcctcacaacagaagacggactggattcctctagcactgacaatcaaagggcttaatcccaccgctatctttctcactaccctgagccgcacaagtaagaaacggtcttggccattgaacgaggccgtcatggccgtaggaatggtgtccattctggctagctcgttactcaagaatgatataccgatgactggtcctctggttgcaggcgggcttctgaccgtgtgctatgtcttgacgggaagatcagccgacctcgaactggagagggcggctgacgtgaaatgggaggatcaggccgaaatctctggcagttcccccattctaagcatcacaatttctgaggacggtagcatgtccatcaagaacgaagaggaggaacagaccctgactatacttatccgaacagggctcctggtaatttcaggagtgttcccagtcagtatccccattaccgcagccgcttggtacttgtgggaggttaagaaacaacgcgcaggcgtgttatgggatgtgcctagcccaccccctgtcggcaaggccgaactggaggacggggcgtatcggatcaaacagagaggaatactcggttactctcagattggcgctggggtgtataaggaaggaacttttcacacaatgtggcatgttaccaggggcgccgtactgatgcaccgtggtaaacgcatcgagccgtcctgggcagatgtgaagaaggaccttatctcatacgggggaggctggaaactggagggcgaatggaaggagggggaagaggtccaggtgttggccctagaaccaggcaaaaatccccgggctgttcaaacgaagcctggtctgttcaaaactaacaccggcacaattggggccgtgagtctcgattttagcccaggaacctccggctctcccatcgtcgacagaaagggtaaggtggtagggctgtacggaaatggcgtcgtgacaaggtcgggcgcatatgttagcgctatagcccagactgagaaatcaattgaggataaccctgaaatcgaggacgatattttccgaaagaaacggcttaccatcatggacttacatccgggggcgggaaagacgaaacgctacctgcccgccatagtgagagaagcaattaagaggggtctccggacattgatcctggctccaactcgagtcgtggccgctgagatggaagaggcactcagaggcctgcctatccgctatcagacccccgccattagggccgagcacacagggcgtgaaatcgttgatcttatgtgtcatgctaccttcactatgcggctgttgtccccagtgagagtccctaactacaatctaattataatggacgaggcgcactttaccgaccccgcaagtatcgccgctaggggatatatttctacacgcgtggaaatgggcgaggccgcaggtatcttcatgacggccactccaccggggagccgagatccttttccccagtccaacgctccaatcatggacgaggaaagagagattcccgaacggtcatggaactctggacacgagtgggtaaccgatttcaagggcaaaacagtgtggtttgttcctagcataaaggcgggcaacgacatcgccgcatgcctgaggaaaaatgggaagaaagtcattcaactcagtcgcaagaccttcgattccgaatacgtgaagactcgtgctaacgactgggattttgtggtcacaaccgacatcagcgagatgggagccaatttcagagcagagcgggtaattgatccaaggcgctgtatgaaacccgtgatcttaacggacggtgaagaacgagttatactggccggccctatgccggtgactcattcttcagctgcccagagacgggggagggtcggacgcaacccaaagaatgaaaacgatcagtatatctacatgggcgagccccttgaaaatgacgaggactgcgcgcactggaaagaggcaaagatgctgctcgataacattaatacacctgaaggtatcattccctccatgtttgagccagaaagagagaaagtggacgccatcgatggggaatacaggttgcggggcgaggctcgtaagaccttcgttgacctgatgcgccgaggagatctccctgtgtggctggcctatagagtcgctgcagagggcataaactacgccgacaggcggtggtgttttgatgggattaaaaataaccaaatccttgaagagaacgtggaagtagagatttggaccaaggagggagaacgcaagaaactaaagcccagatggctggacgctaggatctatagtgatccattggccttaaaagagttcaaggagttcgcagcgggtcggaaaagcctgactctcaatctgataacagagatgggccgacttcctacctttatgacacagaaggccagagacgctctggataacctcgccgtgttgcatactgcagaagctgggggacgcgcctacaatcacgcactgtcggagctaccggagacgctggaaaccctccttctgttaacattgctggccactgttaccggcggtatcttcctctttctgatgtctgggaagggcattggaaaaatgacacttggcatgtgctgcatcattaccgcttccatcctgctctggtatgcgcagatacagccccactggattgccgcaagcatcatcttggagttctttctgattgtcttactaatcccagaacctgagaagcaaaggactccccaggacaaccagctgacgtacgtggtgatagctattctcaccgtcgttgccgccacaatggcaaatgaaatggggttccttgagaaaactaagaaagatctgggattgggttcaatcaccacacaggagagtgaatctaacattctggacatcgacctccggccagcttccgcctggaccctgtatgcggtggctactacatttgtaacgcctatgcttcgtcatagcatagaaaattcaagtgtgaacgtcagcctcaccgccatcgcaaatcaagccactgtgctgatgggcttggggaagggatggcccctgtccaagatggatattggcgttccgttactagctatcggttgttactctcaggtgaacccaattacactgaccgcagccctccttctgttggtcgcgcactacgctatcattgggcctggcctgcaggccaaagcaaccagagaagcccagaagagggctgccgcaggaatcatgaaaaatcccacagtagacggcataactgtgattgatctcgagccaatcccctatgaccctaagttcgaaaaacaactggggcaggttatgcttttaatcctgtgcgtgacgcaggtcctcatgatgcgcaccacatgggctttgtgtgaggccctgactctagcgaccggaccgattagcacactgtgggagggcaaccccggtcggttttggaataccactatagccgtgtccatggcaaacatcttccgagggtcatacctcgctggagccggccttctgttttctattatgaagaatacgacaaacaccagaaggggtactggcaatatcggggaaaccttgggagagaagtggaaaagtcgcctgaacgcactcggcaagtcggagttccagatttataaaaagagcgggatccaagaggtcgatcggacactggctaaagagggaataaagagaggcgaaactgaccatcacgccgtgtcccgtggttctgccaaattaaggtggtttgttgagcggaacatggtgaccccagaagggaaggtagtggatcttggatgcggccgcggtggctggtcatactattgtgggggactgaagaatgtccgagaggttaaaggcctcacaaaaggcgggcctgggcatgaagaaccaatccctatgagcacgtacggttggaacctagtgagactgcagtccggggtcgacgtgttcttcaccccacccgagaaatgcgatactttgctgtgtgacattggagaaagttctcctaatccaacaatcgaggcgggcaggaccctccgggtacttaacctggtggaaaattggttgaacaataacactcagttttgcattaaggttctgaatccctatatgccgagcgtgatcgagaaaatggaaacactccaacgcaagtacggcggggctttagtcagaaaccctctgtcaagaaattccacccacgagatgtactgggtgagtaacgcaacgggaaatatagtcagctctgtgaacatgatttcccgaatgcttatcaatcggttcaccatgaagcacaaaaaggccacatatgagccagatgttgacctgggttcaggcactcgtaacatcgggattgaaagcgagatacccaacctagatatcattggaaaaagaatcgaaaagattaaacaggagcatgaaacctcgtggcactacgaccaggaccatccttataagacatgggcttaccacggctcttatgagactaagcagaccggtagtgcctccagcatggtaaatggggtggtccgcctcctgacaaaaccatgggatgtggttcccatggtgacccaaatggcaatgactgacacgacaccgtttggacagcagagggtcttcaaggagaaagtggatacccggactcaggaacctaaggagggcaccaaaaagttgatgagaatcacagccgaatggctgtggaaggagctcggcaaaaagaaaacgccccgcatgtgtaccagggaggaatttactcgaaaggtacggtcaaacgctgcgcttggggccatattcacagacgagaataaatggaagtccgcaagagaagctgtggaggattctaggttttgggaactggttgaccgcgagcgtaacttacacctggagggaaaatgcgaaacctgtgtctacaatatgatgggtaagcgggagaagaaattgggcgagttcgggaaggccaaaggaagcagagcaatctggtatatgtggctcggcgccaggtttctggagttcgaagctctaggttttcttaacgaggatcattggttcagtcgcggaaattccctgagcggagtggagggcgaaggcctccaccgactggggtacattttgcgggacgtgtctaagaaagagggaggtgccatgtacgcggatgacactgcaggctgggatacaagaatcaccctggaagacctcaagaacgaggaaatggtcacaaatcatatgaagggggagcacaagaaacttgccgaggctatttttaaactgacttatcaaaacaaagttgtgagggtacagcgcccaacccctagaggaacggtgatggacatcatttcacggagggatcagcgtggcagtggtcaggtcgggacctacggattaaatacattcactaacatggaagcccaactgatacgacagatggagggcgaaggcatcttcaaatccattcagcatttgaccgtgacagaggagatcgcagttcaaaattggctcgctcgcgtggggagagaacggctgagcaggatggccatctctggagacgattgcgtcgtgaagcccctagacgatcgctttgcttcggcccttactgcactgaacgacatgggtaaggtaagaaaagatattcagcagtgggagccatcacggggctggaatgactggacccaggttcccttctgcagccaccactttcatgaactcgtgatgaaggatgggagggtcctggtggtgccttgtcgaaaccaagacgagttgataggacgtgcgagaatctcccagggcgccggttggagtttaaaagaaacggcttgcctggggaagtcttatgcccagatgtggacactcatgtacttccaccgccgggatcttaggctggcagctaacgccatttgtagcgcagtcccatcccattgggttccgacctcaagaactacatggagtatccacgccaaacacgagtggatgaccactgaggacatgctagcggtgtggaatcgcgtatggattcaggaaaacccctggatgggagataagacccctgtggagtcttgggaagaggtcccatatctgggcaagcgggaagaccaatggtgcggcagcctcatcgggttgacatccagggctacgtgggccaaaaatatacagaccgcaatcaaccaggtgcgatcactgattggaaatgaggagtacactgactatatgcccagcatgaagagatttcggagggaagaggaagaggccggtgttctttgg

SEQ ID NO: 15003 - RNA, 9873 nt, synthetic construct
  misc_feature 1..9873: note = derived and/or modified CDS sequence (opt3) from DENV-2__HQ012537__SS-prME
  source 1..9873: mol_type = other RNA
accgcaggcgtgatcattatgctgataccaacggctatggctttccacctcactacgagaaacggggaacctcatatgatcgtcggaaggcaggaaaagggtaaaagccttctgtttaagaccgaggacggcgttaatatgtgcacattgatggccattgatttaggggaactgtgtgaggacactatcacctacaaatgcccacttctccggcaaaacgaaccggaggatattgactgttggtgcaattccacatctacctgggtgacttatggaacatgtaccacgactggcgagcaccgccgagaaaagcgttcagttgcgctggtgccccatgtcggtatggggcttgagaccagaacagaaacttggatgagtagcgagggagcttggaaacacgtgcagaggatcgagacctggatactgcggcatcctggcttcgccatcatggcagccattttggcttacacaatcggcaccacgcactttcagcgcgcactcattttcatcctgctgactgccgttgctccatccatgacaatgagatgcatagggatttctaacagggattttgtggaaggagtctcgggtggctcatgggtggacatcgtactcgagcacgggagctgtgttaccactatggccaagaataagcccacattagatttcgaactgattaaaaccgaggcgaagcagcctgcaacgcttcggaaatattgcatcgaagccaagttgaccaacacaactaccgagagtcgctgtccaacacaaggagagccctccctgaatgaagaacaggacaaacgatttatctgcaagcattctatggtggatagaggctggggtaacgggtgtggactattcggcaagggcgggattgtcacttgcgctatgtttacctgcaaaaagaatatggaaggaaaagtggtgctccctgagaacctggaatacacaatagtcatcaccccacacagcggtgaggagcatgccgttggcaatgacactgggaagcacggaaaagaaattaagatcacgccgcagtcctcaataacagaggcagaacttaccggctatggtactgtgaccatggagtgtagtcccaggacagggctggatttcaacgaaatggtattgctccagatggaggagaaggcttggctggtgcaccggcaatggtttttagacctgcctctcccatggcttcccggcgccgatacccagggaagcaattggattcagaaggaaactctggtcacattcaagaaccctcatgcgaaaaagcaggacgtggttgtgttgggctctcaagagggggccatgcacacggcactaaccggagctactgaaatccagatgtcctcaggtaatctgctctttacaggccatctgaaatgccgtcttcgcatggacaagctgcagttgaaagggatgagctacagtatgtgtaccggaaagttcaagatcgtcaaagagattgccgagacacaacacggcactatcgtgattagagtacagtatgaaggtgatgggtctccatgcaagatacccttcgagatcatggacctcgagaagaggcatgttctgggccggttaattaccgtgaacccgatcgtcacggagaaggattcccctgtgaacatcgaagctgagcccccatttggagacagctacattataatcggcgtcgagcctgggcagctgaaactaaattggttcaagaagggatcgtctattggtcagatgtttgaaaccacaatgcgaggcgccaaacgcatggcaatcctcggggatactgcctgggacttcggatccctgggcggtgtgtttacctcaattgggaaggcacttcaccaagttttcggcgcgatctacggagcagcctttagtggcgtgagctggacaatgaaaatattgatcggggtaattatcacttggattggaatgaactccagatctaccagcctgtcagtcagtctcgtgctggttggcgtggtcacgctttatctgggtgctatggtgcaggccgattccgggtgtgtagtgagctggaagaataaagagttgaagtgcggatctggcatcttcataacagacaacgttcacacctggactgaacagtacaagtttcagcccgagtcaccaagtaaactcgcaagcgccattcaaaaggctcatgaagagggtatctgtggcattaggtccgtcacacggctggagaatttaatgtggaaacagatcacccccgaactgaaccacatactatctgagaatgaagtgaagctcactatcatgaccggggatattaaaggaatcatgcaggccggcaagcgctcgctgagacctcagccaacagagcttaaatatagctggaagacgtgggggaaggcaaaaatgttgtccaccgaatcacataaccaaactttcctgattgacggaccggagacagcggagtgccccaataccaacagggcttggaatagtctcgaagtggaggattacggctttggtgtcttcacaactaacatctggctgaagttacgtgaaaaacaggacgtattttgtgactctaagctgatgagcgccgcaataaaagataatcgggccgtgcacgctgacatggggtattggattgagtccgcccttaacgatacctggaagatggagaaggcatcattcatcgaagtgaaaagctgccactggcctaagtctcatacgttgtggtccaatggagtactcgagagtgaaatgatcattcccaaaaatttcgctggccccgtcagccagcacaactaccgacctggttatcatacacagaccgccggcccatggcacctggggaagctagagatggactttgatttctgtgaaggaactaccgtggttgtgacagaggactgcggcaatagagggccctctctgaggactaccacagcgtccggaaaactcatcacggagtggtgctgtcgctcatgcaccctgccgcctcttcggtacagaggcgaagatggttgttggtacgggatggagattaggccattgaaggaaaaggaggaaaacctggtcaatagtttagtgactgccggacatggccaaatagacaactttagcctcggtgttctgggcatggctcttttcctggaggagatgttgcgcacacgagtggggaccaaacacgcaatcctcctggtagccgtctcgtttgtgactctaattacaggaaatatgtccttccgggatctgggccgtgtgatggtcatggttggggtgaccatgacggacgatatcggaatgggcgtaacttatctcgctctgcttgccgcatttaaggtgagacccaccttcgcggccggtttgctgttaaggaaactcacatctaaggaactgatgatggctaccattgggatcgcccttctgagccagtcaactatacctgagacaatcctagaactcaccgacgcactggctttgggaatgatggtcctgcgcattgtgcggaacatggagaaataccagttagccgttacaatcatggcaattagttgcgtgcccaatgccgtcatcctcctgaacgcttggaaggtgtcctgtactatacttgcggccgtttctgtgagcccactgttgctcacctcctcacaacagaagacggattggattcctctggcactaacaatcaaaggcctgaatcccaccgctatctttcttactaccctcagcagaacaagtaagaaaaggtcttggccactgaacgaagccgtcatggccgtaggcatggtgtccattttggctagctcgctgttaaagaatgacataccgatgactgggcctctcgttgcaggaggtctgcttaccgtgtgctatgtcctgacgggccgatcagccgacttggagctcgagcgcgcggctgatgtgaaatgggaagaccaggccgagatctctgggagttcccccattctgagcatcacaatttctgaagatggaagcatgtccatcaagaacgaggaggaagaacagaccctaactatactgatccggacaggccttctcgtaatttcaggtgtgttcccagtcagtatccccattaccgcagccgcttggtacctgtgggaagttaaaaagcaaagagcaggggtgttgtgggacgtgcctagcccaccccctgtcgagaaggccgaattagaggatggagcgtataggatcaaacagcgtggcatactgggctactctcagattggggctggagtgtataaggagggtacttttcacacaatgtggcatgttacccgcggcgccgtactcatgcaccgggggaaaagaatcgaaccgtcctgggcagacgtgaagaaagatctgatctcatacggaggcggttggaaacttgagggggaatggaaggagggagaagaggtccaggtgctggccttggagccaggcaaaaatcccagggctgttcaaacgaagcctggcctattcaaaactaacaccgggacaattggagccgtgagtctggactttagcccaggtacctccggctctcccatcgtcgatcgaaaggggaaagtggtaggactctacggcaatggtgtcgtgacacggtcgggggcatatgttagcgctatagcccagactgaaaagtcaattgaggacaaccctgaaatcgaggatgacattttccgcaagaaaagactgaccatcatggatcttcatccgggagcgggcaagacgaaaaggtacttacccgccatagtgcgggaagcaattaagcgaggcctgagaacactcatcttggctccaactcgcgtcgtggccgctgagatggaggaagcactgagggggctccctatccgttatcagacccccgccattcgggccgagcacacaggaagagaaatcgttgacctgatgtgtcatgctaccttcactatgaggcttctgtccccagtgcgcgtccctaactacaatttgattataatggacgaggcgcactttaccgatcccgcaagtatcgccgctcgaggttatatttctacaagagtggagatgggcgaagccgcagggatcttcatgacggccactccaccgggaagccgggacccttttccccagtccaacgctccaatcatggatgaggaaagggagattcccgaacgctcatggaactctggccacgagtgggtaaccgacttcaaaggtaagacagtgtggtttgttcctagcataaaggcggggaacgatatcgccgcatgcctacgtaaaaatggaaagaaagtcattcaactgagtagaaagaccttcgactccgagtacgtgaaaactcgggctaacgattgggactttgtggtcacaaccgatatcagcgaaatgggcgccaatttcagggcagagcgcgtaattgacccacgaagatgtatgaagcccgtgatcctcacggatggcgaagaacgggttatattagccgggcctatgccggtgactcattcttcagctgcccagaggcgcggaagaatcggtaggaacccaaagaatgaaaacgaccagtatatttacatgggcgagcccctggagaatgacgaagattgcgcgcactggaaagaggcaaagatgcttctggacaacatcaatacacctgaagggattatcccctccatgtttgagccagaacgggagaaagtcgatgccatagacggagagtaccgtctccgcggcgaagctcgaaagaccttcgtggatttgatgagaaggggtgacctgcctgtttggctcgcctatcgggtggctgcagaggggattaactacgccgatcgcagatggtgttttgacggcatcaaaaataaccaaattctggaagagaacgtcgaggtggaaatctggaccaaggagggagaaaggaagaaacttaaaccccggtggctagatgctcgaatatatagtgacccactggccttgaaagagttcaaggagttcgcagcgggcagaaagagcttaactctgaatctcatcacagagatggggcgcctgcctacctttatgacacagaaggccagggatgctcttgacaacctggccgtactccatactgcagaggctggaggtcgggcctacaaacacgcattgtcggaactgccggagacgctagaaaccctgctccttctgacattattggccactgtgaccggcgggattttcctgtttctcatgtctggaaagggcatcggtaagatgacactggggatgtgctgcattatcaccgcttccatacttctgtggtatgcgcagattcagccccactggatcgccgcaagcatcattctcgagttctttttgatcgttctgttaataccagaacctgagaaacaacgtactccccaggataatcagctaacgtacgtcgtgattgctatcctgaccgtggtcgccgccacaatggcaaacgagatgggcttcctcgaaaagactaaaaaggaccttggactgggctcaattaccacacaggagagtgaatctaatatcttggacatagatctgagaccagcttccgcctggaccctctatgcggttgctactacatttgtgacgcctatgctgaggcatagcatcgagaactcaagtgtaaatgtgagccttaccgccattgcaaaccaagccactgtcctcatggggctgggaaaaggttggcccttgtccaagatggacatcggcgtgccgctgttagctattgggtgttactctcaggttaatccaatcacactaaccgcagccctgctccttctggtggcgcactacgctattatcggacctggcttgcaggccaaggcaacccgcgaagcccagaaacgggctgccgcaggtataatgaagaaccccacagtcgatgggattactgtaatcgacctggagccaatcccctatgatcctaaattcgagaagcaactcggccaggtgatgctgcttattttatgcgttacacaggtgctgatgatgcgaaccacatgggctctctgtgaagccttgactctggcgaccggaccgataagcacactatgggagggcaatcccgggagattttggaacaccactatcgccgtctccatggcaaatattttcaggggatcatacctggctggcgccggtctcctattttctatcatgaaaaacacgacaaatacccgccgggggactggaaacattggcgaaaccctgggtgagaagtggaagagtagattgaatgcactgggcaaatcggagttccagatctataagaaaagcgggatacaagaagtggaccgtacactcgctaaggagggaatcaaaaggggcgaaactgatcatcacgccgtctcccgggggtctgccaagctgcgctggtttgtggagcgaaacatggttaccccagaaggaaaagtggtagacttaggctgcggtagagggggatggtcatactattgtggcggtcttaagaacgtgagggaggtcaagggcctgacaaaagggggacctggccatgaggaacccattcctatgagcacgtacgggtggaatctcgttcggctacagtccggagtggatgtcttcttcaccccacccgagaagtgcgacactctgttgtgtgatatcggcgaaagttctcctaacccaacaattgaggcgggtcgcaccctgagagtgctcaatcttgctgaaaactggctgaataacaatactcagttttgcatcaaagtattgaacccctatatgccgagcgtgatagagaagatggagacactgcaaaggaaatacgggggagcactcgttcgaaatcctttatcacggaactccacccacgaaatgtactgggtgagtaatgccacgggcaacattgtcagctctgtgaatatgatctcccgtatgctgatcaacagattcaccatgaagcacaagaaagctacatatgagccagacgtcgatcttggctcagggactcgcaatattggaatagaaagcgagatccccaacctggacattatcggtaagaggattgagaaaatcaagcaggagcatgagacctcgtggcactacgaccaggatcatccttataaaacatgggcctaccacggctcttatgaaactaagcagaccgggagtgcatccagcatggtgaacggagttgtacggctactcacaaagccatgggacgtggtccccatggtgacccaaatggccatgactgatacgacaccgtttggccagcagagagttttcaaagagaaggtggacacccgcactcaggaacctaaagagggtaccaagaaactgatgaggataacagctgagtggttgtggaaggaactggggaagaaaaagacgccccgaatgtgtacccgggaggaatttactagaaaagtcaggtcaaatgcggccctcggagcaatcttcacagatgagaacaagtggaaatccgctcgcgaagccgtggaggactctcgtttttgggagcttgtagatcgggaaagaaatctgcacttagagggcaagtgcgaaacctgtgtgtacaacatgatgggcaaaagggagaagaagctgggggagttcggaaaagcaaagggtagccgcgccatttggtatatgtggttgggcgctcgatttctcgagttcgaggccctggggtttctaaatgaagaccattggttcagtcggggaaactcccttagcggcgttgagggtgaagggctgcacagactcggatacatcctgagggatgtctctaaaaaggagggcggcgcgatgtacgcagacgatactgccgggtgggacacacgcattaccttggaagacctgaaaaatgaggagatggtgacaaaccatatgaagggagaacacaagaaactcgctgaggccatctttaaacttacttatcaaaataaagtggtcagagttcagcggccaacccctaggggtacggtgatggatattatatcacgtaaggaccagcgaggcagtgggcaggtaggaacctacggcctgaacacattcactaatatggaagcacaattaatccgccagatggagggtgaggggattttcaaatccatccagcatctgaccgtgacagaagagatcgctgtccaaaactggttggccagagtgggacgggaaaggctcagccgcatggctatttctggcgatgactgcgttgtgaagcccctggatgacagatttgcctcggcactaactgcgcttaatgatatgggcaaggtccggaaagacatacagcagtgggagccatcaagggggtggaacgattggacccaggtgcccttctgcagccaccactttcatgaactggtaatgaaggacggacgagttctcgtggtcccttgtcgtaatcaagatgagctgatcggtagagcccgcatttcccagggcgctgggtggagtttgaaagagacggcctgcttaggaaagtcttatgcacagatgtggacactgatgtacttccaccggagggacctcagacttgctgccaacgcaatctgtagcgccgtgccatcccattgggtgccgacctcacgcactacatggagtattcacgcgaaacacgaatggatgaccactgaggatatgctggctgtctggaaccgggtttggatccaggaaaatccctggatggaggacaagacccctgtggaatcttgggaggaggtaccatatctaggcaagagggaagaccaatggtgcggtagcctgatagggctcacatcccgagccacgtgggccaaaaacatccagaccgccattaatcaggtgagatcattgatcggaaacgaggaatacactgattatatgcccagcatgaagcggtttaggcgcgaggaagaggaggctggcgtcctgtgg

SEQ ID NO: 15004 - RNA, 9876 nt, synthetic construct
  misc_feature 1..9876: note = derived and/or modified CDS sequence (opt3) from DENV-2__KU365901__SS-prME
  source 1..9876: mol_type = other RNA
accgccggaatcattataatgatgatccccacagtgatggctttccacctgactacgagaaatggggaacctcatatgattgtcagcaggcaggaaaagggaaagtccctcctttttaagaccgagaatggtgttaacatgtgcacactgatggcaatggacttgggcgaattatgtgaggatactatcacctacaattgcccactgctccggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactcggaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtggccccatctatgacaatgagatgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaacaccctgcgacgctgcggaagtactgcattgaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaagatcgtccagcctgaaaacctggagtatacaattgttataaccccacactccggagaagagaatgccgtgggtaacgatactggcaaacatgggaaggagatcaaagtaacgccgcagtcaagtattacagaagcagagctcaccggatacggcactgtgaccatggaatgtagccccaggacaggtctggacttcaatgagatggtccttctgcagatggaaaacaaggcttggttggtgcaccggcaatggtttctcgatctgcctttaccatggctgcccggggccgacacccagggctctaactggatccagaaagagactctcgttacattcaagaatcctcacgcgaagaaacaggatgtggtcgtgcttggatcccaagagggcgccatgcatacggcactgaccggggctactgaaatacagatgtcaagcggaaacttgctatttacaggtcacctgaagtgccgtctccgcatggacaaactgcagcttaagggcatgagttattctatgtgtaccgggaaattcaaggtagttaaggagattgccgaaacacaacatggaactatcgtgatcagagtccagtacgagggcgacggttccccatgcaaaattcccttcgagatcatggatctggaaaagaggcacgtgttggggcggctcattaccgtcaatccgatagtgacggagaaagacagccctgttaacatcgaagctgagcccccatttggcgattcgtacattatcatcggagtggaacctggccagctgaagttatcttggttcaaaaaggggtcctcaattggacagatgtttgagaccacaatgcgaggtgccaagcgcatggcaatactgggcgacactgcctgggatttcgggagtctaggaggcgtatttaccagcatcggtaaagctctccatcaagtcttcggggcgatttatggcgcagccttttccggagtgtcttggacaatgaagatcctgattggcgttgtgatcacttggatagggatgaatagcagatcaaccagtctttccgtcagcttggtgctggtaggagtggttacgctctacctgggcgtcatggtgcaggctgactctggttgtgtggtctcatggaaaaacaaggagcttaaatgcgggagtggaatcttcattacagataatgttcacacctggactgaacagtataagtttcagcccgagagcccatccaagctggcctctgcaatccaaaaagcccacgaagagggcatttgtggtatcaggtcggtgacacggttggaaaacctcatgtggaagcagataacccaggagctgaatcatattttaagcgagaacgaagtgaaactgactatcatgaccggcgacattaaggggatcatgcaggctggaaaacgctccctaagaccccaacctacagagctcaagtactcatggaaaacgtggggcaaggccaagatgctgagtaccgaacttcacaatcatactttcttgatagatgggccagagacagcagaatgcccgaacaccaatagggcgtggaactctctggaggtagaggactatggatttggcgtcttcacaactaatatctggctcaaactgaaggaaaaacaggatgtgttttgtgacagcaagttaatgtccgctgccattaaagacaaccgtgcagttcacgccgatatgggttactggatcgagtcagctctgaacgacacctggaagattgaaaaggccagcttcatcgaggtgaaatcttgcaattggcccaagtcccacacgctttggagtaacggggtcttggagagcgaaatgataattcctaaaaatttcgcaggaccagtgtctcagcataactatcggcccggctaccacacacagaccgctggtccttggcatctcggccgactggagatggattttgagttctgtgaggggactaccgttgtggtaacagaagactgcggaaatagaggcccatccctaaggactaccacagcctcagggaagctgatcacggagtggtgctgtcgcagttgcaccctacccccgctgcggtacagaggagaggatggctgttggtatggtatggaaatcaggcctcttaaagagaaggaagagaacttggtcaatagcctggtgactgcggggcacggacaaattgacaacttttcgttaggcgtgctcggtatggccctgttccttgaagagatgctgcgcacacgagtcggcaccaagcatgctatcttgctcgttgcagtgacttttgtaacactgattaccgggaatatgtccttccgggatctaggacgtgtgatggtcatggtgggcgccacgatgactgacgatatagggatgggagttacctacctggctctcctggccgcatttaaagtgagaccaacattcgcggccggccttttgctgaggaagttaacctctaaagagctcatgatggctactatcggtattgtcctgcttagccagtcaacaatccccgaaaccattctggagctaacagacgccctcgcactggggatgatggtgttgaagatcgttcgcaacatggaaaaatatcagctggctgtgactataatggccatcttatgcgtccctaatgcagtaattctccaaaacgcctggcgggtgagttgtaccacgctggctgttgtgtccgtctctccccttctgttgacaagctcccagcagaaggcggattggatcccactcgccctgaccattaagggactaaatcctactgcaatctttctgaccacactttcaagaactagcaaaaagaggagttggcccctcaacgaggctataatggccgtgggcatggtatctattctggcctccagcttgctgaaaaatgacatcccaatgaccggcccgttagtggctgggggactcctgacggtctgctacgttcttacaggtcgatcggcagatctggaattggagcgcgccgcggacgtgcggtgggaggaacaggctgagatctcaggctctagtcctattctctccataaccatcagcgaagacgggtctatgagcattaagaacgaggaggaagaacaaactctgacaatcctaattagaaccggactgcttgtgatctccggcctcttccccgtctcaataccaatcactgccgcagcctggtatctgtgggaagtgaaaaagcagagggctggtgttttgtgggatgtacccagtcctccacccgtggggaaagcagagttagaagacggagcctaccgtattaagcagaagggcatcctgggctatagccagattggggcgggagtctacaaagagggtacatttcacaccatgtggcacgtgacgcgcggcgctgttctcatgcataaggggaaacggatcgagccttcttgggccgatgtgaagaaagacctgatatcctacggaggcggttggaaacttgaaggggagtggaaggaaggagaggaagtccaagtgctggcattggagccgggcaaaaacccaagagccgtacagactaagcccggcctattcaaaaccaatacagggaccattggagctgtctcactggattttagtcctggtacaagcggctccccaatcgtggacaagaaagggaaggttgtgggactctatggcaacggtgtcgtgactaggtctgggacctacgtttcggccatcgcacagacggaaaagagcattgaagataatcccgagatcgaagacgatatattcagaaagaagcggctgacaattatggaccttcaccctggagctggcaaaactaagcgctatttaccggccatcgtgagagaggcgattaaaaggggcctgcggaccctcatcttggcccccacacgagtcgtggcagctgaaatggaggaggccctgagagggctcccaatacgctaccagacccctgctattagggcagaacatactggacgtgagatcgtagatctgatgtgtcacgccaccttcacaatgcggcttctgtcacccatcagagtgccaaactataatttgattatcatggacgaagcccattttacggatcctgcttccattgcggcaaggggttacataagtactcgcgttgagatgggcgaggccgctgggatcttcatgaccgccacacccccaggatctcgagacccgtttcctcaaagcaacgcacccattatggacgaagagagagaaatcccagagcggtcctggaactcaggccacgaatgggtcaccgatttcaagggtaagactgtgtggtttgtgccctctatcaaagccgggaacgacattgctgcgtgcctaaggaagaatggcaagaaggtcatacagctgagccgcaaaacattcgatagtgagtatatcaagacccgtacgaacgactgggattttgtagtgactacagacatttccgagatgggcgccaatttcaaggcagaaagagttatcgatcctcggaggtgtatgaaaccagtgattctcaccgacggcgaggaacgcgtcatcttagctgggcccatgcctgtgacccacagctctgccgcacagcgaagaggacgggttggtaggaacccgaagaatgagaacgatcaatacatatacatgggcgaaccactggagaatgacgaggattgcgcccattggaaagaagctaagatgcttctggacaacatcaacactcccgaggggattatcccttcaatgtttgaacccgagcgcgaaaaagtggacgccattgatggagagtatagactcaggggcgaggcgcggaagacattcgtcgacttgatgcgtcgcggtgatctgccagtgtggctcgcataccgagtagccgctgaagggatcaattatgccgacagaaggtggtgttttgatggcgtgaaaaacaatcagatactggaggaaaacgttgaggtcgagatttggaccaaggaaggagagcggaagaaacttaagcctcgctggctagacgctagaatctactccgatcccctggcattgaaagagttcaaggagttcgccgctggcaggaaaagtttaacactgaatctcattactgaaatggggcggctgccaacgtttatgacccagaaggcccgaaacgcacttgacaatctggcggtgctccacacagccgaggctggaggtagagcctataaccatgcattgagcgagctgcctgaaactctagagaccctgctccttctgacattattggctaccgtgactggcgggatcttcctgtttctcatgtcgggaaagggcataggtaaaatgacgctggggatgtgctgcatcattaccgcctctatccttctgtggtacgcacagattcaaccgcactggatcgccgcttccataattctcgagttctttttgatcgtcctgttaatccccgagccagaaaagcagcgcacacctcaggataatcagctaacttatgttgtgattgcgatcctgaccgtagtggccgcaacaatggctaacgagatgggcttcctcgagaaaaccaagaaagactttggacttggcagcataactacacaacagcccgaatcaaatattctggatatcgacttgaggccagccagtgcctggacgctgtacgcagtcgctaccactttcattacacctatgctccggcactctatcgagaactccagcgtgaatgtttcactgaccgccatagcgaaccaggctaccgtgcttatggggctcggaaagggttggcccctgagtaagatggatatcggcgtcccgttgctggccattgggtgttacagccaggtaaatccaatcacattaactgcagccctactgctccttgtggctcattatgcaattatcggacctggcctgcaagccaaagcgacgcgtgaagctcagaagagagccgcagccggtattatgaaaaaccccaccgttgacgggatcacagtgatagacttggatccaattccctacgaccctaagtttgagaaacagctgggccaggtcatgctcctggtgctttgcgtcactcaagtgttaatgatgaggaccacatgggctctgtgtgaagccctcaccttggcaactggaccgatctccacgctgtgggagggcaatcccgggcgcttctggaacacaaccatcgctgtttctatggccaacatttttcggggaagctatctagcgggcgccggtctactcttctccataatgaagaatactgcaaacacccgaagagggacaggaaatactggcgagacccttggtgaaaagtggaaaaacaggctgaatgctttgggcaagtcagagtttcagatctacaaaaagtctgggattcaggaagtggatcgcacactggccaaagagggaatcaagcggggcgagacggaccaccatgcagtaagtagagggtcggctaaactccgttggttcgtggaaaggaacctggtcaccccagagggaaaggttgtggatttaggctgcggtagaggcgggtggagctattactgtgggggtcttaagaatgtcaaagaagtgaagggcctgactaaagggggacctggccacgaggaacccattcctatgtccacatatgggtggaacctcgtacgcctacaatctggagtggacgttttctttaccccacccgagaagtgcgatactctgttgtgtgacatcggcgagtcaagccctaatccaacagtggaagccggtcgaaccctgagagtcctcaaccttgtggagaattggctgaacaataacacgcagttctgcataaaagtcttgaatccctacatgccgtccgtgatcgaaaagatggaggccctgcagaggaagtacgggggagcgctcgttcggaaccctttaagtcgcaactctacccatgaaatgtattgggtaagcaatgcttcaggcaacattgtgtccagtgtcaatatgatcagcagaatgctgattaacaggtttacaatgcgacacaaaaaggcaacttacgagccagatgtggaccttggctctgggacccggaatatcggaatagagtccgaaacacccaacctggatattatcggtaaacgtatcgagaagattaaacaggaacacgagacttcatggcattatgaccaagatcacccttacaagacctgggcctatcatggcagctacgaaacaaagcagaccgggtcggcttctagtatggttaatggagtggtcagactactcactaaaccatgggacgtgatacccatggtaacgcagatggccatgacagacaccactccgttcggccagcaacgcgtgtttaaggagaaagttgataccaggacacaggagcctaaggaaggtacgaaaaagctgatgaagatcaccgcagagtggttgtggaaagaactggggcggaagaaaactcccagaatgtgtacacgcgaggagttcaccaggaaggtccgatccaacgccgctctcggagcgatttttactgacgaaaataaatggaaaagcgcccgggaggcagtggaagattcaggcttctgggagcttgtggacaaagaaagaaacctgcacttagagggcaagtgcgagacatgtgtctataatatgatggggaagagggagaaaaagctgggagaatttggtaaagctaagggctcccgcgccatctggtacatgtggttgggggcacgtttcctcgaatttgaggccctgggattcctaaacgaagatcactggttttctcgggagaatagccttagtggcgttgagggtgaagggctgcataaactcggatacattctgagagacgtgtccaagaaggagggcggcgctatgtatgccgatgacaccgcggggtgggatacaaggatcactttggaagacctgaaaaacgaggaaatggtaaccaatcacatggagggagagcataagaaactcgcagaagccatattcaaacttacgtaccagaacaaagtggtccgcgtgcagcgaccaacccctcggggtacagttatggatatcattagcagaagggaccaacgcggctctggacaggtggtcacttatggactgaacaccttcacaaatatggaggctcagttaatcagacaaatggaaggcgagggtgtgtttaagtcaattcagcagctgactgtaaccgaggaaatcgccgttaagaactggttggcacgggtggggagggagcgtctcagtcgaatggctatttccggagacgattgcgtcgtgaaacccctggacgatcgcttcgccagcgctctaacggcccttaatgacatgggcaaggtgagaaaagatatacagcaatgggaaccatctcggggctggaacgactggacacaggtccccttttgctcgcaccatttccacgagctgatcatgaaggatgggagggttctcgtggtaccttgtcgcaatcaggacgaactgattggacgagcacggatctcacagggtgcgggctggagcttgagggagaccgcctgcttagggaaatcctacgctcaaatgtggagtctgatgtattttcaccgacgtgatctcagacttgccgcaaacgctatctgttctgccgtgccaagccattgggtcccgacttcccgcacaacctggtcaattcacgcaactcatgagtggatgaccacagaagacatgctgacggtgtggaatcgggtttggatacaggagaacccctggatggaagataagacccctgtggagagttgggaagagatcccatacctaggaaagagggaggaccagtggtgcggctctctgattggtctcactagcagagccacatgggcgaaaaatatccagaccgctattaaccaagtccgctccttgatcgggaatgaagagtatactgattacatgccctcaatgaagcggttcaggcgagaagaggaagaggccggagtgctgtggtga

SEQ ID NO: 15005 - RNA, 9876 nt, synthetic construct
  misc_feature 1..9876: note = derived and/or modified CDS sequence (opt3) from DENV-2__GQ398258__SS-prME
  source 1..9876: mol_type = other RNA
accgccggcatgatcattatgctgatacccacagtgatggctttccacctcactacgcgaaacggggaacctcatatgatcgtcagcaggcaggaaaaggggaaatcccttctgtttaagaccgaagacggtgttaatatgtgcacattgatggcaatggatttaggcgaactgtgtgaagacactattacctacaactgcccactactccggcaaaatgaaccggaggatatcgactgttggtgcaactctacatcaacctgggtgacttatgggacatgtaccgccacgggagagcaccgccgagaaaaacgtagtgtagcgctggtgccccatgtcggcatgggtcttgagactcgaaccgaaacatggatgagctccgagggggcttggaagcacgcccagaggattgagacttggatcctgcggcatcctggattcaccataatggcagccatcttggcttacacaattggcaccacgtattttcagcgcgtgctcatcttcattctgctgactgcagttgccccatctatgacaatgagatgcatcggcatatcgaatagggattttgtggaaggggtctcaggaggtagctgggtggacattgtactcgagcacggcagttgtgttaccactatggctaaaaacaagcccacattagatttcgaactgatcaagaccgaggccaaacagcctgcgacgcttcggaagtactgcattgaagcaaaattgaccaatacaactaccgcctcccgctgtccaacacaaggggagccctctctgaacgaggaacaggacaagcgatttgtgtgcaaacacagcatggtcgatagaggatggggcaatggttgtgggctattcggaaagggcggcatcgtgacttgcgctatgtttacctgcaagaaaaacatggaggggaaggtggtccagcctgaaaatctcgagtatacaatcgttattaccccacattccggagaagagaacgccgtgggtaatgacactggcaaacacgggaaggagataaaaatcacgccgcagtcaagtattacagaagcagagctgaccggatacggcactgtaaccatggaatgtagccccaggacaggtcttgatttcaacgagatggtgctgttgcaaatggaaaataaggcttggctcgtccatcggcagtggtttctggacttacctctgccatggctccccggggccgatacccagggctctaactggatccagaaagagactcttgtgacattcaagaaccctcacgcgaagaaacaagacgttgtggtcctgggatcccaggagggcgccatgcacacggcattgaccggggctactgaaatacagatgtcaagcggaaatctactgtttacaggtcatctcaagtgccgtctgcgcatggacaaacttcaactgaagggcatgagttattctatgtgtaccgggaaattcaaggtggtaaaggagattgccgaaacacagcacggaactatcgttatcagagtgcagtacgagggcgatggttccccatgcaaaattcccttcgagatcatggacttggaaaagaggcatgtcctcgggcggctgattaccgtgaacccgatagtcacggagaaagatagccctgtgaatatcgaagctgagcccccatttggcgactcgtacattatcatcggagttgaacctggccagttaaagctgaactggttcaaaaaggggtcttccattggacaaatgtttgagaccacaatgcgaggtgccaagcgcatggcaatactaggcgatactgcctgggacttcgggtcactcggaggcgtgtttaccagtatcggtaaagctctgcaccaggtattcggggcgatttatggcgcagcctttagcggagtctcctggacaatgaagatccttattggcgtggttatcacttggatagggatgaactctagaagcacctcattgagtgtgtccctggtcctcgtgggagtagtgacgctgtaccttggcgttatggtccaggctgatagcggttgtgtggtgtcttggaaaaacaaggagctgaaatgcgggtcaggaatcttcattacagacaatgtccatacctggactgaacagtataagtttcaacccgagagtccaagcaagttggcctccgcaatccagaaagcccacgaagagggcatttgtggtatcaggtctgttacacggctcgaaaacctgatgtggaagcagataacccccgagttaaatcacattctgtcggagaacgaagtgaaactaactatcatgaccggcgatattaaggggatcatgcaggctggaaaacgcagcctcagacctcaaccaacagagctgaagtactcctggaaaacgtggggcaaggccaagatgctttcaaccgaattgcataatcagactttcctgatagacgggccggagacagcagaatgccccaacaccaatagggcgtggaacagtctcgaggtggaggattatggatttggcgtattcacaactaatatctggctgaaattaaaggaacgtcaggacgtcttttgtgaccctaaactgatgtctgctgccattaaggataaccgggcagtgcacgccgacatgggttactggatcgagagcgctcttaacgatacctggaaaattgaaaaggcctccttcatcgaggttaagtcatgccattggccaaaaagccacacgttgtggtctaatggggtgctcgagtccgaaatgataattcccaagaacttcgcaggacctgtcagtcagcacaattatcgaccaggctaccatacacaaaccgctggtccctggcacctgggcaaactagagatggactttgatttctgtgaagggactaccgtggttgtgacagaggactgcggaaacagaggcccgagcctgaggactaccacagcctctgggaagctcatcacggaatggtgctgtcgctcctgcaccctgcctccacttcggtacaaaggagaggatggctgttggtatggtatggagatcagacccttgaaggaaaaggaggaaaatctggtaaactcattagtcactgcggggcatggacagattgacaattttagtctcggcgtgctgggtatggcccttttcctggaggaaatgttgaggacacgcgtgggcaccaaacacgctatcctcctggtcgcagttagctttgtgactctaattacagggaacatgtcgttccgagatctgggacgggtaatggtgatggtcggcgccaccatgacggacgatatagggatgggagtgacttacctcgctctgcttgccgcatttaaggttcgtcctaccttcgcggccggcttgctgttaagaaaactcacatccaaggagctgatgatgaccactatcggtattgtgcttctgtctcagagcacaatccccgagaccattctagaactcacagacgctctggccttggggatgatggtcctgaaaatcgtgaagaatatggagaagtatcaattagcagttactataatggctatcctctgcgtgccaaacgccgtcattctgcagaatgcatggaaagtatcatgtaccatccttgccgtggttagtgtgtcccctctgttgctcacgtctagccagcagaaggctgattggattcccctggcgctaacaatcaaaggactgaacccaaccgccatatttcttactaccctctccaggacatcaaagaaacgcagctggccgctgaatgaagcaattatggctgtcggcatggtgagtatcttggcctcttccctgttaaagaacgacatccctatgactggccccctcgtagccgggggactgcttaccgtgtgctacgtcctgacgggtcggagcgctgacttggagctcgaaagagcagccgatgttaggtgggaggaccaagcggagatttcgggctcatctccaatactgagtatcacaatttccgaagatgggagcatgtctatcaaaaatgaggaagaggagcagaccctaactattctgatccgaacaggacttctcgtgataagcggcctgttccccgtgtccatccctattaccgctgccgcatggtatttgtgggaagtcaagaagcagcgcgccggtgtgttatgggacgttccatcaccccctccggtagggaaagctgagctggaagatggagcataccggatcaagcagaaaggcattctcggctatagtcaaatcggggccggagtgtacaaggagggtacttttcatacaatgtggcacgtcaccagaggcgcggtgctgatgcacaaagggaagaggatagaaccaagctgggctgacgttaagaaagatcttatttcttacggaggcggttggaagctggagggggagtggaaagaaggagaggaagtgcaggtcttggccctagagcccggcaagaaccctcgtgcagtgcagacgaaaccaggcctgttcaagactaacaccgggacaatcggagccgtatccctcgacttttcacccggtaccagtggcagccctatcgtcgataagaaagggaaggtggttggactgtatggcaatggtgtggtcacacgctccgggacttacgtgtctgctattgcccagaccgaaaaatcgatcgaggacaacccggagatagaagatgacattttccggaagaaaagacttacgatcatggatttacatcccggagcaggcaagacaaagaggtatctgccagctattgttcgagaggccatcaaacggggcctccgcactttgatactggcgcctaccagagtggtcgccgcagaaatggaggaagctctcagggggctgcccattcggtaccaaacaccagccatccgagctgagcacaccggaagagagatcgtggaccttatgtgtcatgcaactttcaccatgcgcctgttgagccctgtaagggtgcccaattataacctaattatcatggacgaagcccactttacagatccagcctcaattgctgcgcgtggttacatatccacgcgggttgagatgggcgaagcagccgggatcttcatgactgctaccccgcctggaagtagagacccctttccacagtctaatgcccccattatggatgaggagagggaaatccctgagcgcagctggaactccggccatgaatgggtcacagacttcaagggtaaaaccgtgtggtttgtgccatcaatcaaggcagggaatgatattgccgcttgcctgagaaagaatggaaagaaggtcatacagctctctagaaaaactttcgacagcgagtatatcaagacacggaccaatgattgggactttgtagtgacgactgatattagtgaaatgggcgcgaacttcaaagccgagagggttatcgacccccgccgttgtatgaagcctgtgattttaacagatggcgaggaaagagtcatcctggcagggccgatgccagtgacccactccagcgctgcccaacggaggggacgcataggtcgaaatcccaaaaacgagaatgaccagtacatctacatgggcgaacctcttgagaacgacgaagattgcgcacactggaaggaggccaaaatgctgctcgacaatattaacacccccgaggggatcattccatctatgtttgaacctgagagagaaaaggttgatgctatcgacggagagtatcggttgaggggcgaagcccgcaagactttcgtggatctgatgagaaggggtgacctccccgtctggctggcgtaccgggtggcagccgaggggataaactatgctgatcgtcgctggtgttttgacggcattaaaaataaccagatccttgaggaaaatgtagaggtggaaatttggacaaaggagggagagaggaaaaagctaaaaccaagatggctggatgccagaatctactcagaccctttggctttaaaggagttcaaggagttcgcagccggccggaaatccctgaccctcaacctgataacagaaatggggcgccttccgacttttatgacgcagaaggctagaaatgccctggataacctcgcagttttgcataccgcggaggccggaggtagggcttataatcacgccctgagtgaactacccgagacactggagactctccttctgttaaccttgctggcaacagtcaccggcgggatcttcctctttctgatgagcggaaaaggcattggtaagatgactcttgggatgtgctgcatcattacggcttcgatcctgctctggtacgcccaaatacagccacattggattgcagcctctatcatcttggagttctttctgattgtgttactaatccctgagcccgaaaaacagcggaccccacaggacaaccaactgacatatgtggtcatagctattctcactgttgtggcggccaccatggcaaatgagatgggcttccttgaaaagacaaagaaagattttggactgggctccatcgctacccaccagcctgagagcaacattttggacatcgacctgcgacccgcctcagcctggactctctacgcagtagctacaacgttcataaccccgatgctgagacacagtatcgaaaattcttccgtgaacgtcagccttactgccattgcgaatcaggctacagtgctcatggggctgggaaagggttggccattgtcaaaaatggatatcggcgttcctctgttagccattgggtgttacagtcaggtgaaccccatcaccctaaccgcagccctgctccttctggtcgctcattatgcaattatcggaccaggcttgcaagccaaggcgacacgcgaagctcagaaaagggccgcagccggtataatgaagaatcccactgtagacgggattacggtgatcgatctggaccctatcccgtacgatcccaagtttgagaaacagctcggccaggttatgctgcttgtgttatgcgtcacccaagtgctgatgatgcggacaacttgggctctctgtgaagccttgaccctggcaacaggaccaattagcaccctatgggagggcaaccctgggcgtttctggaatactacgatagctgtctccatggccaacatctttagaggatcttatctggcgggcgccggtctccttttcagcattatgaagaacacagcaaataccaggcgcgggactggaaacaccggcgaaacactgggtgagaaatggaagaatcggttgaacgctctgggcaaatccgagtttcagatctacaagaaatcagggattcaggaagtggaccgaactctcgccaaggagggaatcaagagaggcgaaaccgatcaccatgcagtttctagggggagtgctaaactgcgctggttcgtggagcggaatttagtaacacccgagggaaaggtggtcgaccttggctgcggtagagggggatggtcgtattactgtggcggtctgaaaaacgttcgtgaagtgaagggcctcacgaaagggggacctggccacgaggaaccaatacccatgagcacctatgggtggaatctagtcaggctgcaatccggagtggatgtattctttactcctccagagaagtgcgacacattgctgtgtgatatcggcgaatcttcacccaacccgaccgtggaggccggtcggactctccgcgttcttaatctggtggagaactggttgaataacaatacacagttctgcattaaggtcctgaacccttacatgccaagcgtgatcgagaaaatggaggccctccagcgaaagtacgggggagcgttagtcagaaatcccctgtccaggaacagtacccatgaaatgtattgggtgtctaacgctagcggcaatattgtttcatccgtaaacatgatcagtcggatgcttataaatcgctttacgatgagacacaaaaaggcaacctacgagcctgacgtggatctgggcagcgggacaaggaacattggaatcgaatctgagactccaaatctagacatcattggtaaacgaatagagaagatcaagcaggaacacgagacctcctggcattatgaccaagatcacccctacaaaacatgggcctatcatggctcatacgaaactaagcagaccgggagcgcttcgtctatggtcaacggagtggttcggctcctgacaaaaccgtgggacgtgattcctatggtcacccagatggccatgactgatacgacacccttcggccagcaacgtgtgtttaaggagaaagtagacaccagaactcaggaaccaaaggagggtaccaagaaattgatgaagatcacagcagagtggctgtggaaagaactcgggaagaaaaagacgcctcgcatgtgtaccagggaggagttcactcggaaagtgagaagtaatgccgctcttggagcgatttttacagatgagaacaagtggaagtccgcccgcgaggcagttgaagacagcaggttctgggagctggtcgataaagaacgaaatttacacctggagggcaagtgcgaaacctgtgtgtataacatgatgggcaaacgggagaagaaattgggggagtttggaaaggctaagggttcaagagccatctggtacatgtggctcggcgcaaggttcctggaatttgaggccctagggttccttaatgaagaccactggttttcccgcgagaactctctgagcggagtggaaggcgagggtctccataaactggggtacatattgcgtgatgtcagtaagaaagagggaggcgctatgtatgccgacgatactgcgggctgggacacacggatcaccctggaagacctcaagaatgaggaaatggttacaaaccacatggagggggaacataagaaacttgcagaggccattttcaaactgacttaccagaataaagtggtaagagtgcagaggcccaccccacgcggaacggtcatggatatcatttcccgacgggaccaaagaggtagcggccaggtggggacctatggattaaacacattcactaacatggaggctcagctgatcaggcaaatggaaggcgagggtgtttttaagtctattcagcacttgaccgtgacagaagagatagccgtccagaattggctcgcacgcgtggggagagagcggctgtcaaggatggctatcagtggagatgactgcgtagttaaacccctagatgaccgtttcgcctccgctcttactgccctgaacgatatgggcaaggtgcgaaaagacattcagcaatgggaacctagccgcggctggaatgattggacccaggtcccattttgctctcatcacttccacgagctcatcatgaaggacgggagagtgctggtggtcccgtgtcggaaccaggatgaattgatcggaagggcacgcatttcgcagggtgcgggctggtcattaagagagacggcctgcctgggaaagagctacgctcaaatgtggtccctcatgtattttcatcggagggaccttcgactggccgcaaatgctatatgtagtgccgttccctctcactgggtgcctacaagccgtaccacttggtccatccatgcaagacacgaatggatgacaaccgaggatatgctaactgtatggaaccgcgtgtgggtccaggagaatccatggatggaagacaaaacccccgtggagtcatgggaagagattccttacctgggaaagcgggaagaccagtggtgcggcagtctcatcggtttgacatctagggccacgtgggcgaaaaacattcagaccgctatcaatcaagttagaagcctgatagggaacgaggagtatactgattacatgccatccatgaagcgcttccggagggaagaggaagaggccggagtgctttggtga

SEQ ID NO: 15006 - RNA, 9876 nt, synthetic construct
  misc_feature 1..9876: note = derived and/or modified CDS sequence (opt3) from DENV-2__GQ398259__SS-prME
  source 1..9876: mol_type = other RNA
accgccggcatgatcattatgctgatacccaccgtgatggctttccacctcactacgcgaaacggggaacctcatatgatcgtcagcaggcaggaaaagggaaaatcccttctgtttaagaccgaagacggtgttaatatgtgcacattgatggcaatggatttaggcgaactgtgtgaagacactattacctacaactgcccactactccggcaaaatgaaccggaagatatcgactgttggtgcaactctacatcaacctgggtgacttatgggacatgtaccgccacgggagagcaccgccgagaaaaacgtagtgtagcgctggtgccccatgtcggcatgggtcttgagactcgaaccgaaacatggatgagctccgagggggcttggaagcacgcccagaggattgagacttggatcctgcggcatcctggattcaccataatggcagccatcttggcttacacaattggcaccacgtattttcagcgcgtgctcatcttcattctgctgactgcagttgccccatctatgacaatgagatgcatcggcatatcgaatagggattttgtggaaggggtctcaggaggtagctgggtggacattgtactcgagcacggcagttgtgttaccactatggctaaaaacaagcccacattagatttcgaactgatcaagaccgaggccaaacagcctgcgacgcttcggaagtactgcattgaagcaaaattgaccaatacaactaccgcctcccgctgtccaacacaaggggagccctctctgaacgaggaacaggacaagcgatttgtgtgcaaacacagcatggtcgatagaggatggggcaatggttgtgggctattcggaaagggcggcatcgtgacttgcgctatgtttacctgcaagaaaaacatggaggggaaggtggtccagcctgaaaatctcgagtatacaatcgttattaccccacattccggagaagagaacgccgtgggtaatgacactggcaaacacgggaaggagataaaaatcacgccgcagtcaagtattacagaagcagagctgaccggatacggcactgtaaccatggaatgtagccccaggacaggtcttgatttcaacgagatggtgctgttgcaaatggaaaataaggcttggctcgtccatcggcagtggtttctggacttacctctgccatggctccccggggccgatacccagggctctaactggatccagaaagagactcttgtgacattcaagaaccctcacgcgaagaaacaagacgttgtggtcctgggatcccaggagggcgccatgcacacggcattgaccggggctactgaaatacagatgtcaagcggaaatctactgtttacaggtcatctcaagtgccgtctgcgcatggacaaacttcaactgaagggcatgagttattctatgtgtaccgggaaattcaaggtggtaaaggagattgccgaaacacagcacggaactatcgttatcagagtgcagtacgagggcgatggttccccatgcaaaattcccttcgagatcatggacttggaaaagaggcatgtcctcgggcggctgattaccgtgaacccgatagtcacggagaaagatagccctgtgaatatcgaagctgagcccccatttggcgactcgtacattatcatcggagttgaacctggccagttaaagctgaactggttcaaaaaggggtcttccattggacaaatgtttgagaccacaatgcgaggtgccaagcgcatggcaatactaggcgatactgcctgggacttcgggtcactcggaggcgtgtttaccagtatcggtaaagctctgcaccaggtattcggggcgatttatggcgcagcctttagcggagtctcctggacaatgaagatccttattggcgtggttatcacttggatagggatgaactctagaagcacctcattgagtgtgtccctggtcctcgtgggagtagtgacgctgtaccttggcgttatggtccaggctgatagcggttgtgtggtgtcttggaaaaacaaggagctgaaatgcgggtcaggaatcttcattacagacaatgtccatacctggactgaacagtataagtttcaacccgagagtccaagcaagttggcctccgcaatccagaaagcccacgaagagggcatttgtggtatcaggtctgttacacggctcgaaaacctgatgtggaagcagataacccccgagttaaatcacattctgtcggagaacgaagtgaaactaactatcatgaccggcgatattaaggggatcatgcaggctggaaaacgcagcctcagacctcaaccaacagagctgaagtactcctggaaaacgtggggcaaggccaagatgctttcaaccgaattgcataatcagactttcctgatagacgggccggagacagcagaatgccccaacaccaatagggcgtggaacagtctcgaggtggaggattatggatttggcgtattcacaactaatatctggctgaaattaaaggaacgtcaggacgtcttttgtgactctaaactgatgagcgctgccattaaggataaccgggcagtgcacgccgacatgggttactggatcgagtccgctcttaacgatacctggaaaattgaaaaggcctcattcatcgaggttaagagctgccattggcctaaatctcacacgttgtggtccaatggggtgctcgagagtgaaatgataattccaaagaacttcgcaggacccgtcagccagcacaattatcgacctggctaccatacacaaaccgctggtccatggcacctgggcaaactagagatggactttgatttctgtgaagggactaccgtggttgtgacagaggactgcggaaacagaggcccctctctgaggactaccacagcctccgggaagctcatcacggaatggtgctgtcgctcatgcaccctgccgcctcttcggtacaaaggagaggatggctgttggtatggtatggagatcagaccattgaaggaaaaggaggaaaatctggtaaacagtttagtcactgcggggcatggacagattgacaattttagcctcggcgtgctgggtatggcccttttcctggaggaaatgttgaggacacgcgtgggcaccaaacacgctatcctcctggtcgcagtttcgtttgtgactctaattacagggaacatgtccttccgagatctgggacgggtaatggtgatggtcggcgccaccatgacggacgatatagggatgggagtgacttacctcgctctgcttgccgcatttaaggttcgtcccaccttcgcggccggcttgctgttaagaaaactcacatctaaggagctgatgatgaccactatcggtattgtgcttctgagccagtcaacaatccctgagaccattctagaactcacagacgctctggccttggggatgatggtcctgaaaatcgtgaagaatatggagaagtatcaattagcagttactataatggctatcctctgcgtgcccaacgccgtcattctgcagaatgcatggaaagtaagttgtaccatccttgccgtggtttccgtgtctccactgttgctcacgagctcccagcagaaggctgattggattcctctggcgctaacaatcaaaggactgaaccccaccgccatatttcttactaccctctcaaggacaagcaagaaacgcagttggccactgaatgaagcaattatggctgtcggcatggtgtctatcttggcctccagcctgttaaagaacgacatcccgatgactggccctctcgtagccgggggactgcttaccgtgtgctacgtcctgacgggtcggtcggctgacttggagctcgaaagagcagccgatgttaggtgggaggaccaagcggagatttcaggctctagtcccatactgtccatcacaattagcgaagatgggtctatgagcatcaaaaatgaggaagaggagcagaccctaactattctgatccgaacaggacttctcgtgatatccggcctgttcccagtgtcaatccccattaccgctgccgcatggtatttgtgggaagtcaagaagcagcgcgccggtgtgttatgggacgttcctagtccaccccctgtagggaaagctgagctggaagatggagcataccggatcaagcagaaaggcattctcggctatagccaaatcggggccggagtgtacaaggagggtacttttcatacaatgtggcacgtcaccagaggcgcggtgctgatgcacaaagggaagaggatagaaccgtcttgggctgacgttaagaaagatcttatttcctacggaggcggttggaagctggagggggagtggaaagaaggagaggaagtgcaggtcttggccctagagccaggcaagaacccccgtgcagtgcagacgaaacctggcctgttcaagactaacaccgggacaatcggagccgtatcactcgactttagtccaggtaccagcggctcccccatcgtcgataagaaagggaaggtggttggactgtatggcaatggtgtggtcacacgctctgggacttacgtgtcggctattgcccagaccgagaaaagcatcgaggacaaccctgagatagaagatgacattttccggaagaaaagacttacgatcatggatttacatccgggagcaggcaagacaaagaggtatctgcccgctattgttcgagaggccatcaaacggggcctccgcactttgatactggcgccaaccagagtggtcgccgcagaaatggaggaagctctcagggggctgcctattcggtaccaaacacccgccatccgagctgagcacaccggaagagagatcgtggaccttatgtgtcatgcaactttcaccatgcgcctgttgtcaccagtaagggtgcctaattataacctaattatcatggacgaagcccactttacagatcccgcctccattgctgcgcgtggttacataagtacgcgggttgagatgggcgaagcagccgggatcttcatgactgctaccccaccgggatctagagacccttttccccagagcaatgccccaattatggatgaggagagggaaatccccgagcgctcctggaactcaggccatgaatgggtcacagacttcaagggtaaaaccgtgtggtttgtgccttctatcaaggcagggaatgatattgccgcttgcctgagaaagaatggaaagaaggtcatacagctcagcagaaaaactttcgacagtgagtatatcaagacacggaccaatgattgggactttgtagtgacgactgatatttccgaaatgggcgcgaacttcaaagccgagagggttatcgacccacgccgttgtatgaagcccgtgattttaacagatggcgaggaaagagtcatcctggcagggcctatgccggtgacccacagctctgctgcccaacggaggggacgcataggtcgaaatcccaaaaacgagaatgaccagtacatctacatgggcgaaccccttgagaacgacgaagattgcgcacactggaaggaggccaaaatgctgctcgacaatattaacacccctgaggggatcattccctcaatgtttgaaccagagagagaaaaggttgatgctatcgacggagagtatcggttgaggggcgaagcccgcaagactttcgtggatctgatgagaaggggtgacctccctgtctggctggcgtaccgggtggcagccgaggggataaactatgctgatcgtcgctggtgttttgacggcattaaaaataaccagatccttgaggaaaatgtagaggtggaaatttggacaaaggagggagagaggaaaaagctaaaacccagatggctggatgccagaatctactccgacccattggctttaaaggagttcaaggagttcgcagccggccggaaaagtctgaccctcaacctgataacagaaatggggcgccttcctacttttatgacgcagaaggctagaaatgccctggataacctcgcagttttgcataccgcggaggccggaggtagggcttataatcacgccctgagcgaactaccggagacactggagactctccttctgttaaccttgctggcaacagtcaccggcgggatcttcctctttctgatgtcgggaaaaggcattggtaagatgactcttgggatgtgctgcatcattacggcttctatcctgctctggtacgcccaaatacagccccattggattgcagcctccatcatcttggagttctttctgattgtgttactaatcccagagcctgaaaaacagcggaccccacaggacaaccaactgacatatgtggtcatagctattctcactgttgtggcggccaccatggcaaatgagatgggcttccttgaaaagacaaagaaagattttggactgggcagcatcgctacccaccagccagagtcaaacattttggacatcgacctgcgacctgccagtgcctggactctctacgcagtagctacaacgttcataacccccatgctgagacactctatcgaaaattccagcgtgaacgtctcacttactgccattgcgaatcaggctacagtgctcatggggctgggaaagggttggccgttgagtaaaatggatatcggcgttccactgttagccattgggtgttacagccaggtgaaccctatcaccctaaccgcagccctgctccttctggtcgctcattatgcaattatcggacccggcttgcaagccaaggcgacacgcgaagctcagaaaagggccgcagccggtataatgaagaatccaactgtagacgggattacggtgatcgatctggaccccatcccttacgatccgaagtttgagaaacagctcggccaggttatgctgcttgtgttatgcgtcacccaagtgctgatgatgcggacaacttgggctctctgtgaagccttgaccctggcaacaggacccatttccaccctatgggagggcaacccagggcgtttctggaatactacgatagctgtctctatggccaacatctttagaggaagctatctggcgggcgccggtctccttttctccattatgaagaacacagcaaataccaggcgcgggactggaaacaccggcgaaacactgggtgagaaatggaagaatcggttgaacgctctgggcaaatcagagtttcagatctacaagaaatctgggattcaggaagtggaccgaactctcgccaaggagggaatcaagagaggcgaaaccgatcaccatgcagttagtagggggtcggctaaactgcgctggttcgtggagcggaatttagtaacacctgagggaaaggtggtcgaccttggctgcggtagagggggatggagctattactgtggcggtctgaaaaacgttcgtgaagtgaagggcctcacgaaagggggacccggccacgaggaacctataccaatgtccacctatgggtggaatctagtcaggctgcaatctggagtggatgtattctttactccccctgagaagtgcgacacattgctgtgtgatatcggcgaatcaagcccaaaccccaccgtggaggccggtcggactctccgcgttcttaatctggtggagaactggttgaataacaatacacagttctgcattaaggtcctgaacccgtacatgccttccgtgatcgagaaaatggaggccctccagcgaaagtacgggggagcgttagtcagaaatccactgagtaggaactctacccatgaaatgtattgggtgagcaacgcttcaggcaatattgtttccagtgtaaacatgatcagccggatgcttataaatcgctttacgatgagacacaaaaaggcaacctacgagcccgacgtggatctgggctctgggacaaggaacattggaatcgaatccgagactcctaatctagacatcattggtaaacgaatagagaagatcaagcaggaacacgagacctcatggcattatgaccaagatcacccatacaaaacatgggcctatcatggcagctacgaaactaagcagaccgggtcggcttctagtatggtcaacggagtggttcggctcctgacaaaaccctgggacgtgattccgatggtcacccagatggccatgactgatacgacacctttcggccagcaacgtgtgtttaaggagaaagtagacaccagaactcaggaacccaaggagggtaccaagaaattgatgaagatcacagcagagtggctgtggaaagaactcgggaagaaaaagacgccacgcatgtgtaccagggaggagttcactcggaaagtgagatccaatgccgctcttggagcgatttttacagatgagaacaagtggaaaagcgcccgcgaggcagttgaagactcaaggttctgggagctggtcgataaagaacgaaatttacacctggagggcaagtgcgaaacctgtgtgtataacatgatgggcaaacgggagaagaaattgggggagtttggaaaggctaagggttccagagccatctggtacatgtggctcggcgcaaggttcctggaatttgaggccctagggttccttaatgaagaccactggttttctcgcgagaacagcctgagtggagtggaaggcgagggtctccataaactggggtacatattgcgtgatgtctccaagaaagagggaggcgctatgtatgccgacgatactgcgggctgggacacacggatcaccctggaagacctcaagaatgaggaaatggttacaaaccacatggagggggaacataagaaacttgcagaggccattttcaagctgacttaccagaataaagtggtaagagtgcagaggcctacaccccgcggaacggtcatggatatcattagccgacgggaccaaagaggttctggccaggtggggacctatggattaaacacattcactaacatggaggctcagctgatcaggcaaatggaaggcgagggtgtttttaagtcaattcagcacttgaccgtgacagaagagatagccgtccagaattggctcgcacgcgtggggagagagcggctgagtaggatggctatctccggagatgactgcgtagttaaaccactagatgaccgtttcgccagcgctcttactgccctgaacgatatgggcaaggtgcgaaaagacattcagcaatgggaaccctctcgcggctggaatgattggacccaggtccctttttgctcgcatcacttccacgagctcatcatgaaggacgggagagtgctggtggtcccatgtcggaaccaggatgaattgatcggaagggcacgcatttcacagggtgcgggctggagcttaagagagacggcctgcctggggaagtcctacgctcaaatgtggagtctcatgtattttcatcggagggaccttcgactggccgcaaatgctatatgttctgccgttccgagccactgggtgcccacatcccgtaccacttggtcaatccatgcaagacacgaatggatgacaaccgaggatatgctaactgtatggaaccgcgtgtgggtccaggagaatccttggatggaagacaaaaccccagtggagagttgggaagagattccctacctgggaaagcgggaagaccagtggtgcggctctctcatcggtttgacaagcagggccacgtgggcgaaaaacattcagaccgctatcaatcaagttagatccctgatagggaacgaggagtatactgattacatgccttcaatgaagcgcttccggagggaagaggaagaggccggagtgctttggtga

SEQ ID NO: 15007 - RNA, 9876 nt, synthetic construct
  misc_feature 1..9876: note = derived and/or modified CDS sequence (opt3) from DENV-2__GQ398268__SS-prME
  source 1..9876: mol_type = other RNA
accgccggcatgatcattatgctgataccaacagtgatggctttccacctcactacgaggaacggggagcctcatatgatcgtcagcaggcaggaaaagggaaagtcccttctgtttaagaccgaggacggtgttaatatgtgcacattgatggcaatggatttaggcgaactgtgtgaggacactattacctacaaatgcccacttctccggcaaaacgaaccggaggatatcgactgttggtgcaattctacatcaacctgggtgacttatgggacatgtaccacgactggagagcaccgccgagaaaagcgtagtgtcgccctggtgccccatgtcggcatgggtcttgagaccagaacagaaacttggatgagctccgagggggcgtggaaacacgctcagaggattgagacctggatcctgcggcatcctggattcacaataatggccgcaatcttggcctacaccattggcacgactcactttcagcgcgctctcatcttcattctgctgacagcagtggccccatctatgaccatgagatgcatcggcatatcgaacagggattttgttgaaggggtgtcaggaggtagctgggtcgacattgtgctcgagcacggcagttgtgtaactacaatggctaagaataagcccaccttagatttcgaactgatcaaaacggaggccaagcagcctgcgacccttcggaaatattgcattgaagcaaagttgacaaacactaccacagagtcccgctgtccaactcaaggggagccctctctgaatgaagaacaggacaaacgatttgtttgcaagcatagcatggtggatagaggatggggcaacggttgtgggctattcggaaagggcggcatcgtaacctgcgccatgtttacatgcaaaaagaatatggaagggaaagtggtgcagcctgagaacctcgaatacaccatcgtcattactccacactccggagaggagcatgctgttggtaatgacacgggcaagcacgggaaagaaataaagatcacaccgcagtcaagtattaccgaggccgaactgactggatatggcaccgtgacaatggagtgtagccccaggaccggtcttgatttcaacgaaatggtactgttgcaaatggagaataaagcatggctcgtgcaccggcagtggtttctggacttacctctgccatggctccccggggctgatactcagggctctaactggatccagaaggagacacttgtcacgttcaagaatcctcatgccaaaaagcaagacgtggttgtgctgggatcccaggaaggcgcgatgcacaccgccttgactggggcaacagagatacagatgtcaagcggaaacctactgtttaccggtcatctcaaatgccgtctgcgcatggacaaacttcaactgaaaggcatgagttactctatgtgtacagggaagttcaaggtcgtgaaagaaattgctgagactcagcacggaaccatcgtaatcagagttcagtatgagggcgatggttccccatgcaagattcccttcgaaatcatggacttggagaaaaggcatgtgctcgggcggctgattacggtcaacccgatagtgaccgaaaaggatagccctgtcaatatcgaggccgaacccccatttggcgactcgtacattatcatcggagtggagcctggccagttaaaactgaactggttcaagaaggggtcttccattggacaaatgtttgagacaactatgcgaggtgctaaacgcatggccatactaggcgataccgcatgggacttcgggtcactcggaggcgtttttacaagtatcggtaaggccctgcaccaggtgttcggggctatttacggcgcggcatttagcggagtatcctggactatgaaaatccttattggcgtcatcataacctggatcgggatgaactctagaagcacgtcattgagtgtgtccctggttctcgtgggagtcgtgacactgtatcttggcgtaatggtgcaggccgatagcggttgtgttgtctcttggaagaacaaagaactgaagtgcgggtcaggaattttcatcaccgacaatgtgcacacttggacagagcagtacaagtttcaacccgaaagtccaagcaaattggcttccgccattcagaaggcacatgaggaaggcatctgtggtataaggtctgtgacccggctcgagaacctgatgtggaaacagattactcccgagttaaatcacatcctgtcggaaaacgaggtcaagctaaccattatgacaggcgatatcaaagggataatgcaggccggaaagcgcagcctcagacctcaaccaacggaactgaaatattcctggaagacctggggcaaggctaaaatgctttcaactgagagtcataatcagacattcttgatcgacgggccggaaaccgccgagtgccccaacacaaatagggcatggaactctctggaggttgaagattacggatttggcgtgttcactaccaatatttggctcaagctgcgtgagaaacaggacgtgttttgtgacagcaagttaatgtccgcggctatcaaagataaccgggccgtacacgcagacatgggttattggattgaatcagccctgaatgatacgtggaagatcgagaaggctagcttcatagaggtcaaatcttgccactggcctaagtcccatacactttggagtaacggggtgttggaaagcgagatgattatccccaagaatttcgccggacccgtttctcagcacaattaccgacctggctatcatacccaaactgcaggtccatggcacctcggcaagctggaaatggactttgatttctgtgaggggaccacagtggtcgtgactgaagactgcggaaacagaggcccctccctaaggaccacaacggcttcagggaaactgatcaccgagtggtgctgtcgcagttgcactctcccgcctctgcggtacagaggagaggatggctgttggtacggtatggaaattaggccacttaaggagaaggaagagaatttggttaacagcctggtgacagccgggcatggacagatcgacaatttttcgttaggcgtactcggtatggcgctgttccttgaagagatgctgcgcacccgagtcggcactaaacacgccattttgctcgtggctgtgtcctttgtcacactgataaccgggaacatgtctttccgggatctaggacgtgttatggtgatggtaggcgcaacgatgactgacgatatcgggatgggagtgacctatctggccctcctggctgcctttaaggtcagacccacattcgcagcgggccttttgctgaggaaattaaccagcaaggagctcatgatgactacaattggtatcgtgctgctttcacagagtaccattcctgaaacaatcctggagctaactgacgccctcgctctggggatgatggttttgaaaatggtgcgcaagatggaaaagtaccaactggccgtcaccataatggcaatcttatgcgtgcccaatgctgttattctccagaacgcctggaaagtgtcctgtacgatcctggcagtcgtatctgtgagcccacttctgttgacatcctcacagcagaaggccgattggattcctctcgctctgaccatcaaaggactaaatcccactgcgatatttctgaccacacttagccggactaacaagaaaagaagttggccactcaatgaggccattatggcagttggcatggtgtctatcctggcttccagcttgctgaagaacgacatcccgatgaccggccctttagtcgccgggggactcctgacggtgtgctatgtacttacaggtaggtcggccgacctggaattggagcgagctgcagatgtgaaatgggaggaccaagccgaaatttcaggctctagtcccatactctccatcaccattagcgaggatgggtctatgagcatcaagaatgaagaggaggaacagactctgacaattctaatccgcaccggactgcttgtcatatccggcctcttcccagtttcaatccccattactgcggctgcctggtacctgtgggaggtgaagaaacagcgggccggtgtgttgtgggacgtccctagtccaccccctgtggggaaggccgaattagaggatggagcttatagaatcaaacagaagggcattctgggctacagccaaatcggggcaggagtttataaagaaggtacatttcacaccatgtggcatgtaacgaggggcgccgtgctcatgcacaaggggaagcgtatagagccgtcttgggcggacgtcaaaaaggatctgatttcctacggaggcggttggaaacttgagggggaatggaaggagggagaagaggtgcaggttctggctttggaaccaggcaaaaacccccgcgccgtgcagactaagcctggcctattcaagaccaatgcagggacaatcggagccgtctcactggactttagtccaggtaccagcggctcccccatcattgataaaaaggggaaagtggtaggactctacggcaacggtgtcgtgacacggtctggggcttatgtttcggccatcgcacagactgaaaagagcatagaggacaaccctgaaattgaggatgacatcttcagaaaaaggaagctgaccattatggatcttcatccgggagctggcaagacgaaacgatacttacccgccatcgtgcgggaagcgataaagcgcggcctgagaacactcattttggccccaactagggtcgtggcagctgagatggaagaggccctgcgggggctccctatccgatatcaaacccccgctatcagagcagagcacacaggacgcgaaattgttgacctgatgtgtcatgccaccttcactatgaggcttctgtcaccagtgcgtgtccctaattacaacttgatcattatggacgaggcccactttaccgatcccgcttccatagcggcacggggttatatcagtacaagagtggaaatgggcgaggccgctgggattttcatgacggccactccaccgggatctagggacccttttccccagagcaatgcaccaatcatggatgaggaacgcgagatccccgaacgatcctggtcatctggccacgagtgggtaaccgacttcaaaggtaagacagtgtggtttgttcctagcattaaagccgggaacgatatagctgcgtgcctaagaaagaatggaaagaaagtcatccagctgagtcggaagaccttcgactccgaatacgtgaaaactaggacaaacgattgggactttgtggtcaccacggatattagcgagatgggcgccaatttcaaggcagagcgcgtaatcgacccacgtagatgtatgaaacccgtgattctcactgatggcgaagaacgggttatcttagctgggcctatgccggtgacacattcttcagccgcacaaaggcgcggacgaataggtagaaacccaaagaatgaaaacgaccagtatatctacatgggcgagcccctggaaaatgacgaggattgcgcccactggaaagaggctaagatgcttctggacaacattaatacccctgaagggatcattccctccatgtttgagccagaacgggagaaggtcgatgccatcgacggagaatacaggctccgcggcgaggcgagaaaaaccttcgtggatttgatgaggcggggtgacctgcctgtttggctcgcatatcgtgtggccgctgaggggataaactacgccgatcgccgatggtgttttgacggcattaagaataaccagatcctggaagagaacgtcgaagtggagatttggactaaagagggagaaagaaagaaacttaagcccaggtggctagatgctcggatctatagtgacccactggcattgaaggagttcaaagagttcgccgctggccgcaagagcttaacactgaatctcataaccgagatggggagactgcctacatttatgactcagaaagccagggatgcacttgacaacctggcggtactccatacggccgaagctggaggtcgggcctacaatcacgcattgtcggagctgccggagaccctagaaacactgctccttctgactttattggctaccgtgacaggcgggatcttcctgtttctcatgtctggacgaggcattggtaagatgaccctggggatgtgctgcatcattactgcctccatccttctgtggtatgcacaaatacagccccactggattgccgctagcatcatcctcgagttctttttgattgttctgttaatcccagaacctgagaaacagagaacgccccaggataaccaactaacctacgtcgtgatagcgattctgacagtggtcgccgcaactatggctaatgaaatgggcttcctcgagaagaccaagaaagaccttggactgggctcaatcacaacccagcagccagagagtaacattttggacatcgatctgcgccctgcctctgcctggactctctatgcagttgctacaacgtttgtgacccccatgctgaggcattccatagaaaatagctcagtaaacgtgagtcttactgccatcgcgaatcaggctacagtcctcatggggctgggaaagggttggccgttgagcaaaatggacattggcgtgccactgttagccatcgggtgttactcccaagttaaccctattaccctaaccgcagccctgctccttctggtggctcactacgcaatcattggacccggcttgcaggccaaggcgacacgggaggctcagaaacgtgccgcagccggtatcatgaagaatccaactgtcgatgggataacggtaattgacctggatcccatcccttatgacccgaagttcgaaaaacagctcggccaagtgatgctgcttgttttatgcgtgacccaggtcctgatgatgagaacaacttgggctctctgtgaggccttgaccctggcaacaggacccatctctaccctatgggaaggcaacccagggaggttttggaatactacgattgctgtgagcatggccaacatattccgcggatcctacctggcgggcgccggtctcctattttcaatcatgaagaatacaaccaacactcggcgagggaccggaaatattggcgagacactgggtgagaaatggaagtctagattgaacgcactgggcaaaagtgagttccagatctataagaaatcggggattcaagaggtcgataggactctcgctaaggaaggaatcaagcgcggcgagaccgaccatcacgccgtgagccgggggtccgcaaaactgagatggtttgttgagcgtaacatggtgacacctgaaggaaaggtagtggatttaggctgcggtagagggggatggtcttactattgtggcggtcttaaaaatgtccgggaggttaagggcctgacgaaagggggacccggccatgaggaacctataccaatgtcaacctacgggtggaacctcgtgcgcctacagagcggagtcgacgtgttcttcactccccctgaaaagtgcgatacactgttgtgtgacatcggcgagtccagtccaaatcccaccgtagaggctggtcgaactctgagagtgctcaaccttgttgaaaattggctgaacaataacacacagttttgcattaaggtgttgaatccgtatatgccttctgtcatcgagaaaatggaagccctgcagaggaagtacgggggagccctcgtgcggaacccattaagccgcaattcaacccacgagatgtactgggtctccaacgcgagtggcaatattgtgagctctgttaacatgatctccagaatgctgataaataggttcacgatgcgacacaaaaaggctacctatgaacccgatgtagaccttggctcagggacacggaacattggaatcgagagcgagatccctaacctggacattataggtaaacgtatcgaaaagattaagcaagagcatgaaacttcgtggcactacgatcaggaccatccatataaaacctgggcataccacggctcttatgagacaaagcagactgggagtgcctccagcatggtgaatggagtcgtgagactactcaccaaaccctgggatgttgtgccgatggtcacacagatggctatgaccgacactacgccttttggccaacagcgcgtgttcaaggaaaaagtagatacaaggacccaggagcccaaggagggtactaagaaactgatgaagatcaccgccgaatggttgtggaaagagctggggaagaaaaagacaccacggatgtgtacgagagaagagtttacccgcaaagtgaggtcaaacgcagccctcggagctattttcactgacgagaataagtggaagtccgcgcgagaagccgttgaggattctcggttttgggaacttgtcgacaaagagagaaacctgcacttagaaggcaagtgcgagacatgtgtgtacaatatgatgggcaaaagggagaagaaactgggggagttcggaaaggcaaagggtagccgcgctatctggtatatgtggttgggcgcccgttttctcgagttcgaagcactggggtttctaaacgaggatcattggttcagtcgggaaaattcccttagcggagtggagggcgagggtctgcacaaactcgggtacatactgagagacgtctctaagaaagaaggaggcgccatgtacgctgatgacaccgccggctgggacactaggatcacattggaggatctgaagaacgaagagatggttaccaatcatatggaaggggagcacaaaaagctcgcggaggcaatttttaaacttacatatcagaacaaagtggtacgcgtgcaacgacctactccccggggaaccgtcatggacatcatttcaagaagggatcagcgcggtagtggccaggtggggacgtacggactgaataccttcacaaacatggaagcccaattaatcagacagatggagggcgaaggtgttttcaagtccattcagcatctgactgtgaccgaggagatagctgtccagaattggttggcccgggtggggagggaacgtctcagccgaatggcaatctctggagacgattgcgtagttaaaccactggacgatcgctttgcttcggccctaacagctcttaacgacatgggcaaggtgagaaaagatattcaacagtgggagccctcacggggctggaatgactggactcaggtccctttctgcagccaccactttcatgaactgatcatgaaggatgggagggtgctcgtggtcccatgtcgcaaccaggacgagctgatcggtagagcacggatttcccaaggagcaggctggagtttgagggaaaccgcgtgcttagggaagtcttatgcccagatgtggagcctgatgtacttccaccgacgtgatctcagacttgctgccaacgcaatatgttccgctgttccgtcacattgggtgcccacgagtcgcacaacctggtctatccacgccaaacacgagtggatgactacagaggacatgctgaccgtatggaatcgggtgtggattcaggaaaacccttggatggaggacaagactccagtcgaaagctgggaggaaatcccctatctaggaaaaagggaggatcagtggtgcggctccctgattggtctcacctcaagagcaacatgggccaagaatatccaaacggcgataaaccaggtgcgcagcttgatcgggaatgaggaatacaccgactatatgccttctatgaaacggtttaggcgagaggaagaggaagctggagttctgtggtga

SEQ ID NO: 15008 - RNA, 9876 nt, synthetic construct
  misc_feature 1..9876: note = derived and/or modified CDS sequence (opt3) from DENV-2__GQ398263__SS-prME
  source 1..9876: mol_type = other RNA
accgccggaatgatcattatgatgatacccactgtgatggctttccacctgactacgcgaaacggggagcctcatatgatcgtcagcaggcaggaaaagggaaaatccctcctttttaagaccgaggacggtgttaatatgtgcaccctgatggcaatggatttgggcgaattatgtgaggacactattacctacaactgcccactgcttcggcaaaatgaaccggaggatatcgactgttggtgcaactctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggattgagacttgggtgcttcggcatcctggattcaccatcatggcagccatactggcttacacaatcggcaccacgtattttcagcgcgttttgattttcatcctcctgactgcagtggccccatctatgacaatgcggtgcattggcatctcgaatagggattttgtcgaaggggtgtcaggaggtagctgggtagacatagttctggagcacggcagttgtgtgaccactatggctaaaaacaagcccacactcgatttcgaattaattaagaccgaggccaaacaccctgcgacgctgcggaagtactgcatcgaagcaaaacttaccaatacaactaccgcctcccgctgtccaacacagggggagccctctttgaacgaggaacaagacaagcgatttgtctgcaaacatagcatggtggatagaggatggggcaatggttgtgggctgttcggaaagggcggcattgtgacttgcgctatgtttacctgcaagaaaaacatggaggggaaggtcgttcagcctgaaaatctagagtatacaatcgtgatcaccccacactccggagaagagaacgccgtaggtaatgacactggcaaacatgggaaggagattaaaataacgccgcagtcaagtatcacagaagcagagctcaccggatacggcactgtgaccatggaatgtagccccaggacaggtctggatttcaacgagatggtccttctgcagatggaaaataaggcttggttggtgcaccggcaatggtttctcgacctgcctttaccatggctgcccggggccgatacccagggctctaactggattcagaaagagactctcgttacattcaagaaccctcacgcgaagaaacaggacgtggtcgtgcttggatcccaagagggcgccatgcatacggcactgaccggggctactgaaatccagatgtcaagcggaaatttgctatttacaggtcacctgaagtgccgtctccgcatggacaaactgcagcttaagggcatgagttattctatgtgtaccgggaaattcaaggtagttaaggagatagccgaaacacaacatggaactattgtggtcagagtgcagtacgagggcgatggttccccatgcaaaatccccttcgagatcatggacctggaaaagaggcacgtcttggggcggctcattaccgtgaacccgatcgttacggagaaagatagccctgtgaatattgaagctgagcccccatttggcgactcgtacataatcattggagtagaacctggccagctgaagttatcttggttcaaaaaggggtcctcaatcggacagatgtttgagaccacaatgcgaggtgccaagcgcatggcaatcctgggcgatactgcctgggacttcgggagtctaggaggcgtctttaccagcattggtaaagctctccatcaagtgttcggggcgatatatggcgcagccttttccggagtttcttggacaatgaagatcctgattggcgtggtcatcacttggattgggatgaacagcagatcaaccagtctttccgtgagcttggtactggtgggagttgtcacgctctacctgggcgtgatggtgcaggctgattctggttgtgtcgtttcatggaaaaataaggagcttaaatgcgggagtggaatcttcataacagacaacgtgcacacctggactgaacagtataagtttcagcccgagagcccatccaagctggcctctgcaatccaaaaagcccacgaagagggcatttgtggtatcaggtcggtgacacggttggaaaatctcatgtggaagcagattacccccgagctgaaccatatcttaagcgagaatgaagtaaaactgactataatgaccggcgatattaaggggatcatgcaggctggaaaacgctccctaagacctcagccaacagagctcaagtactcatggaaaacgtggggcaaggccaagatgctgagtaccgaacttcacaaccatactttcttgattgacgggccggagacagcagaatgccccaccacaaatagggcgtggaactctctggaggtcgaggattatggatttggcgtgttcactaccaatatctggctcaaactgaaggaacgtcaagacgttttatgtgacagcaaactgatgtccgctgccataaaggataaccgggcagtgcacgccgacatgggttactggatcgagtcagctcttaatgatacgtggaaaattgaaaaggccagctttatcgaggtcaagtcttgccactggcctaaatcccatacattgtggagtaacggggtgctcgagagcgaaatgattatcccaaagaacttcgcaggacccgtttctcagcacaattatcgacctggctaccatacccagactgctggtccatggcacctgggcaaactagagatggacttcgatttttgtgaagggaccacagtggtagtcactgaggactgcggaaacagaggcccctccctgaggaccacaacggcctcagggaagctcataaccgaatggtgctgtcgcagttgcactctgccgcctcttcggtacagaggagaggatggctgttggtatggtatggagattaggccattgaaagacaaggaagagaatctggtgaacagcttagtgacagcggggcatggacagatcgataatttctcgctcggcgtcctgggtatggccctttttctggaagagatgttgcgcacccgagttggcactaagcacgctatcctcctggtggcagtatccttcgtgacactaattaccgggaacatgtcttttcgggacctgggacgtgtcatggtgatggttggcgccacgatgactgatgacatcgggatgggagtgacctacctcgctctgcttgccgcattcaaagtcagacccacatttgcggccggcttgctgttaaggaagctcaccagcaaagaactgatgatgactacaattggtatagtgcttctgtcacaaagtaccatccctgagacaattctagagctcactgatgctctggccttggggatgatggttctgaagatcgtgcgcaatatggaaaaatatcagttagcagtcaccattatggctatcctctgcgtacccaacgccgtgatactgcagaatgcatggaaggtttcctgtacgatccttgccgtggtctctgtgagcccactgttgctcacatcctcacaacagaaggctgactggattcctctggcgctaaccatcaaaggactgaaccccactgccattttccttaccacactcagccggacaagtaagaaaagatcttggccactgaatgaggcaatcatggctgtaggcatggtgtccatattggccagctcgctgttaaagaacgacattccgatgaccggccctctcgtcgccgggggactgcttacggtttgctacgtgctgacaggtaggtcagctgatttggaactcgagcgagcagccgacgtgcgctgggaagatcaggcggagatctctggcagttcccccatcctgagcattaccatatctgaggacgggagcatgtccatcaaaaatgaagaggaagaacagactctaacaattctgatccggaccggacttctcgtcatttcaggcctgtttccagtgagtatccccataactgctgccgcatggtatttgtgggaggttaagaaacaaagagccggtgtattatgggatgtgcctagcccaccccctgtcgggaaggctgaactggaggacggagcatacaggatcaagcagaaaggcattctcggctattctcagatcggggccggagtgtacaaggaaggtacattccacaccatgtggcatgttacgcgtggcgcggtgctgatgcacaaagggaagcgcattgagccgtcctgggctgatgtccggaaagaccttatctcatacggaggcggttggaagctggaaggggagtggaaggagggagaagaggtgcaggtattggccctagaaccaggcaaaaaccccagagcagtccaaactaagcctggcctgtttaaaaccaatacagggaccataggagccgtgagtctcgatttcagcccaggtacatccggctctcccattgttgacaagaaagggaaggtggtcggactgtatggcaacggtgtggttactaggtcggggacctacgtgagcgctatcgcccagacggagaagtcaatcgaagataaccctgagattgaggacgatatctttagaaagaagcggcttacaataatggacttacatccgggagcaggcaaaactaagcgctatctgcccgctattgtcagagaagccatcaaaaggggcctccggaccttgattctggcgccaacacgagtggtagccgcagagatggaagaggctctcagagggctgcctatccgctaccagacccccgccataagggctgaacacactggacgtgagattgtggaccttatgtgtcatgcaaccttcacaatgcggctgttgtccccagttagagtccctaattataacctaatcatcatggatgaggcccacttcacggaccccgccagtattgctgcgaggggttacatctctactcgcgtggaaatgggcgaggcagccgggatttttatgaccgctacaccaccgggaagccgagatcctttcccccagtccaatgccccaataatggacgaagagagagagatccccgaacggtcatggaactctggccacgagtgggtgaccgattttaagggtaagactgtctggttcgtacctagcattaaagcagggaatgacatcgccgcttgcctgaggaagaacggcaaaaaggtgatccaactcagtcgcaaaacatttgattccgaatatattaagacccgtacgaatgactgggatttcgttgtgactacagacataagcgagatgggcgcgaactttaaggccgaaagagtcatcgatccacggaggtgtatgaaacccgtgattttaaccgacggcgaggagcgcgttatcctggcagggcctatgccggtgacccattcttcagctgcccagcgaagaggacggattggtaggaatccaaagaacgaaaatgaccagtacatctacatgggcgagccccttgaaaacgatgaggactgcgcacactggaaagaagccaagatgctgctcgataatataaacactcctgaggggatcattccctccatgttcgagccagaacgcgagaaagtcgacgctatcgatggagaatatagattgaggggcgaggcccggaagacatttgtggacctgatgcgtcgcggtgatctccctgtatggctggcgtaccgagtggcagccgaagggattaattatgctgacagaaggtggtgtttcgatggcatcaaaaacaaccaaatacttgaggagaatgttgaagtcgagatttggaccaaggaaggagagcggaagaaactaaagccccgctggctggacgccagaatctacagtgatccattggctttaaaagagtttaaggagttcgcagccggcaggaaaagcctgacactcaacctgattactgagatggggcggcttcctacgttcatgacccagaaggctcgaaatgccctggacaacctcgcagtgttgcatacagcggaagccggaggtagagcttataatcacgccctgtcggagctaccggaaactctggagaccctccttctgttaacattgctggcaaccgtgactggcgggatctttctcttcctgatgtctggaaagggcataggtaaaatgacgcttgggatgtgctgcatcattaccgcttccatcctgctctggtacgcccagattcagccccactggatcgcagccagcataattttggagtttttcctgatcgtcttactaatcccagaacctgagaagcaacgcacaccccaggataaccagctgacttatgttgtgattgctatcctcaccgtagtggcggccacaatggcaaatgaaatgggctttcttgagaaaaccaagaaagacttcggactgggctcaatagctactcagcaaccagaaagtaacattttggacatcgatctgaggcctgcctctgcctggacactctacgcagtcgctacgacctttattactcccatgctgcggcattccatcgagaatagctcagtgaacgttagtcttacagccatagcgaatcaggctaccgtgctcatggggctgggaaagggttggccgttgagcaagatggacatcggcgtcccactgttagccattgggtgttactcccaggtaaaccctatcaccctaacagcagccctgctccttctggtggctcactatgcaattatcggacccggcttgcaggccaaagcgactcgtgaggctcaaaagagagccgcagccggtattatgaaaaatccaacggttgatgggatcaccgtgatagacctggatcccattccttacgacccgaagttcgaaaaacagctcggccaggtcatgctgcttgtgttatgcgtcacacaggtgctgatgatgaggactacctgggctctctgtgaggccttgacactggcaaccggacccatctctactctatgggaaggcaacccagggcgcttttggaatacgacaatcgctgttagcatggccaacattttccggggatcctatctggcgggcgccggtctcctattttcaataatgaagaataccgcaaacactcgaagagggaccggaaacacaggcgagactctgggtgaaaagtggaaaaataggttgaacgctctgggcaagtctgagttccaaatctacaaaaagagtgggattcaggaggtggatcgcaccctcgccaaagaaggaatcaagcggggcgagacagaccatcacgcagtatcgagagggagcgctaaactgcgttggtttgtggaaaggaatttagtcacgcctgagggaaaggttgtggatcttggctgcggtagagggggatggtcctattactgtggcggtctgaagaacgtcaaagaggtgaagggcctcaccaaagggggacccggccatgaggaacctattccaatgtctacttatgggtggaatctagtacgcctgcagtcaggagtggacgttttcttcacaccccctgaaaagtgcgataccttgctgtgtgacatcggcgagagctccccaaaccccactgtggaagccggtcgaacactcagagtccttaatctggtggagaactggttgaataacaatacccaattttgcataaaagtcctgaacccgtacatgcctagtgtgatcgagaagatggaagccctccagaggaagtacgggggagcgttagttcggaatccactgtctcgcaacagcacgcacgagatgtattgggtatcaaatgcttccggcaacattgtgagtagcgtcaacatgatctctagaatgcttattaataggttcaccatgcgacacaaaaaggcaacatacgaacccgatgtggacctgggctccgggactcggaacatcggaatagagtcagaaattcctaatctagacgttatcggtaaacgtatcgagaagattaaacaggagcatgaaaccagctggcactatgatcaggaccatccatacaagacatgggcctatcacggctcgtacgagactaagcaaaccgggtctgctagttccatggtgaacggagtcgtgagactcctgacaaaaccctgggatgtaataccgatggtgacccagatggccatgactgacacgacaccttttggccagcagcgcgttttcaaggaaaaagtcgataccaggactcaagagcccaaggaaggtaccaaaaagttgatgaagatcacagcagagtggctgtggaaagagctcgggaagaaaaagacgccacggatgtgtaccagagaagagtttactcgcaaagtgaggagcaatgccgctcttggagcgatttatacagacgaaaacaagtggaaatcagcccgagaggcagtggaggattcccggttctgggaactggtcgacaaggagagaaatttacacctggaaggcaagtgcgagacctgtgtttacaacatgatgggcaaaagggaaaagaaattgggggagtttggaaaggctaaaggttctcgcgccatctggtacatgtggctcggcgcacgtttcctggagtttgaagccctagggttccttaatgaggatcattggtttagccgggaaaacagtctgtccggagtggagggcgaaggtctccacaagctggggtatattttgagagacgtaagcaagaaagagggaggcgctatgtacgccgatgacactgcgggctgggacacaaggatcaccctggaggatctcaagaatgaagagatggtgacaaaccatatggaaggggagcacaagaaacttgcagaagccatattcaaactgacttatcagaataaagtcgtgcgcgttcagcgacctacaccccggggaacggtgatggacatcatttctagaagggatcagcgcggttcaggccaagtcgtgacctacgggttaaacacatttactaatatggaggctcagctgatcagacagatggagggagaaggcgtattcaagagtattcaacatttgaccgttacagaggaaatcgccgtgaaaaactggctcgcacgggtcggtagggagcgtctgtcccgaatggctattagcggggacgattgcgtggtgaagccactagacgatcgcttcgcctctgctcttactgccctgaacgacatgggaaaagtcagaaaggatatacagcagtgggagccctcgcggggctggaatgactggacccaggttcctttttgctcacaccacttccatgaactcatcatgaaagatggcagggtgctggtagtgccatgtcgcaaccaagacgagttgattgggagagcacggatcagccagggagcgggttggtccttaagggaaacggcctgcctgggcaagagttatgctcagatgtggtctctcatgtactttcaccgacgtgatcttagactggccgcaaatgctatctgtagcgccgtcccgtcccattgggtgcccacatcacgcaccacttggagtattcacgcaacacacgagtggatgaccactgaagacatgctaaccgtttggaaccgggtgtggatacaggagaatccttggatggaggacaagacaccagtcgaatcttgggaggaaatcccctatctggggaaaagggaggatcaatggtgcggaagcctcattggcttgacgtccagagccacctgggcgaagaacatccagactgctattaatcaggtgcgctcactgatcggtaacgaagagtacacagactacatgcctagcatgaaacggttcaggcgagaggaagaggaagccggggtactttggtga

SEQ ID NO: 15009 - RNA, 9876 nt, synthetic construct
  misc_feature 1..9876: note = derived and/or modified CDS sequence (opt3) from DENV-2__GQ398264__SS-prME
  source 1..9876: mol_type = other RNA
accgccggcatgatcattatgatgatacccacagtgatggctttccacctgactacgagaaacggggagcctcatatgatcgtcagcaggcaggaaaagggaaaatccctcctttttaagaccgagaatggtgttaacatgtgcacactgatggcaatggacttgggcgaattatgtgaggatactattacctacaattgcccactgctacggcaaaacgaaccggaggacatcgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggattgagacttgggtgcttcggcatcctggattcaccatcatggcagccatactggcttacacaatcggcaccacgtattttcagcgcgttttgattttcatcctcctgactgcagtggccccatctatgacaatgagatgcattggcatctcgaacagggactttgtcgaaggggtgtcaggaggtagctgggtagatatagttctggagcacggcagttgtgtgaccactatggctaaaaataagcccacactcgacttcgaattaattaagaccgaggccaaacaccctgcgacgctgcggaagtactgcatcgaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcattgtgacttgcgctatgtttacctgcaagaaaaatatggaggggaaggtcgttcagcctgaaaacctagagtatacaatcgtgatcaccccacactccggagaagagaatgccgtaggtaacgatactggcaaacatgggaaggagattaaaataacgccgcagtcaagtatcacagaagcagagctcaccggatacggcactgtgaccatggaatgtagccccaggacaggtctggacttcaatgagatggtccttctgcagatggaaaacaaggcttggttggtgcaccggcaatggtttctcgatctgcctttaccatggctgcccggggccgacacccagggctctaactggattcagaaagagactctcgttacattcaagaatcctcacgcgaagaaacaggatgtggtcgtgcttggatcccaagagggcgccatgcatacggcactgaccggggctactgaaatccagatgtcaagcggaaacttgctatttacaggtcacctgaagtgccgtctccgcatggacaaactgcagcttaagggcatgagttattctatgtgtaccgggaaattcaaggtagttaaggagatagccgaaacacaacatggaactattgtgatcagagtccagtacgagggcgacggttccccatgcaaaatccccttcgagattatggatctggaaaagaggcacgtgttggggcggctcatcaccgtcaatccgattgtgacggagaaagacagccctgttaacatagaagctgagcccccatttggcgattcgtacatcattatcggagtggaacctggccagctgaagttatcttggttcaaaaaggggtcctcaatcggacagatgtttgagaccacaatgcgaggtgccaagcgcatggcaattctgggcgacactgcctgggatttcgggagtctaggaggcgtatttaccagcataggtaaagctctccatcaagtcttcggggcgatctatggcgcagccttttccggagtgtcttggacaatgaagattctgatcggcgttgtgattacttggatcgggatgaatagcagatcaaccagtctttccgtcagcttggtgctggtaggagtggttacgctctacctgggcgtcatggtgcaggctgactctggttgtgtggtctcatggaaaaacaaggagcttaaatgcgggagtggaatattcatcacagataatgttcacacctggactgaacagtataagtttcagcccgagagcccatccaagctggcctctgcaattcaaaaagcccacgaagagggcatctgtggtattaggtcggtgacacggttggaaaacctcatgtggaagcagatcacccccgagctgaatcatatattaagcgagaacgaagtgaaactgactattatgaccggcgacatcaaggggattatgcaggctggaaaacgctccctaagacctcagccaacagagctcaagtactcatggaaaacgtggggcaaggccaagatgctgagtaccgaacttcacaatcatactttcttgatcgatgggccggagacagcagaatgccccaacaccaatagggcgtggaactctctggaggtagaggactatggatttggcgtcttcacaactaatatatggctcaaactgaaggaacgtcaagatgtgttttgtgacagcaaattaatgtccgctgccatcaaggacaaccgggcagttcacgccgatatgggttactggattgagtcagctctgaacgacacctggatgatcgaaaaagccagcttcattgaggtgaagtcttgccactggcctaagtcccatacgctttggagtaatggggtcttggagagcgaaatgatcataccaaaaaacttcgcaggacccgtgtctcagcacaattatcgacctggctaccatacacagaccgctggtccatggcagctcggcaagctggagatggattttgacttctgtgaagggactaccgttgtggtaacagaggattgcggaaacagaggcccctccctaaggactaccacagcctcagggaaactgattacggaatggtgctgtcgcagttgcaccctcccgcctctgcggtacagaggagaggacggctgttggtatggtatggagatcaggccacttaaggaaaaagaggaaaatttggtcaacagcctggtgactgcggggcacggacaaatcgataatttttcgttaggcgtgctcggtatggccctgttccttgaggaaatgctgcgcacacgagtcggcaccaagcatgctattttgctcgttgcagtgtcctttgtaactctgatcacagggaacatgtctttccgggacctaggacgtgtgatggtcatggtgggcgccaccatgacggatgacattgggatgggagttacttacctggctctcctggccgcatttaaggtgagacccaccttcgcggccggccttttgctgaggaaattaacaagcaaggagctcatgatgaccactataggtatcgtcctgctttcacagagtacaattcctgagaccatcctggaactaacagatgctctcgccctggggatgatggtgttgaaaattgttcgcaatatggagaagtatcagctggcagtgactatcatggctatattatgcgtccccaacgccgtaatcctccaaaatgcatggaaagtgtcctgtaccacgctggccgttgtgtctgtcagcccacttctgttgacatcctcacagcagaaggctgactggattcctctcgcgctgaccatcaagggactaaaccccactgccatttttctgaccacacttagccggactagtaaaaagagatcttggccactcaatgaagcaatcatggctgtgggcatggtatccatactggccagctcgttgctgaaaaacgatattccgatgaccggccctttagtggccgggggactcctgacggtctgctacgttcttacaggtaggtcagctgacctggagttggaacgagcagccgacgtgcgctgggaggatcaggcggagatctctggcagttcccccatcctcagcattaccatatctgaagacgggagcatgtccatcaagaatgaggaagaggagcaaactctgacaattctaatccggaccggactgcttgtgatttcaggcctcttcccagtcagtatccccataactgctgccgcatggtatctgtgggaagtgaaaaagcagagagccggtgttttgtgggatgtacctagcccaccccctgtggggaaagctgagttagaagacggagcatacaggatcaagcagaagggcattctgggctattctcagatcggggccggagtctacaaagagggtacatttcacaccatgtggcacgtgacgcgtggcgcggttctcatgcataaggggaaacgcattgaaccgtcctgggctgatgtgcggaaggacctgatctcatacggaggcggttggaaacttgagggggagtggaaggaaggagaggaagtccaagtgctggccttggagccaggcaagaaccccagagcagtacagactaaacctggcctattcaagaccaacacagggaccataggagccgtcagtctggattttagcccaggtacatccggctctcccattgtggacaaaaaggggaaagttgtgggactctatggcaatggtgtcgtgactaggtcggggacctacgttagcgctatcgcccagacggaaaagtcaatcgaggataaccctgagattgaagacgatatcttccgaaagaaacggctgacaataatggaccttcacccgggagcaggcaagactaaacgctatttacccgctattgtgagagaggccatcaagaggggcctgcggaccctcattttggcgccaacacgagtcgtggccgcagaaatggaggaagctctgagagggctccctatccgctaccagacccccgccataagggctgagcatactggacgtgagattgtagatctgatgtgtcacgcaaccttcacaatgcggcttctgtccccagtgagagttcctaattataacttgatcatcatggacgaagcccattttacggaccccgccagtattgctgcgaggggttacatctctactcgcgtcgagatgggcgaagcagccgggattttcatgaccgctacaccaccgggaagccgagatccttttccccaatccaatgccccaataatggacgaggagagagaaatccccgagcggtcatggaactctggccacgaatgggtgaccgatttcaaaggtaagactgtgtggtttgtccctagcattaaggcagggaatgacatcgccgcttgcctaaggaaaaacggaaagaaagtaatccagctgagtcgcaagacattcgattccgagtatattaaaacccgtacgaatgactgggattttgtggttactacagacataagcgaaatgggcgcgaacttcaaggccgagagagtgatcgatccacggaggtgtatgaagcccgtcattctcaccgacggcgaggaacgcgtgatcttagcagggcctatgccggttacccactcttcagctgcccagcgaagaggacgggtgggtaggaatccaaaaaacgagaatgatcaatacatttacatgggcgaacccctggagaacgacgaagactgcgcacattggaaggaggccaaaatgcttctggataatatcaacactcctgaggggataatcccctccatgtttgaaccagagcgcgaaaaggtcgacgctattgatggagagtatagactcaggggcgaagcccggaaaacattcgtggacttgatgcgtcgcggtgatctgcctgtatggctcgcgtaccgagtggcagccgaggggatcaactatgctgacagaaggtggtgttttgatggcgttaagaataaccagattctggaggaaaatgtcgaggtggaaatctggaccaaagagggagagcggaagaagcttaaaccccgctggctagacgccagaatatacagtgatccactggctttgaaggaattcaaagagttcgcagccggcaggaagagcttaacactgaacctcattactgaaatggggcggctgcctacgtttatgacccagaaagctcgaaatgcccttgacaacctggcagtgctccacacagcggaggccggaggtagagcttataatcatgccttgtcggaactgccggagactctagagaccctgctccttctgacattattggcaaccgtcactggcgggatcttcctgtttctcatgtctggaaagggcattggtaagatgacgctggggatgtgctgcatcataaccgcttccatccttctgtggtacgcccagattcaaccccactggatcgcagccagcattatcctcgaattctttttgatagttctgttaattccagagcctgaaaaacagcgcacaccccaggataaccagctaacttatgtggtaatcgctatcctgaccgtggtcgcggccacaatggcaaatgagatgggcttcctcgaaaagaccaaaaaggactttggacttggctcaactgctacacaacagccagagagtaacattctggatatcgacttgaggcctgcctctgcctggacgctgtacgcagtggctaccactttcataacacccatgctccggcactccattgagaatagctcagttaacgtgagtctgaccgccatcgcgaatcaggctaccgtccttatggggctcggaaaaggttggccgctgagcaagatggacattggcgtaccattgctggccatcgggtgttactcccaggtgaaccctataacattaactgcagccctactgctccttgttgctcattatgcaatcattggacccggcctgcaagccaaggcgacgcgtgaagctcagaaaagagccgcagccggtatcatgaagaatccaaccgtggatgggattacagtcatcgacttggatcccattccttacgacccgaaatttgagaagcagctgggccaggtgatgctcctggtcctttgcgtgactcaagttttaatgatgaggaccacatgggctctgtgtgaagccctcaccttggcaactggacccatctctacgctgtgggagggcaacccagggcgcttctggaatacaaccatagctgtgagcatggccaacatttttcggggatcctatctagcgggcgccggtctgctcttctcaatcatgaaaaacactgcaaatacccgaagagggacaggaaacactggcgaaacccttggtgagaagtggaagaataggctgaacgctttgggcaaatctgagtttcagatctacaagaaaagtgggattcaggaagtagatcgcacactggccaaggagggaataaaacggggcgaaacggaccaccatgcagtgtcgagagggagcgctaagctccgttggttcgtcgagaggaatctggttacccctgagggaaaagtggtcgatttaggctgcggtcgggggggatggtcctattactgtggcggtcttaagaacgtgaaggaagtaaaaggcctgactaaggggggacccggccacgaggaacctatcccaatgtctacatatgggtggaatctcgtgcgcctacaatcaggagttgacgtgttctttaccccccctgagaaatgcgatactctgttgtgtgacattggcgaaagctccccaaaccccacagtcgaggccggtcgaaccctgagagtgctcaatcttgtcgagaactggctgaataacaatacgcagttctgcatcaaggtgttgaacccgtacatgcctagtgttattgaaaaaatggaggccctgcagaggaagtacgggggagcgctcgtacggaatccattatctcgcaacagcacccatgaaatgtattgggtgtcaaacgcttccggcaatatcgtcagtagcgtgaacatgatatctagaatgctgatcaataggtttacaatgcgacacaagaaagcaacttacgagcccgatgttgaccttggctccgggacccggaacattggaatcgaatcagagacacctaatctggatattatcggtaagcgtatagagaaaattaagcaggaacacgagactagctggcattatgaccaagaccacccatacaaaacctgggcctatcatggctcgtacgaaacaaagcagaccgggtctgctagttccatggtgaacggagtcgtgagactactcactaagccctgggatgtaatcccgatggtgacgcagatggccatgacagacaccactcctttcggccagcaacgcgtttttaaagagaaggtcgataccaggacacaggaacccaaagagggtacgaagaaactgatgaagatcaccgcagagtggttgtggaaggaactggggaaaaagaaaactccacggatgtgtacaagagaggaattcacccgcaaggtgaggagcaatgccgctctcggagcgatttttactgacgagaacaaatggaagtcagcccgagaggcagtggaagattccggcttctgggagcttgtcgacaaagaacggaatctgcacttagagggcaagtgcgaaacatgtgtttataacatgatggggaagagagagaaaaagctgggagagtttggtaaagctaagggctctagggccatatggtacatgtggttgggggcacgcttcctcgaatttgaggccctgggattcctaaatgaagatcactggtttagccgtgagaacagtctttccggcgtggaaggtgaggggctgcataaactcggatacatcctgcgggacgtaagcaagaaggagggcggcgctatgtatgccgatgacaccgcggggtgggatacaagaattactttggaagacctgaaaaatgaggaaatggtgaccaaccacatggagggagaacataagaaactcgcagaggccatcttcaagcttacgtaccagaataaagtcgtgagggttcagcgccctaccccccgaggtacagtgatggacattatctctcggagagatcaaaggggctcagggcaggtcgtgacttatggactgaacaccttcacaaacatggaggctcagttaatacgccaaatggaaggcgagggtgtatttaagagtatccagcacctgactgttaccgaagagattgccgtgaagaattggttggcaagagtcgggcgggagaggctctcccgtatggctatcagcggagacgattgcgtggtgaaaccactggacgatcgattcgcctctgctctaacggcccttaacgacatgggcaaggtccgcaaagatattcagcagtgggaaccctcgagaggctggaatgactggacacaagttcctttttgctcacatcacttccacgagctgatcatgaaggatgggcgggtgctcgtagtgccatgtaggaaccaggacgaactgattggacgcgcaagaataagccagggtgcgggctggtccttgcgggagaccgcctgcttagggaaaagttacgctcagatgtggtctctgatgtattttcataggcgagatctccgtcttgccgcaaatgctatctgtagcgccgtcccgtcccactgggtgcccacttcaagaacaacctggagtattcatgcaactcacgaatggatgaccacagaggacatgctgacggtttggaaccgcgtgtggatccaagagaatccttggatggaagataagaccccagtcgagtcttgggaagagatcccctacctaggaaagcgggaagaccagtggtgcggcagcctgattggtctcacttccagggccacatgggcgaaaaacatacagaccgctatcaatcaggtgagatcattgattgggaacgaggagtatactgactacatgcctagcatgaagcgcttccggagggaagaggaagaggccggagtactgtggtga

SEQ ID NO: 15010 - RNA, 9876 nt, synthetic construct
  misc_feature 1..9876: note = derived and/or modified CDS sequence (opt3) from DENV-2__GQ398260__SS-prME
  source 1..9876: mol_type = other RNA
accgccggcatgatcattatgctgatacccactgtgatggctttccacctcactacgaggaatggggaacctcatatgatcgtcagcaggcaggaaaagggaaaatcccttctgtttaagaccgaagacggtgttaatatgtgcaccttgatggcaatggatttaggcgaactgtgtgaagacactattacctacaattgcccactactccggcaaaatgaaccggaagatatcgactgttggtgcaactctacctcaacctgggtgacttatgggacatgtaccgccacgggagagcaccgccgagaaaaacgtagtgtggcgctggtgccccatgtcggcatgggtcttgagactagaaccgaaacatggatgagctccgagggggcttggaagcacgcccagaggattgagacttggatcctgcggcatcctggattcaccataatggcagccatcttggcttacacaattggcaccacgtattttcagcgcgtgctcatcttcattctgctgactgcagttgccccatctatgacaatgagatgcatcggcatatcgaatagggattttgtggaaggggtctcaggaggtagctgggtggacattgtactcgagcacggcagttgtgttaccactatggctaaaaacaagcccacattagatttcgaactgatcaagaccgaggccaaacagcctgcgacgcttcggaagtactgcattgaagcaaaattgaccaatacaactaccgcctcccgctgtccaacacaaggggagccctctctgaacgaggaacaggacaagcgatttgtgtgcaaacacagcatggtcgatagaggatggggcaatggttgtgggctattcggaaagggcggcatcgtgacttgcgctatgtttacctgcaagaaaaacatggaggggaaggtggtccagcctgaaaatctcgagtatacaatcgttattaccccacattccggagaagagaacgccgtgggtaatgacactggcaaacacgggaaggagataaaaatcacgccgcagtcaagtattacagaagcagagctgatcggatacggcaccgtaactatggaatgtagccccaggaccggtcttgatttcaacgagatggtgctgttgcaaatggaaaataaggcttggctcgtccatcggcagtggtttctggacttacctctgccatggctccccggggccgatacacagggctctaactggatacagaaagagacccttgtgactttcaagaaccctcacgcgaagaaacaagacgttgtggtcctgggatcccaggagggcgccatgcacacagcattgacgggggctaccgaaattcagatgtcaagcggaaatctactgtttactggtcatctcaagtgccgtctgcgcatggacaaacttcaactgaagggcatgagttattctatgtgtacagggaaattcaaggtggtaaaggagatcgccgaaacccagcacggaacaatcgttattagagtgcagtacgagggcgatggttccccatgcaaaatccccttcgagattatggacttggaaaagaggcatgtcctcgggcggctgataactgtgaacccgatcgtcaccgagaaagatagccctgtgaatattgaagctgagcccccatttggcgactcgtacatcatcattggagttgaacctggccagttaaagctgaactggttcaaaaaggggtcttccataggacaaatgtttgagacgaccatgcgaggtgccaagcgcatggcaatcctaggcgatacagcctgggacttcgggtcactcggaggcgtgtttacaagtattggtaaagctctgcaccaggtattcggggcgatctatggcgcagcctttagcggagtctcctggaccatgaagattcttatcggcgtggttataacatggatcgggatgaactctagaagcacttcattgagtgtgtccctggtcctcgtgggagtagtgaccctgtaccttggcgttatggtccaggctgatagcggttgtgtggtgtcttggaaaaacaaggagctgaaatgcgggtcaggaattttcgtcacggacaatgttcatacatggaccgaacagtataagtttcaacccgagagtccaagcaagttggcctccgcaatccagaaagcccacgaagagggcatttgtggtatcaggtctgtgactcggctcgaaaacctgatgtggaagcagataacacccgagttaaatcacattctgtcggagaacgaagtgaaactaaccatcatgactggcgatattaaggggatcatgcaggctggaaaacgcagcctcagacctcaaccaaccgagctgaagtactcctggaaaacatggggcaaggccaagatgctttcaacggaattgcataatcagaccttcctgatagacgggccggagactgcagaatgccccaacacaaatagggcgtggaacagtctcgaggtagaggattatggatttggcgtcttcaccacaaatatctggctgaaattaaaggaacgtcaggacgtgttttgtgactctaaactgatgagcgctgccattaaggataaccgggcagttcacgccgacatgggttactggatcgagtccgctcttaacgatacttggaaaattgaaaaggcctcattcatcgaggtaaagagctgccattggcctaaatctcacaccttgtggtccaatggggtcctcgagagtgaaatgataattccaaagaacttcgcaggacccgtgagccagcacaattatcgacctggctaccatacgcaaacagctggtccatggcacctgggcaaactagagatggactttaacttctgtgaagggaccactgttgtggtaaccgaggattgcggaaatagaggcccctctctgaggacaactaccgcctccgggaagctcatcacagaatggtgctgtcgctcatgcacgctgccgcctcttcggtacagaggagaggacggctgttggtatggtatggagatcaggccattgaaagaaaaggaggaaaacctggtcaatagtttagtgaccgcggggcatggacagattgataactttagcctcggcgtgctgggtatggcccttttcctggaggaaatgttgcgcactcgagtcggcacaaagcacgctatcctcctggttgcagtgtcgtttgtaaccctaattactgggaatatgtccttccgggacctgggacgtgtgatggtcatggtgggcgccacaatgaccgatgacatagggatgggagttacgtacctcgctctgcttgccgcatttaaagtgagacccactttcgcggccggcttgctgttaaggaagctcacctctaaagagctgatgatgacaaccatcggtattgtccttctgagccagtcaactatccctgagacaattctagaactcaccgatgctctggccttggggatgatggtgctgaagatcgttcgcaacatggagaaatatcaattagcagtgacaataatggctatcctctgcgtccccaatgccgtaattctgcagaacgcatggaaggtgagttgtactatccttgccgttgtgtccgtctctccactgttgctcaccagctcccagcagaaggctgactggattcctctggcgctaacgatcaaaggactgaatcccacagccatatttcttaccactctctcacggaccagcaagaaaagaagttggccactgaacgaagcaattatggctgtgggcatggtatctatcttggcctccagcctgttaaagaatgatatcccgatgacaggccctctcgtggccgggggactgcttactgtctgctacgttctgaccggtaggtcggctgacttggagctcgaacgagcagccgacgtgcgctgggaggatcaagcggagatttcaggctctagtcccatactgtccatcacgattagcgaagacgggtctatgagcatcaaaaacgaggaagaggagcagacactaaccattctgatccggactggacttctcgtgatatccggcctgttcccagtctcaatccccattacagctgccgcatggtatttgtgggaagtgaagaaacagagagccggtgttttatgggatgtacctagtccaccccctgtggggaaggctgagctggaagacggagcatacaggatcaagcagaaaggcattctcggctatagccaaatcggggccggagtctacaaggagggtacctttcatactatgtggcacgtgacacgtggcgcggttctgatgcacaaagggaagcgcatagaaccgtcttgggctgatgtgaaaaaggaccttatttcctacggaggcggttggaagctggagggggagtggaaagaaggagaggaagtccaggtgttggccctagagccaggcaagaacccccgggcagtacagaccaaacctggcctgttcaagacgaatactgggaccatcggagccgtctcactcgattttagtccaggtacaagcggctcccccatcgtggacaaaaaggggaaggttgtgggactgtatggcaacggtgtcgtgaccagatctgggacatacgtttcggctattgcccagactgagaaaagcatcgaggataatcctgagatagaagacgatattttcaggaagaaacgacttaccatcatggacttacatccgggagcaggcaagacgaaacggtatctgcccgctattgtgcgcgaggccatcaagagaggcctcaggacattgatactggcgccaactcgggtcgtggccgcagaaatggaggaagctctccgagggctgcctattagataccaaacccccgccatccgcgctgagcacacaggaagggagatcgtagatcttatgtgtcatgcaaccttcactatgcgtctgttgtcaccagtgcgggttcctaactataatctaattatcatggacgaagcccactttaccgaccccgcctccattgctgcgagaggttacataagtacaagggtcgagatgggcgaagcagccgggatcttcatgacggctactccaccgggatctcgcgatccttttccccagagcaacgccccaattatggacgaggagcgagaaatccccgagagatcctggaactcaggccatgaatgggtgaccgatttcaagggtaaaacagtgtggtttgtcccttctatcaaggcagggaacgacattgccgcttgcctgcggaaaaatggaaagaaagtaatacagctcagcaggaagaccttcgatagtgagtatatcaagactcgcacaaacgactgggattttgtggttaccacggacatttccgaaatgggcgcgaatttcaaagccgagcgtgtgatcgatccaagacggtgtatgaagcccgtcattttaactgacggcgaggaaagggtgatcctggcagggcctatgccggttacacacagctctgctgcccaacgccgaggaagaataggtcggaaccccaaaaatgagaacgatcagtacatctacatgggcgaaccccttgagaatgacgaagactgcgcacactggaaggaggccaaaatgctgctcgataacattaacacccctgaggggatcattccctcaatgtttgaaccagagagggaaaaggtggacgctatcgatggagagtatcgcttgagaggcgaagccaggaaaaccttcgtcgacctgatgcggcgtggtgatctccctgtgtggctggcgtaccgcgtagcagccgaggggataaattatgctgaccgaagatggtgttttgatggcattaagaacaatcagatccttgaggaaaacgtggaggttgaaatttggactaaggagggagagaggaaaaagctaaaaccccggtggctggacgcccgcatctactccgatccattggctttaaaggagttcaaagagttcgcagccggcagaaagagtctgacactcaatctgataaccgaaatcgggaggcttcctacatttatgactcagaaggctcggaacgccctggacaatctcgcagtcttgcatacggcggaggccggaggtcgagcttataaccacgccctgagcgaactaccggagaccctggagacactccttctgttaactttgctggcaaccgtgacaggcgggattttcctctttctgatgtcgggaaaaggcatcggtaagatgacccttgggatgtgctgcattatcactgcttctatactgctctggtacgcccaaattcagccccattggatcgcagcctccatcattttggagttctttctgatcgtgttactaataccagagcctgaaaaacagagaacgccccaggataatcaactgacctatgtcgttattgctatcctcacagtggtagcggccactatggcaaacgagatgggcttccttgaaaagaccaaaaaggactttggactgggcagcattgctacacagcagccagagtcaaatatcttggatatagacctgcgccctgccagtgcctggaccctctacgcagtggctactacattcatcacgcccatgctgaggcactctattgagaactccagcgtcaatgtgtcacttaccgccatcgcgaaccaggctactgttctcatggggctgggaaagggttggccgttgagtaaaatggacattggcgtgccactgttagccatcgggtgttacagccaagtcaatcctattacactaaccgcagccctgctccttctggtagctcactatgcaatcataggacccggcttgcaggccaaggcgacccgggaagctcagaaacgtgccgcagccggtattatgaagaacccaacagtggatgggatcactgttatcgacctggatcccattccttacgacccgaaatttgagaagcagctcggccaagtgatgctgcttgtcttatgcgtgacgcaggtcctgatgatgagaaccacatgggctctctgtgaagccttgactctggcaaccggacccatatccacactatgggagggcaatccagggaggttctggaacaccactatcgctgtgtctatggccaacatttttcgcggaagctatctggcgggcgccggtctccttttctccatcatgaagaatacggcaaacacacggcgagggaccggaaatactggcgaaaccctgggtgagaaatggaagaacagattgaatgctctgggcaaatcagagtttcagatttacaagaaatctgggatccaagaagttgataggacactcgccaaggagggaataaaacgcggcgaaactgaccatcacgcagtgagtcgggggtcggctaagctgagatggttcgtagagcgtaacttagtgacccctgagggaaaggtcgttgatcttggctgcggtagagggggatggagctattactgtggcggtctgaaaaatgtgcgggaagtcaagggcctcacaaaagggggacccggccatgaggaacctatcccaatgtccacgtatgggtggaacctagtgcgcctgcagtctggagtagacgtgttctttacaccacctgagaagtgcgatactttgctgtgtgacattggcgaatcaagcccaaatcccacaatcgaggccggtcgaaccctcagagttcttaacctggtggagaattggttgaacaataacactcagttctgcattaaagtcctgaatccgtacatgccttccgtgatcgaaaagatggaggccctccagaggaagtacgggggagcgttagtccggaacccactgagtcgcaactctacacacgaaatgtattgggtgagcaatgcttcaggcaacatagtttccagtgtaaatatgattagcagaatgcttatcaacaggtttaccatgcgacataaaaaggcaacgtacgagcccgatgtggacctgggctctgggacccggaatatcggaattgaatccgagacacctaacctagatataatcggtaaacgtattgagaagatcaaacaagaacacgagacttcatggcactatgaccaggaccatccatacaagacctgggcctatcacggcagctacgaaacaaagcagactgggtcggcttctagtatggtcaatggagtggttagactcctgaccaaaccctgggatgtgattccgacagtcacccagatggccatgactgacacgacacctttcggccaacagcgcgtgtttaaggagaaagtagataccaggactcaggaacccaaggagggtaccaaaaagttgatgaagatcacagcagagtggctgtggaaagaactcgggaagaaaaagacgccacggatgtgtaccagagaggagttcactcgcaaagtgaggtccaacgccgctcttggagcgatatttacagacgagaataagtggaaaagcgcccgagaggcagttgaagattcacggttctgggagctggtcgacaaggaaagaaacttacatctggagggcaagtgcgaaacctgtgtgtataatatgatgggcaaaagggagaagaaattgggggagtttggaaaggctaaaggttcccgcgccatctggtacatgtggctcggcgcacgtttcctggaatttgaggccctagggttccttaacgaagatcactggttttctcgggagaatagcctgagtggagtggaaggcgagggtctccacaagctggggtacattttgagagacgtctccaagaaagagggaggcgctatgtatgccgatgacactgcgggctgggatacaaggatcaccctggaagacctcaagaacgaggaaatggttacaaatcatatggagggggaacacaagaaacttgcagaggccattttcaaactgacttaccagaacaaggtggtacgcgtgcaacgacctacaccccggggaacggtcatggacatcattagcagaagggatcagcgcggttctggccaggtggggacctatggattaaacacattcactaatatggaggctcaactgataagacagatggaaggcgagggtgtttttaagtcaatccagcatttgaccgtgacagaagagattgccgtccagaactggctcgcacgggtggggagggagcgtctgagtcgaatggctatctccggagacgattgcgtagttaaaccactagacgatcgcttcgccagcgctcttactgccctgaatgacatgggcaaggtgagaaaagatatccaacagtgggaaccctctcggggctggaacgactggacccaggtccctttttgctcgcaccatttccacgagctcattatgaaggatgggagggtgctggtggtcccatgtcgcaatcaggacgaattgataggtagagcacggatctcacaaggagcgggctggagcttaagggagacggcctgcctggggaaatcctacgctcagatgtggagtctcatgtattttcaccgacgtgatcttagactggccgcaaacgctatttgttctgccgttccgagccattgggtgcccacatcccgcaccacttggtcaatccacgcacggcatgaatggatgacaaccgaggacatgctaactgtatggaatagggtgtggattcaggagaacccttggatggaagataagaccccagtcgagagttgggaagagatcccctacctgggaaagagagaagaccagtggtgcggctctctcataggtttgacaagccgcgccacgtgggcgaaaaatatccaaaccgctattaaccaggtgcggtccctgatcgggaatgaggagtatactgactacatgccttcaatgaagaggttccgaagagaagaggaagaggccggagttctttggtga

SEQ ID NO: 15011 - RNA, 9876 nt, synthetic construct
  misc_feature 1..9876: note = derived and/or modified CDS sequence (opt3) from DENV-2__GQ398262__SS-prME
  source 1..9876: mol_type = other RNA
accgccggaatgatcattatgctgatacccacagtgatggctttccacctcactacgcgaaatggggaacctcatatgatcgtcagcaggcaggaaaagggaaaatcccttctgtttaagaccgaagacggtgttaatatgtgcacattgatggcaatggatttaggcgaactgtgtgaagacactattacctacaactgcccattactccggcaaaatgaaccggaagatatcgactgttggtgcaactctacatcaacctgggtgacttatgggacatgtaccgccacgggagaacaccgccgagaaaaacgtagtgtagcgctggtgccccatgtcggcatgggtcttgagactagaaccgaaacatggatgagctccgagggggcttggaagcacgcccagaggattgagacttggatcctgcggcatcctggattcaccataatggcagccatcttggcttacacaattggcaccacgtattttcagcgcgtgctcatcttcattctgctgactgcagttgccccatctatgacaatgcggtgcatcggcatatcgaatagggattttgtggaaggggtctcaggaggtagctgggtggacattgtactcgagcacggcagttgtgttaccactatggctaaaaacaagcccacattagatttcgaactgatcaagaccgaggccaaacagcctgcgacgcttcggaagtactgcattgaagcaaaattgaccaatacaactaccgcctcccgctgtccaacacaaggggagccctctctgaacgaggaacaggacaagcgatttgtgtgcaaacacagcatggtcgatagaggatggggcaatggttgtgggctattcggaaagggcggcatcgtgacttgcgctatgtttacctgcaagaaaaacatggaggggaaggtggtccagcctgaaaatctcgagtatacaatcgttattaccccacattccggagaagagaacgccgtgggtaatgacactggcaaacacgggaaggagataaaaatcacgccgcagtcaagtattacagaagcagagctgaccggatacggcactgtaaccatggaatgtagccccaggacaggtcttgatttcaacgagatggtgctgttgcaaatggaaaataaggcttggctcgtccatcggcagtggtttctggacttacctctgccatggctccccggggccgatacccagggctctaactggatccagaaagagactcttgtgacattcaagaaccctcacgcgaagaaacaagacgttgtggtcctgggatcccaggagggcgccatgcacacggcattgaccggggctactgaaatacagatgtcaagcggaaatctactgtttacaggtcatctcaagtgccgtctgcgcatggacaaacttcaactgaagggcatgagttattctatgtgtaccgggaaattcaaggtggtaaaggagattgccgaaacacagcacggaactatcgttatcagagtgcagtacgagggcgatggttccccatgcaaaattcccttcgagatcatggacttggaaaagaggcatgtcctcgggcggctgattaccgtgaacccgatagtcacggagaaagatagccctgtgaatatcgaagctgagcccccatttggcgactcgtacattatcatcggagttgaacctggccagttaaagctgaactggttcaaaaaggggtcttccattggacaaatgtttgagaccacaatgcgaggtgccaagcgcatggcaatactaggcgatactgcctgggacttcgggtcactcggaggcgtgtttaccagtatcggtaaagctctgcaccaggtattcggggcgatttatggcgcagcctttagcggagtctcctggacaatgaagatccttattggcgtggttatcacttggatagggatgaactctagaagcacctcattgagtgtgtccctggtcctcgtgggagtagtgacgctgtaccttggcgttatggtccaggctgatagcggttgtgtggtgtcttggaaaaacaaggagctgaaatgcgggtcaggaatcttcattacagacaatgtccatacctggactgaacagtataagtttcaacccgagagtccaagcaagttggcctccgcaatccagaaagcccacgaagagggcatttgtggtatcaggtctgttacacggctcgaaaacctgatgtggaagcagataacccccgagttaaatcacattctgtcggagaacgaagtgcgcctaactatcatgaccggcgatattaaagggatcatgcaggctggaaagagaagcctcaggcctcaaccaacagagctgaaatactcctggaagacgtggggcaaagccaagatgctttcaaccgaattgcataatcagactttcctgatagacgggccggagacagcagaatgccccaacaccaatcgtgcgtggaacagtctcgaggtggaggattatggatttggcgtattcacaactaatatctggctgaagttaaaagaacggcaggacgtcttttgtgactctaagctgatgagcgctgccattaaagataaccgagcagtgcacgccgacatgggttactggatcgagtccgctcttaacgatacctggaagattgaaaaagcctcattcatcgaggttaagagctgccattggcctaagtctcacacgttgtggtccaatggggtgctcgagagtgaaatgataattcccaagaatttcgcaggacccgtcagccagcacaattatagacctggctaccatacacaaaccgctggtccatggcacctgggcaagctagagatggactttaacttctgtgaagggactaccgtggttgtgacagaggattgcggaaataggggcccctctctgcgcactaccacagcctccgggaaactcatcacggaatggtgctgtcggtcatgcaccctgccgcctcttagatacaggggagaggacggctgttggtatggtatggagatccgcccattgaaggaaaaagaggaaaacctggtaaatagtttagtcactgcggggcatggacagattgataactttagcctcggcgtgctgggtatggcccttttcctggaggaaatgttgcgaacacgggtgggcaccaagcacgctatcctcctggtcgcagtttcgtttgtgactctaattacagggaatatgtccttccgtgacctgggaagagtaatggtgatggtcggcgccaccatgacggatgacatagggatgggagtgacttacctcgctctgcttgccgcatttaaggttaggcccaccttcgcggccggcttgctgttacgcaaactcacatctaaggagctgatgatgaccactatcggtattgtgcttctgagccagtcaacaatccctgagaccattctagaactcacagatgctctggccttggggatgatggtcctgaaaatcgtgcggaacatggagaagtatcaattagcagttactataatggctatcctctgcgtgcccaatgccgtcattctgcagaacgcatggaaagtaagttgtaccatccttgccgtggtttccgtgtctccactgttgctcacgagctcccagcagaaggctgactggattcctctggcgctaacaatcaagggactgaatcccaccgccatatttcttactaccctctcaagaacaagcaaaaagaggagttggccactgaacgaagcaattatggctgtcggcatggtgtctatcttggcctccagcctgctaaagaatgatatcccgatgactggccctctcgtagccgggggactgcttaccgtgtgctacgtcctgacgggtcgatcggctgacttggagctcgaacgcgcagccgacgttcggtgggaggatcaagcggagatttcaggctctagtcccatactgtccatcacaattagcgaagacgggtctatgagcatcaagaacgaggaagaggagcagaccctaactattctgatcagaacaggacttctcgtgatatccggcctgttcccagtgtcaatccccattaccgctgccgcatggtatttgtgggaagtcaaaaagcagagggccggtgtgttatgggatgttcctagtccaccccctgtagggaaagctgagctggaagacggagcataccgtatcaagcagaagggcattctcggctatagccaaatcggggccggagtgtacaaagagggtacttttcatacaatgtggcacgtcacccgcggcgcggtgctgatgcacaaggggaaacggatagaaccgtcttgggctgatgttaagaaagaccttatttcctacggaggcggttggaagctggagggggagtggaaggaaggagaggaagtgcaggtcttggccctagagccaggcaaaaaccccagagcagtgcagacgaagcctggcctgttcaaaactaataccgggacaatcggagccgtatcactcgattttagtccaggtaccagcggctcccccatcgtcgacaagaaagggaaggtggttggactgtatggcaacggtgtggtcacaaggtctgggacttacgtgtcggctattgcccagaccgaaaagagcatcgaggataatcctgagatagaagacgatattttccggaaaaagagacttacgatcatggacttacatccgggagcaggcaaaacaaagcgctatctgcccgctattgttagagaggccatcaaaaggggcctccggactttgatactggcgccaacccgagtggtcgccgcagaaatggaggaagctctcagagggctgcctattcgctaccaaacacccgccatcagggctgagcacaccggacgtgagatcgtggatcttatgtgtcatgcaactttcaccatgcggctgttgtcaccagtaagagtgcctaactataatctaattatcatggacgaagcccactttacagaccccgcctccattgctgcgaggggttacataagtacgcgcgttgagatgggcgaagcagccgggatcttcatgactgctaccccaccgggatctcgagatccttttccccagagcaacgccccaattatggacgaggagagagaaatccccgagcggtcctggaactcaggccatgaatgggtcacagatttcaagggtaagaccgtgtggtttgtgccttctatcaaagcagggaacgacattgccgcttgcctgaggaagaatggcaaaaaggtcatacagctcagccgcaaaactttcgatagtgagtatatcaagacacgtaccaacgactgggattttgtagtgacgactgacatttccgaaatgggcgcgaatttcaaggccgagagagttatcgatccacggaggtgtatgaaacccgtgattttaacagacggcgaggaacgcgtcatcctggcagggcctatgccggtgacccacagctctgctgcccaacgaagaggacggataggtaggaacccaaagaatgagaacgatcagtacatctacatgggcgaaccccttgagaatgacgaagactgcgcacactggaaagaggccaagatgctgctcgataacattaacacccctgaggggatcattccctcaatgtttgaaccagagcgcgaaaaagttgacgctatcgatggagagtatagattgaggggcgaagcccggaagactttcgtggacctgatgcgtcgcggtgatctccctgtctggctggcgtaccgagtggcagccgaggggataaattatgctgacagaaggtggtgttttgatggcattaaaaacaatcagatccttgaggaaaacgtagaggtggaaatttggacaaaggagggagagcggaagaaactaaagccccgctggctggacgccagaatctactccgatccattggctttaaaagagttcaaggagttcgcagccggcaggaaaagtctgaccctcaatctgataacagaaatggggcggcttcctacttttatgacgcagaaggctcgaaacgccctggacaatctcgcagttttgcataccgcggaggccggaggtagagcttataaccacgccctgagcgaactaccggagacactggagactctccttctgttaaccttgctggcaacagtcaccggcgggatcttcctctttctgatgtcgggaaagggcattggtaaaatgactcttgggatgtgctgcatcattacggcttctatcctgctctggtacgcccaaatacagccccattggattgcagcctccatcatcttggagttctttctgattgtgttactaatcccagagcctgaaaagcagcgcaccccacaggataatcaactgacatatgtggtcatagctattctcactgttgtggcggccaccatggcaaacgagatgggcttccttgagaaaacaaagaaagactttggactgggcagcatcgctacccagcagccagagtcaaatattttggatatcgacctgaggcctgccagtgcctggactctctacgcagtagctacaacgttcataacccccatgctgcggcactctatcgagaactccagcgtgaatgtctcacttactgccattgcgaaccaggctacagtgctcatggggctgggaaagggttggccgttgagtaagatggacatcggcgttccactgttagccattgggtgttacagccaagtgaatcctatcaccctaaccgcagccctgctccttctggtcgctcactatgcaattatcggacccggcttgcaggccaaagcgacacgtgaagctcagaagagagccgcagccggtataatgaaaaacccaactgtagatgggattacggtgatcgacctggatcccatcccttacgacccgaagtttgagaaacagctcggccaagttatgctgcttgtgttatgcgtcacccaggtgctgatgatgaggacaacttgggctctctgtgaagccttgaccctggcaacaggacccatttccaccctatgggagggcaatccagggcgcttctggaacactacgatagctgtctctatggccaacatctttcggggaagctatctggcgggcgccggtctccttttctccattatgaagaatacagcaaacacccgaagagggactggaaataccggcgaaacactgggtgagaagtggaaaaacaggttgaatgctctgggcaagtcagagtttcagatctacaaaaagtctgggattcaagaagtggatcgcactctcgccaaagagggaatcaagcggggcgaaaccgaccatcacgcagttagtagagggtcggctaaactgcgttggttcgtggagaggaacttagtaacacctgagggaaaggtggtcgatcttggctgcggtagagggggatggagctattactgtggcggtctgaagaatgttcgcgaagtgaaaggcctcacgaaagggggacccggccatgaggaacctataccaatgtccacctatgggtggaacctagtccgactgcagtctggagtggacgtattctttactccccctgagaaatgcgatacattgctgtgtgacatcggcgaatcaagcccaaatcccaccgtggaggccggtagaactctcagggttcttaacctggtggagaattggttgaacaataacacacagttctgcattaaggtcctgaatccgtacatgccttccgtgatcgagaaaatggaggccctccagcggaagtacgggggagcgttagtccgcaacccactgagtagaaactctacccacgaaatgtattgggtgagcaatgcttcaggcaacattgtttccagtgtaaatatgatcagcaggatgcttataaaccgatttacgatgcggcataagaaagcaacctacgagcccgatgtggacctgggctctgggacacgtaatattggaatcgaatccgagactcctaacctagatatcattggtaagagaatagagaaaatcaagcaagaacacgagacctcatggcactatgaccaggaccatccatacaaaacatgggcctatcacggcagctacgaaactaagcagaccgggtcggcttctagtatggtcaatggagtggttcgcctcctgacaaagccctgggatgtgattccgatggtcacccagatggccatgactgacacgacacctttcggccaacagagggtgtttaaagagaaggtagatacccggactcaggaacccaaagagggtaccaagaaattgatgaagatcacagcagagtggctgtggaaggaactcgggaaaaagaaaacgccaagaatgtgtacccgcgaggagttcactaggaaggtgcgatccaacgccgctcttggagcgatttttacagacgagaataaatggaaaagcgcccgggaggcagttgaagattcaagattctgggagctggtcgacaaagaaaggaacttacatctggagggcaagtgcgaaacctgtgtgtataatatgatgggcaagcgcgagaaaaagttgggggagtttggaaaagctaagggttcccgtgccatctggtacatgtggctcggcgcacggttcctggaatttgaggccctagggttccttaacgaagatcactggttttctagagagaatagcctgagtggagtggaaggcgagggtctccacaaactggggtacatattgagggacgtctccaagaaggagggaggcgctatgtatgccgatgacactgcgggctgggatacacgcatcaccctggaagacctcaaaaacgaggaaatggttacaaatcatatggagggggaacacaagaaacttgcagaggccattttcaagctgacttaccagaacaaagtggtacgagtgcaacggcctacccccagaggaacggtcatggacatcattagcaggcgcgatcagagaggttctggccaggtggggacctatggattaaacacattcactaatatggaggctcaactgatccggcagatggaaggcgagggtgtttttaagtcaattcagcatttgaccgtgacagaagagatagccgtccagaactggctcgcaagggtggggcgtgagcgactgagtcgcatggctatctccggagacgattgcgtagttaagccactagacgatagattcgccagcgctcttactgccctgaatgacatgggcaaagtgcggaaggatattcaacagtgggaaccctctaggggctggaacgactggacccaggtccctttttgctcgcaccatttccacgagctcatcatgaaagatgggcgcgtgctggtggtcccatgtagaaatcaggacgaattgatcggacgggcaaggatttcacaaggtgcgggctggagcttacgagagacggcctgcctggggaagtcctacgctcagatgtggagtctcatgtattttcaccgtagagatcttcgcctggccgcaaacgctatatgttctgccgttccgagccattgggtgcccacatcccggaccacttggtcaatccacgcaaggcatgaatggatgacaaccgaggacatgctaactgtatggaatagagtgtggattcaggagaacccttggatggaagataaaaccccagtcgagagttgggaagagatcccctacctgggaaagcgcgaagaccagtggtgcggctctctcattggtttgacaagccgggccacgtgggcgaagaatatccaaaccgctataaaccaggtgaggtccctgatcgggaatgaggagtatactgactacatgccttcaatgaaacgattcagacgggaagaggaagaggccggagttctttggtga

SEQ ID NO: 15012 - RNA, 9876 nt, synthetic construct
  misc_feature 1..9876: note = derived and/or modified CDS sequence (opt3) from DENV-2__GQ398261__SS-prME
  source 1..9876: mol_type = other RNA
acagccggaatgatcattatgctgatacccacagtgatggctttccacctcactacgagaaatggggagcctcatatgatcgtcagcaggcaggaaaaggggaaatcccttctgtttaagaccgaggacggtgttaatatgtgcacattgatggcaatggatttaggcgaactgtgtgaggacactattacctacaattgcccactactccggcaaaatgaaccggaggatatcgactgttggtgcaactctacatcaacctggattacttatgggacatgtaccgccacgggagagcaccgccgagaaaaacgtagtgtggcgctggtgccccatgtgggcatgggtcttgagactagaaccgaaacatggatgagctccgagggggcttggaagcacgcccagaggatcgagacttggatactgcggcatcctggattcaccatcatggcagccattttggcttacacaatcggcaccacgtattttcagcgcgtcctcattttcatcctgctgactgcagtggccccatctatgacaatgagatgcataggcatttcgaatagggattttgttgaaggggtgtcaggaggtagctgggtcgacatcgtgctcgagcacggcagttgtgtaaccactatggctaaaaacaagcccacattagatttcgaactgattaagaccgaggccaaacagcctgcgacgcttcggaagtactgcatcgaagcaaaattgaccaatacaactaccgcctcccgctgtccaacacaaggggagccctctctgaacgaggaacaggacaagcgatttgtttgcaaacacagcatggtggatagaggatggggcaatggttgtgggctattcggaaagggcggcatcgtcacttgcgctatgtttacctgcaagaaaaacatggaggggaaggtggtgcagcctgaaaatctcgagtatacaattgtcataaccccacattccggagaagagaacgccgttggtaatgacactggcaaacacgggaaggagatcaaaattacgccgcagtcaagtatcacagaagcagagctgaccggatacggcactgtgaccatggaatgtagccccaggacaggtcttgatttcaacgagatggtactgttgcaaatggaaaataaggcttggctcgtgcatcggcagtggtttctggacttacctctgccatggctccccggggccgatacccagggctctaactggatacagaaagagactcttgtcacattcaagaaccctcacgcgaagaaacaagacgtggttgtgctgggatcccaggagggcgccatgcacacggcattgaccggggctactgaaattcagatgtcaagcggaaatctactgtttacaggtcatctcaagtgccgtctgcgcatggacaaacttcaactgaagggcatgagttattctatgtgtaccgggaaattcaaggtcgtgaaggagatcgccgaaacacagcacggaactatcgtagttagagtgcagtacgagggcgatggttccccatgcaaaattcccttcgagatcatggacttggaaaagaggcatgtcctcgggcggctgattaccgtgaacccgatagtcacggagaaagatagccctgtgaatatcgaagctgagcccccatttggcgactcgtacattatcatcggagttgaacctggccagttaaagctgaactggttcaaaaaggggtcttccattggacaaatgtttgagaccacaatgcgaggtgccaagcgcatggcaatactaggcgatactgcctgggacttcgggtcactcggaggcgtgtttaccagtatcggtaaagctctgcaccaggtattcggggcgatttatggcgcagcctttagcggagtctcctggacaatgaagatccttattggcgtggttatcacttggatagggatgaactctagaagcacctcattgagtgtgtccctggtcctcgtgggagtagtgacgctgtaccttggcgttatggtccaggctgatagcggttgtgtggtgtcttggaaaaacaaggagctgaaatgcgggtcaggaatcttcgtcacagacaatgttcatacctggactgaacagtataagtttcaacccgagagtccaagcaagttggcctccgcaattcagaaagcccacgaagagggcatctgtggtattaggtctgtgacacggctcgaaaacctgatgtggaagcagatcacccccgagttaaatcacatactgtcggagaacgaagtgaaactaactattatgaccggcgatatcaaggggattatgcaggctggaaaacgcagcctcagacctcaaccaacagagctgaagtactcctggaaaacgtggggcaaggccaagatgctttcaaccgaattgcataatcagactttcctgatcgacgggccggagacagcagaatgccccaacaccaatagggcgtggaacagtctcgaggtagaggattatggatttggcgtcttcacaactaatatatggctgaaattaaaggaacgtcaggacgtgttttgtgactctaaactgatgagcgctgccatcaaggataaccgggcagttcacgccgacatgggttactggattgagtccgctcttaacgatacctggaaaatcgaaaaggcctcattcattgaggtaaagagctgccattggcctaaatctcacacgttgtggtccaatggggtcctcgagagtgaaatgatcataccaaagaacttcgcaggacccgtgagccagcacaattatcgacctggctaccatacacaaaccgctggtccatggcacctgggcaaactagagatggactttaacttctgtgaagggactaccgttgtggtaacaggagattgcggcaatagagggcccgccctgaggactaccacagcgtctggaaagctcattacggagtggtgctgtcgctcctgcaccctgccgcctcttcggtacagaggcgaagacggttgttggtatgggatggagatcaggccattgaaagagaaggaagagaacctggtcaattcattagtgactgccggacatggccagatcgataactttagtctcggtgtgctgggcatggctcttttcctggaagagatgttgcgcacacgagtcgggaccaagcacgcaattctcctggttgccgtgagctttgtaactctaatcacaggaaatatgtcgttccgggacctgggccgtgtgatggtcatggtgggggctaccatgacggatgacattggaatgggcgttacttacctcgccctgcttgcagcgtttaaagtgagacccaccttcgccgctggtttgctgttaaggaagctcacatccaaagaactgatgatgaccactatagggatcgtccttctgtctcagagcacaattcctgagaccatcctagagctcacagatgccctggcattgggaatgatggtgctgaagattgttcgcaacatggaaaaatatcaattagctgtgactatcatggccatactctgcgtccccaatgcagtaatcctgcagaacgcctggaaggtgtcatgtaccattcttgctgttgtgagtgtctccccactgttgctcacgtctagccagcagaaggcggactggatccctctggccctaacaattaaaggcctgaatcccaccgcaatctttcttactaccctctcccggacatcaaagaaaagaagctggccactgaacgaggctataatggccgtgggcatggtaagtattttggcctcttccctgttaaagaatgatatcccgatgactgggcctctcgtggctggaggtctgcttaccgtctgctacgttctgacgggcaggagcgcagacttggaactcgagcgagccgcggacgtgcgctgggaagatcaagctgagatctcggggtcatctcccattctgagtataacaatctccgaggacggaagcatgtctattaaaaacgaagaggaagaacagaccctaactatcctgattcggacaggccttctcgtgatcagcggtctgttcccagtctccatacccatcaccgccgcagcctggtatttgtgggaggtgaagaaacagagagctggggttttatgggatgtaccttcaccaccccctgtgggaaaggcagaactggaggacggcgcctacaggattaagcagaaaggcatcctcgggtatagtcaaattggagcgggtgtctacaaggaaggcacttttcatacaatgtggcacgtgacccgtggggctgttctgatgcacaaaggaaagcgcatcgagccgagctgggccgatgtgaaaaaggaccttatatcttacggcggtgggtggaagctggaaggagagtggaaagagggcgaagaggtccaggtgttggcactagaaccaggcaagaacccccgggccgtacagacgaaacctgggctgttcaagactaataccggaacaattggtgctgtctccctcgatttttcaccaggcaccagtgggagccccatcgtggacaaaaagggaaaggttgtgggcctgtatggtaacggggtcgtgacaagatccggaacttacgtttctgccatcgcacagaccgagaaatcgattgaagataatcctgagatcgaggacgatatattcaggaagaaacgacttacgattatggacttacatccgggcgctggcaagacaaaacggtatctgcccgccatcgtgcgcgaagcgattaagagagggctcaggactttgatcctggccccaacccgggtcgtggcagctgagatggaagaggccctccgaggactgcctataagataccaaacacccgctattcgcgcagaacacaccggtagggagatcgtagatcttatgtgtcatgccactttcaccatgcgtctgttgagcccagtgcgggttcctaactataatctaatcattatggacgaggcccactttacagaccccgcttcaatcgcggcaagaggctacatttccacgagggtcgaaatgggggaggccgctggaatattcatgactgccaccccaccgggcagtcgcgatccttttccccagtctaacgcaccaatcatggacgaggaacgagagattcccgaaagaagctggaactccggtcatgagtgggtgacagatttcaaggggaaaaccgtgtggtttgtcccttcaatcaaggccggaaacgacatcgctgcgtgcctgcggaaaaatggcaagaaagtaattcagctctctaggaagactttcgatagcgaatatataaagacacgcaccaacgactgggattttgtggttacgactgacatcagtgagatgggcgccaatttcaaagcagaacgtgtgattgatccaagacggtgtatgaagcccgtcatcttaacagacggggaggagagggtgattctggctggacctatgccggttacccactccagcgccgcacaacgccgaggtagaatcggccggaaccccaagaatgaaaacgatcagtacatatacatgggggagccccttgaaaatgacgaggactgcgcccactggaaggaagctaaaatgctgctcgataacatcaacacccctgagggaattatcccctctatgtttgagccagaaagggagaaggtggacgccattgatggcgaatatcgcttgagaggtgaggcgaggaaaactttcgtcgacctgatgcggcgtggggatctccctgtgtggctggcataccgcgtagccgctgaaggcatcaattatgccgaccgaagatggtgttttgatggaataaagaacaatcagattcttgaggagaacgtggaagttgagatctggacaaaggaaggcgagaggaaaaagctaaaaccccggtggctggacgctcgcatttactcagatccattggcattaaaggagttcaaagagttcgccgctgggagaaagtccctgaccctcaatctgatcacagagataggaaggcttcctacttttatgacgcagaaggcccggaacgcactggacaatctcgcggtcttgcataccgccgaagctggtggccgagcctataaccacgcactgagtgagctaccggaaacactggagactctccttctgttaaccttgctggctacagtgaccgggggaatcttcctctttctgatgagcggcaaaggtattgggaagatgactcttggcatgtgctgcatcattacggcctcgatcctgctctggtacgcacaaatacagccccattggattgccgcttctatcatcttggagttctttctgattgtgttactaatcccagaacctgagaaacagagaacaccacaggataatcaactgacatatgtcgttatagcgattctcactgtggtagccgcaaccatggctaacgaaatgggattccttgagaagaccaaaaaggactttggcctggggtccatcgccacccagcagccagaaagcaatattttggatatcgacctgcgccctgcctcagcatggactctctacgctgtggccacaacgttcataacccccatgctgaggcacagtatcgagaactcttccgtcaatgtgagccttactgcgattgctaaccaggccacagttctcatgggactgggtaagggctggccgttgtcaaaaatggacatcggggtgccactgttagcaattggatgttacagtcaagtcaatcctatcaccctaaccgccgctctgctccttctggtagcacactatgccattatcggccccggtttgcaggcgaaggctacacgggaggcccagaaacgtgcagccgctgggataatgaagaacccaactgtggatggcattacggttatcgacctggatcccatcccttacgacccgaaatttgaaaagcagctcggacaagtgatgctgcttgtcttatgcgtgacccaggtcctgatgatgagaacaacttgggccctctgtgaggcattgaccctggctacaggccccattagcaccctatgggaagggaatccaggaaggttctggaacactacgatagccgtgtccatggcgaacatctttcgcggctcttatctggccggtgcagggctccttttcagcattatgaagaatacagctaacacccggcgaggaactggcaataccggtgagacactgggcgaaaaatggaagaacagattgaatgccctggggaaatccgagtttcagatctacaagaaatcaggcattcaagaggttgataggactctcgcaaaggaaggcatcaaacgcggggagaccgaccatcacgctgtgtctcggggaagtgccaagctgagatggttcgtagaacgtaacttagtgacacctgagggcaaggtcgttgatcttggttgcgggaggggaggctggtcgtattactgtggtggcctgaaaaatgtgcgggaggtcaaggggctcacgaaaggaggccccgggcatgaggaacctataccaatgagcacctatggatggaacctagtgcgcctgcagtccggcgtagacgtgttctttactccccctgaaaagtgcgatacattgctgtgtgacatcggtgagtcttcaccaaatcccaccattgaagccgggcgaactctcagagttcttaacctggtggagaattggttgaacaataacacacagttctgcatcaaagtcctgaatccgtacatgcctagcgtgattgagaagatggaagcgctccagaggaagtacggaggcgctttagtccggaacccactgtcccgcaacagtacccacgagatgtattgggtgtctaatgcaagcggcaacatcgtttcatccgtaaatatgataagtagaatgcttattaacaggtttacgatgcgacataaaaaggccacctacgaacccgatgtggacctggggagcggaacacggaatatcggtatcgagtctgaaactcctaacctagatattataggcaaacgtatcgagaagattaaacaagagcacgaaacctcctggcactatgaccaggaccatccatacaagacatgggcttatcacgggtcatacgagactaagcagaccggaagcgcctcgtctatggtcaatggcgtggttagactcctgacaaaaccctgggatgtgatcccgaccgtcactcagatggcaatgacggacacaacccctttcggtcaacagcgcgtgtttaaggaaaaagtagatactaggacccaggagcccaaggaagggaccaaaaagttgatgaagattacggccgagtggctgtggaaagagctcggaaagaaaaagaccccacggatgtgtactagagaagagttcacacgcaaagtgaggagtaacgctgcgcttggcgccatctttaccgacgaaaataagtggaaatccgcacgagaggctgttgaggatagccggttctgggaactggtcgacaaggagagaaacttacatctggaaggcaagtgcgagacttgtgtgtataatatgatggggaaaagggaaaagaaattgggagagtttggtaaggccaaaggctcacgcgcaatatggtacatgtggctcggggcccgtttcctggagtttgaagctctaggattccttaacgaggatcactggttttcccgggaaaattctctgagcggcgtggagggtgaagggctccacaagctgggatacatcttgagagacgtcagtaagaaagagggcggcgccatgtatgcggatgacacagcagggtgggataccaggattacactggaggacctcaagaacgaagagatggttactaatcatatggaaggagagcacaagaaacttgccgaagctatcttcaaactgacctaccagaacaaagtggtacgcgtgcaacgacctacgccccggggtaccgtcatggacattatctccagaagggatcagcgcggcagcggacaggtgggaacatatggcttaaacactttcaccaatatggaggcccaactgattagacagatggagggtgaaggggtttttaagtctatacagcatttgacagtgactgaggaaatcgcagtccagaactggctcgctcgggtgggaagggagcgtctgtcacgaatggccattagtggcgacgattgcgtagttaaaccactagacgatcgcttcgcttccgcccttaccgcactgaatgacatgggcaaggtgagaaaagatatccaacagtgggagcccagccgggggtggaacgactggacgcaggtccctttttgctctcaccatttccacgaactcatcatgaaggatggaagggtgctggtggtcccatgtcgcaatcaggacgagttgattggtagagcgcggatatcgcaaggcgccgggtggtcattaagggaaacagcttgcctgggaaaaagctacgcccagatgtggtccctcatgtattttcaccgacgtgatcttagactggcagctaacgccatctgtagtgcagttccgtctcattgggtgcccaccagccgcactacatggtccattcacgcccggcatgagtggatgaccactgaagacatgctaaccgtatggaatagggtgtggatccaggagaacccttggatggaggataagacaccagtcgaatcatgggaggaaattccctacctgggcaagagagaggaccagtggtgcggtagtctcatcgggttgacgtctcgcgcgacctgggctaaaaatatacaaactgccatcaaccaggtgcggagcctgattggaaatgaagagtatacagactacatgccttccatgaagaggttccgaagagaggaagaggaagcaggcgttctttggtga

SEQ ID NO: 15013 - RNA, 9876 nt, synthetic construct
  misc_feature 1..9876: note = derived and/or modified CDS sequence (opt3) from DENV-2__GQ398313__SS-prME
  source 1..9876: mol_type = other RNA
accgcaggcgtgatcattatgctgatacccacagctatggcattccacctcactacgagaaacggggagcctcatatgatcgtcgggaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggccgaacttactggctatggtaccgtaacaatggagtgtagtcccaggaccgggctggatttcaacgaaatggtgttgctccagatggaggacaaagcatggctggtccaccggcaatggtttttagatctgcctctcccatggcttcccggcgctgacactcagggaagcaattggatacagaaggagacactggtgacgttcaagaaccctcatgccaaaaagcaggacgttgtggtcttgggctctcaagaaggggcgatgcacaccgccctaactggagcaacagagattcagatgtcctcaggtaatctgctctttaccggccatctgaaatgccgtcttcgcatggataagctgcagttgaaagggatgagctacagtatgtgtacaggaaagttcaagatcgtgaaagaaatcgctgagactcaacacggcaccattgtaatcagagttcagtatgagggtgacgggtctccatgcaagattcccttcgaaataatggatctcgagaaaaggcatgtgctgggccggttaatcacggtcaacccgattgtggccgaaaaggactcccctgtcaacatcgaggctgaacccccatttggagatagctacatcattataggcgtggagcctgggcagctgaaactaaattggttcaagaagggatcgtctatcggtcagatgtttgagaccacaatgcgaggcgccaaacgcatggcaattctcggggacactgcctgggatttcggatccctgggcggtgtttttacctcaatcgggaaggcacttcaccaagtgttcggcgcgatttacggagcagcctttagtggcgtaagctggacaatgaaaatcttgataggggtcatcattacttggatcggaatgaactccagatctaccagcctgtcagtgagtctcgttctggtgggcgtcgtgacgctttatctgggtgctatggtacaggccgactccgggtgtgtggttagctggaagtctaaagaattgaagtgcggatcaggcattttcatcacagataatgtccacacctggactgagcagtacaagtttcagcccgaaagtccaagcaaactcgcatccgccatacaaaaggctcatgaggaaggtatttgtggcatcaggtctgtgacacggctggagaacttaatgtggaaacagattacccccgagctgaatcacatcctatcggaaaacgaggtgaagctcactataatgaccggggacatcaaaggaattatgcaggccggcaagcgcagcctgagacctcagccaacagaacttaaatattcctggaagacgtgggggaaggcaaaaatgttgtcaaccgagagtcataatcaaactttcctgatcgatggaccggaaacagcggagtgccccaacaccaatagggcttggaactctctcgaggtcgaagactacggctttggtgttttcacaactaatatttggctgaagttacgtgagaaacaggacgtgttttgtgatagcaagctgatgtccgccgcaatcaaagacaaccgggccgtgcacgctgatatggggtattggatagaatcagcccttaatgacacctggaagatggagaaggcttcattcattgaggtaaaatcttgccactggcctaagtcccatacgttgtggagtaacggagtcctcgaaagcgagatgatcatccccaaaaatttcgctggccccgtgtctcagcacaactaccgacctggttatcatacacagaccgccggcccatggcacctggggaagctagaaatggattttgacttctgtgagggaactaccgttgtggtcacagaagattgcggcaacagagggccctccctgaggactaccacagcgtcaggaaaactcattacggagtggtgctgtcgcagttgcaccctgccgcctcttcggtacagaggcgaggacggttgttggtacgggatggaaatcaggccattgaaggagaaggaagagaatctggtgaacagcttagttactgccggacatggccaaattgataatttttcgctcggtgtgctgggcatggctcttttcctggaagagatgttgcgcacacgagtagggaccaaacacgcaatgctcctggtcgccgtgtcctttgtgactctaataacaggaaacatgtctttccgggacctgggccgtgtcatggttatggtgggggctaccatgacggatgacatcggaatgggcattacttatctcgccctgcttgcagcgtttaaggtaagacccaccttcgccgctggtttgctgttaaggaaactcacaagcaaggagctgatgatggccaccatcgggattgcacttctgtcacagagtactatccctgaaacaatactagagctcaccgatgctctggccttgggaatgatggtgctgaaaatcgtccgcaatatggaaaagtaccagttagcagtgacaattatggccatctcctgcgttcccaacgctgtgattctccaaaatgcgtggaaggtctcttgtactatcctggccgcagtgagcgtttccccacttctgttgacctcaagccagcagaaagctgactggatacctctcgccctgacgattaagggcctaaaccccacagccatctttctgaccactcttagtcggacctctaaaaagagatcctggccactcaatgaggctgtgatggcagtcggcatggtaagcatcctggcctcgtcattgctgaaaaacgacattccgatgacagggcctttagtggcgggaggtctcctgactgtttgctatgtgcttaccggcaggtctgctgatctggaattggagcgagccgcagacgtcaagtgggaggatcaggccgaaataagtgggtccagccccatcctctctattacgatcagcgaggacggatccatgtcaattaaaaatgaagaggaggaacaaacactgaccatcctaatacgcactggcctgcttgtgatcagtggtgtattcccagtgagcattcccatcacagctgcagcctggtacctctgggaggtcaagaagcagcgggcgggggttctgtgggatgtgccttctccaccccctgtgggaaaagctgaattggaggacggcgcctatagaattaagcagaggggcatcttagggtactcccagataggagccggtgtatataaagaaggcacctttcacactatgtggcatgtgacacgtggggcagttctgatgcaccgcggaaagcggattgagccgtcatgggctgatgtcaaaaaggacctcatcagttacggcggtgggtggaagctggagggagaatggaaagagggcgaagaggtgcaagtccttgccctggaaccaggcaagaaccccagagcagtgcagaccaaacctgggttgttcaagacgaatactggaaccatcggtgctgttagcctagatttttccccaggcacatctgggtcgcccattgtggacaggaaaggaaaggtcgtgggcctgtacggtaacggggtagtcacccgaagcggagcctatgtgtcagcgatcgcccagacagagaagtccatagaggataatcctgaaattgaggacgatatcttccggaaaaagcgcctcactattatggacctgcatccgggcgcaggcaaaaccaagagataccttcccgctatcgttagggaagccataaaacgggggttacgaacgctgattctcgctccaacaagagtggtcgcagccgagatggaagaggccttgcgcggactgcctatcaggtatcagactcccgctatccgtgcggagcacaccggtcgggaaattgtggacctcatgtgtcatgcaacattcaccatgagactgcttagtccagttagggtgcctaactacaacctgatcattatggatgaggcccactttactgaccccgcttctatagccgcacgcggctatatcagcacccgagtcgaaatgggggaggccgctggaattttcatgacagcgacgccaccgggctccagagatccttttccccaatcaaatgccccaatcatggacgaggaacgggagatccccgaaaggtcttggaacagcggtcacgagtgggtgactgatttcaaggggaagaccgtatggtttgtgcctagtattaaagcaggaaatgacatagctgcctgcttgcgcaagaacggcaaaaaggttatccagctatcccgtaaaacattcgatagcgaatacgtcaagaccagagcaaatgactgggattttgtggtgactacagacatttctgagatgggcgccaacttcaaggctgagcgggtcatcgatccaaggcgctgtatgaaacccgtaattctgaccgacggggaagaacgagtgatcctcgccggacctatgccggttacgcattcatccgcggcacagagacggggtaggataggccgcaatccaaagaacgaaaatgaccaatatatctacatgggggagcccttagaaaacgatgaggactgcgcccactggaaagaggctaagatgctgcttgataatattaacactcctgaaggaatcattcccagtatgtttgagccagaaagagagaaagtggacgccatcgatggcgaatacaggctgcggggtgaggctcgtaagacattcgtcgacctcatgcgccgaggggatttgcctgtgtggctggcatatagagttgccgctgagggcataaattacgccgacaggcggtggtgttttgatggaattaaaaacaatcagatcctcgaagagaacgtggaagtcgagatttggaccaaggagggcgaacgcaagaaactgaagcccagatggcttgacgcaaggatctatagcgatccactagcgctgaaagagttcaaggagttcgccgctgggcggaaatcgttgaccttaaacctgataactgagatgggacgactccctacatttatgacccagaaggccagagacgcactggataatcttgctgtgctgcatacagccgaagccggtggccgcgcctacaaccacgctctctctgagttgccggagactctggaaacgctactgctccttaccctgttagcgacagtaactgggggaatcttcttgtttctgatgtccggcaagggtattgggaaaatgaccctcggcatgtgctgcatcattacagccagcatcctgctttggtatgcacagatacaaccccactggattgctgcctcaatcatcctggagttctttctcattgtgttgctgatcccagaacctgagaagcagaggaccccacaggacaatcagttaacttacgttgtcatagccattctaacggtggtggcagctaccatggccaacgaaatgggattcctggagaaaacaaagaaagacctcggccttgggagtatcgcgactcaagagtctgaatccaatattctggatatcgacttgcggccagctagcgcctggaccctgtatgcagtcgccacaacctttgttactcctatgctccgtcattcaatagagaacagtagcgtgaatgtatccctgacagctatcgcaaaccaggccacggtgcttatgggactcggtaagggctggcccctgtctaagatggatattggggtcccgttgctggcgatcggatgttacagccaggtgaatccaattaccttaactgctgccctactgctccttgttgcacactacgccatcattggccctggtctgcaggctaaagccacaagagaagcacaaaagagggctgccgcggggatcatgaaaaaccccaccgtggacggcataaccgtcattgatttggagccaatcccctatgaccctaagttcgaaaaacagctgggacaggtaatgctcctgatcctttgcgtgacacaggttttaatgatgcgcactacgtgggccctgtgtgaggcactcaccttggctacaggcccgatttccactctgtgggaggggaatcccggacggttttggaacaccacaatagccgtgtcaatggcaaatatcttccgaggctcttacctagctggtgccgggctgctctttagtattatgaagaacaccactaatacgagaaggggaacaggcaacatcggtgaaacccttggcgagaagtggaaatcgcgcctgaatgccttgggaaagagcgagttccaaatttataaaaagtccggaatccaggaggtcgatcggactctggcgaaagagggcataaagagaggggaaaccgaccatcacgctgtgtctcgtggatcagcaaaactcaggtggtttgtcgagcggaacatggtgacaccagaaggcaaggttgtggatctgggttgcgggcgcggaggctggagctactattgtggtggcttaaagaacgtacgagaggtgaaagggcttactaagggaggccctgggcatgaagaacccatccctatgtccacctacggatggaatctggtcagactccagagtggcgttgacgtgttcttcacaccacccgagaaatgcgatacgctactgtgtgacattggtgaatctagccctaacccaaccatcgaggccgggaggactttgcgggtcctgaatctcgtggaaaactggcttaataacaatacacaattttgcattaaggtactgaacccctatatgccgtcagtgatcgagaaaatggaaaccttgcagcgcaagtacggaggcgctctggttagaaatcctctctccaggaacagtactcacgagatgtactgggtgagcaatgccacaggcaacatagtctcttccgtgaatatgatttcacgaatgttaatcaaccggttcaccatgaagcacaaaaaggcaacgtatgagccagatgtcgacctggggagcggaacccgtaatatcggtattgaatcggagatacccaaccttgacatcattggcaaaagaatcgaaaagattaaacaggagcatgaaacatcttggcactacgatcaggaccatccttataagacttgggcctaccacgggagttatgagaccaagcaaacaggatccgctagctcaatggtgaacggcgttgtacgcctgctaactaaaccatgggatgtggtccccatggtgacccagatggcgatgacagacaccactccgtttggtcagcagagggttttcaaggagaaagtggatacgcggacacaagaacctaaggaggggaccaaaaagctcatgaagatcactgccgaatggctgtggaaagagttgggaaagaaaaagacccccagaatgtgtacacgcgaggaatttacgaggaaagtccgatccaatgcagctctgggcgccatattcaccgacgagaacaagtggaaatctgcacgggaagccgtggaggatagcagattttgggaactcatcgacagggagcgcaatcttcacctggagggcaagtgcgaaacttgtgtatacaacatgatggggaagcgtgagaaaaagttaggagagttcggtaaagctaagggcagtcgggccatttggtatatgtggctgggggcgagatttttggagttcgaagcactcggatttctgaatgaggatcattggttctccaggggcaacagcctatctggtgtggagggggaaggacttcaccgcctgggctacatcctccgagacgttagcaaaaaggagggcggggccatgtacgctgatgacacagccggatgggacacccggattactctggaagatttgaagaatgaggaaatggtcacaaaccatatgaaaggtgagcacaagaaactggcagaggctatctttaagctcacctatcagaataaagtggtgagagtccagaggccaacacctcgcggcactgttatggacattataagtagacgggatcagagggggtccggacaagtgggcacctacggtcttaacacgttcaccaatatggaagcccagctgatccgtcagatggagggggaaggaattttcaagagcatccaacatttaacagtaactgaggagatcgctgtgcagaactggctggcccgagtcggccgcgaaagattgtctcggatggcaatttcgggcgacgattgcgtggttaagcccctcgacgataggtttgcgtcagccctgaccgctctaaatgacatggggaaagtgcgcaaggatatacagcagtgggagccaagcagaggatggaacgactggacacaagtccccttctgctcccaccactttcatgaacttgtgatgaaagatggtcgggtactggttgtgccttgtaggaatcaggacgagctcatcggccgagcccgtattagtcagggggcaggatggtctctgaaggaaactgcttgcttgggcaaaagctatgcccagatgtggaccttaatgtacttccacagacgcgatctgcggctcgcagccaacgcgatctgttccgctgtcccatcacattgggtgccgacgagtaggacaacctggtctattcacgccaagcacgagtggatgactacagaggacatgcttgcagtgtggaacagagtctggatccaagaaaatccctggatggaggacaagacccctgttgaaagctgggaggaagtgccatatctgggtaaacgcgaggatcagtggtgcgggtccctaataggactgacttcacgggccacctgggctaagaacatccagacagccattaatcaggtaaggagcctcatcggcaacgaggaatacacggactatatgccctctatgaaacgatttagacgggaggaagaggaagcaggcgtgttgtggtga

SEQ ID NO: 15014 - RNA, 9876 nt, synthetic construct
  misc_feature 1..9876: note = derived and/or modified CDS sequence (opt3) from DENV-2__GQ398285__SS-prME
  source 1..9876: mol_type = other RNA
accgcaggcgtgatcattatgctgatacccacggctatggcattccacctcactacgcggaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggccgaacttactggctatggtaccgtaacaatggagtgtagtcccaggatggggctggatttcaacgaaatggtgttgctccagatggaggacaaagcatggctggtccaccggcaatggtttttagatctgcctctcccatggcttcccggcgctgacacccagggaagcaattggatacagaaggagactctggtgacattcaagaaccctcatgccaaaaagcaggacgttgtggtcttgggctctcaagaaggggcgatgcacacggccctaaccggagcaactgagattcagatgtcctcaggtaatctgctctttacaggccatctgaaatgccgtcttcgcatggataagctgcagttgaaagggatgagctacagtatgtgtaccggaaagttcaagatcgtgaaagaaatcgctgagacacaacacggcactattgtaatcagagttcagtatgagggtgacgggtctccatgcaagattcccttcgaaataatggatctcgagaaaaggcatgtgctgggccggttaatcaccgtcaacccgattgtgacggaaaaggactcccctgtcaacatcgaggccgaacccccatttggagatagctacatcattataggcgtggagcctgggcagctgaaactaaattggttcaagaagggatcgtctatcggtcagatgtttgagaccacaatgcgaggcgctaaacgcatggccattctcggggacactgcatgggatttcggatccctgggcggtgtttttacctcaatcgggaaggcccttcaccaagtgttcggcacaatttacggagctgcgtttagtggcgtaagctggactatgaaaatcttgataggggtcatcattacctggatcggaatgaactccagatctacgagcctgtcagtgagtctcgttctggtgggcgtcgtgacactttatctgggtgcaatggtacaggccgactccgggtgtgtggttagctggaagtctaaagaattgaagtgcggatcaggcattttcatcaccgataatgtccacacttggacagagcagtacaagtttcagcccgaaagtccaagcaaactcgcttccgccatacaaaaggcacatgaggaaggtatttgtggcatcaggtctgtgacccggctggagaacttaatgtggaaacagattactcccgagctgaatcacatcctatcggaaaacgaggtgaagctcaccataatgacagggggaatcaaaggcattatgcaggccgggaagcgcagcctgagacctcagccaacggaacttaaatattcctggaagacctggggaaaggctaaaatgttgtcaactgagagtcataatcaaacattcctgatcgacggcccggaaaccgccgagtgccccaacacaaatagggcatggaactctctcgaggtcgaagattacggttttggggttttcactaccaatatttggctgaagttacgtgagaaacaggacgtgttttgtgacagcaagctgatgtccgcggctatcaaagataaccgggccgtgcacgcagacatgggatattggatagaatcagcccttaatgatacgtggaagatggagaaggctagcttcattgaggtaaaatcttgccactggcctaagtcccatacattgtggagtaacggcgtcctcgaaagcgagatgatcatccccaagaatctggccggtcccgtgtctcagcacaactaccgacctggctatcatacccagactgcagggccatggcacctaggaaagctggaaatggacttcgatttttgtgagggcaccacagttgtggtcactgaagactgcgggaacagaggaccctccctcaggaccacaacggcttcaggcaaactggtgaccgagtggtgctgtcgcagttgcactcttccgcctttgcggtacagaggtgaggatgggtgttggtacggaatggaaattaggccactgaaggagaaggaagagaatttagttaacagcctcgtgacagccggccatggtcaaatcgacaatttctcgctgggcgtacttgggatggcgctgtttttggaagagatgctccgcacccgagtcggaactaaacacgccattctgctagtggctgtgtccttcgtcacactgataaccggcaacatgtcttttcgggatctcgggcgtgttatggtgatggtaggagcaacgatgactgacgatatcggcatgggtgtgacctatctggcccttttggctgccttcaaggtcagacccacatttgcagcggggctgttactcaggaaactgaccagcaaggagcttatgatggccactattggaatcgctctgctatcacagagtacaattcctgaaaccatcctcgagctgacagacgccttggcactgggcatgatggtgttaaaaatagttcgcaatatggaaaagtaccagctcgctgtgactatcatggccatttcctgcgtccccaacgcagtgatcctgcaaaatgcctggaaggtttcttgtaccattcttgctgcggtgagcgtctccccactgttgctcacgtcaagccagcagaaagccgattggatccctctggcactaacaataaagggcctgaaccccaccgctattttccttactaccctcagtcggacatctaaaaagagatcctggccactgaatgaggccatcatggccgtagggatggtgagcatcttggcttcgtcactgctcaaaaacgacattccgatgactggacctctagttgccggtggcctgcttaccgtgtgctatgtcctgacggggaggtctgccgacttggaactcgagcgagcggctgatgtgaagtgggaggaccaggccgaaataagtggatccagccccatcctgtctattacaatcagcgaggatggctccatgtcaattaaaaatgaagaggaggaacaaaccctaactatcctgatacgcacaggtcttctcgtaatcagtggggtgtttccagtcagcattcccatcaccgcagccgcttggtacctgtgggaggttaagaagcagcgggcaggagtgttgtgggacgtgccttctccaccccctgtcggcaaagccgaattagaggatggcgcgtatagaattaagcagagggggatcctgggatactcccagataggtgctggcgtgtataaagaagggactttccacacaatgtggcatgttacccgtggagccgtactcatgcaccgcggcaagcggattgagccgtcatgggcagacgtgaaaaaggatctgatcagttacggtgggggatggaaacttgagggcgaatggaaagagggcgaagaggtccaagtgctggccttggaaccagggaagaaccccagagctgttcagacgaaacctggactatttaagactaataccggtacaatcggcgccgtgagcctggacttctccccagggacctctggatcgcccattgtcgataggaaaggcaaggtggtaggtctctacgggaacggagtcgtgacacgaagcggcgcatatgtttcagctatcgcccagactgagaagtccatagaggacaatcctgaaattgaggatgacatctttcggaaaaagcgcctgaccattatggatcttcatccgggcgcggggaaaacgaagagatacttacccgccatcgtgagggaagcaataaaacggggactgcgaacactcattttggctccaactagagtcgtggccgctgagatggaagaggcactgcgcggtctccctatcaggtatcagacccccgccatccgtgccgagcacacaggccgggaaattgttgacctgatgtgtcatgctaccttcactatgagacttctgagtccagtgagggtccctaactacaacttgatcattatggacgaggcgcacttcaccgatcccgcatctatagccgctcgcgggtatatcagcacacgagtggaaatgggagaggccgcaggcatttttatgacggccactccaccgggttccagagaccctttcccccaatcaaatgctccaatcatggatgaggaacgggagatccccgaaaggtcttggaacagcgggcacgagtgggtaaccgactttaagggaaagacagtgtggttcgttcctagtattaaagcgggcaatgatatagccgcatgcctacgcaagaacggcaaaaaggtcatccagctgtcccgtaaaacctttgacagcgaatacgtgaagactagagctaatgattgggacttcgtggtcacaaccgatatttctgagatgggggccaactttaaggcagagcgggtaatcgacccaaggcgctgtatgaaacccgtgattctcacggatggagaggaacgagttatcttagccggtcctatgccggtgactcattcatccgctgcccagagacggggcaggatagggcgcaatccaaagaacgaaaatgaccaatatatctacatgggagagcccctggaaaacgacgaggattgcgcgcactggaaagaggcaaagatgcttctggacaatattaacacacctgaaggcatcattcccagtatgttcgagccagaaagagagaaagtcgatgccatcgacggtgaatacaggctcagaggggaggctcgtaagacctttgtggatttgatgcgccgaggcgacctgcctgtttggctcgcctatagagtggctgcagagggaataaattacgccgataggcggtggtgtttcgacggcattaaaaacaatcagatcctggaagagaacgtcgaagtggagatttggaccaaggagggggaacgcaagaaacttaagcccagatggctagatgctaggatctatagcgacccactggccttgaaagagtttaaggagttcgcagcgggacggaaatcgttaactctgaacctcataacagagatgggtcgactgcctaccttcatgacacagaaggccagaaatgctcttgataacctggccgtactccatactgcagaagctggcgggcgcgcctacaatcacgcattgtctgagctgccggagacgctagaaaccctgctccttctgacattattggccactgtgaccggaggcatctttctgttcctcatgtccggtaaggggattggcaaaatgacactgggaatgtgctgcatcattaccgctagcatccttctgtggtatgcgcagatacaaccccactggattgccgcatcaatcatcctcgagtttttcttgattgttctgttaatcccagaacctgagaagcagaggactccccaggacaaccagctaacgtacgtcgtgatagctattctgaccgtggtcgccgccacaatggcaaatgaaatgggctttctcgagaaaactaagaaagatcttgggctgggaagtatcaccacacaagagtctgaatccaacattttggacatcgacctgcggccagctagcgcctggaccctctatgcggttgctactacattcgtgacgcctatgctgcgtcattcaatagagaatagtagcgtaaacgtgtcccttaccgccatcgcaaatcaggccactgtcctcatgggtctgggcaaggggtggcccttgtctaagatggatattggagtgccgctgttagctatcggctgttacagccaggttaacccaattacactaaccgcagccctgctccttctggtggcgcactacgctatcattggtcctgggttgcaggccaaagcaaccagagaagcccaaaagagggctgccgcaggcatcatgaaaaatcccacagtcgacggaataactgtaattgatctggagccaatcccctatgaccctaagtttgaaaaacagctcggccaggtgatgctgcttatcttatgcgttacacaggtgctgatgatgcgcaccacatgggctctctgtgaggccttgactctggcgaccgggccgatttccacactatgggagggaaaccccggccggttctggaataccactatagccgtctcaatggcaaacatctttcgaggttcttacctggctggggccggactccttttcagtattatgaagaatacgacaaacaccagaaggggcactggtaatatcggcgaaaccctgggggagaagtggaaatcgcgcttgaacgcactgggaaagagcgaatttcaaatttataaaaagtccggcatccaggaggtggatcggacactcgctaaagaggggataaagagaggagaaactgaccatcacgccgtctctcgtggctcagccaaactgaggtggttcgtggagcggaacatggttaccccagaaggtaaggtggtagatttagggtgcggacgcggcggttggagctactattgtggcgggcttaagaatgtgcgagaggtcaaaggactgacaaagggcgggcctggacatgaggaaccaatccctatgtccacgtacggctggaacctcgttagactacagagtggtgtggacgtctttttcaccccacccgagaaatgcgatactctgttgtgtgacattggggaatctagccctaatccaacaatcgaggcgggaaggaccctgcgggtgctcaaccttgtagaaaattggctgaacaataacactcaattctgcattaaggtgttgaatccctatatgccgtcagttatcgagaaaatggaaacactgcagcgcaagtacggcggcgctctcgtgagaaaccctttatccaggaatagtacccacgagatgtactgggtcagcaacgcaacggggaatatagtgtcttccgtcaacatgatttcacgaatgctgatcaatcggtttaccatgaagcacaaaaaggccacatatgagccagatgtggaccttggaagcggtactcgtaacatcggcattgaatcggagatacccaacctggatatcattgggaaaagaatcgaaaagattaaacaggagcatgaaacctcttggcactacgaccaggaccatccttataagacatgggcttaccacggaagttatgagactaagcaaaccggctccgccagctcaatggttaatggtgtagtgcgcctactcacaaaaccatgggatgtcgtgcccatggttacccagatggcaatgactgacacgacaccgttcgggcagcagagggtgtttaaggagaaagtcgatacccggactcaagaacctaaggagggaaccaaaaagctgatgaagatcacagccgaatggttgtggaaagagctgggcaaggagaaaacgcccagaatgtgtacccgcgaagagttcgctaggaaggtgcgatccaacgcggccctcggcgcaatatttactgacgaaaataaatggaagtctgctcgggaggccgtagaagatagcagattctgggagcttatcgacagggagcgcaacctgcacttagaagggaaatgcgagacatgtgtgtacaatatgatgggaaagcgtgaaaagaaactgggtgagtttggcaaggcaaaagggagtcgggccatttggtatatgtggttgggagctagattcctcgaatttgaggccctgggcttcctaaacgaggatcattggttttccagggaaaatagcctttctggtgttgagggggaaggactgcaccgcctcggctacatcctgcgagacgtctcaaagaaagagggcggggcgatgtacgcagatgacaccgccggatgggatactcggattacattggaagacctgaagaacgaggagatggtgaccaatcatatgaagggtgaacacaaaaagctcgctgaggccatcttcaaacttacatatcagaacaaggtggtcagagttcagaggccaactcctcgcggcaccgtgatggacattataagtagacgggatcagagggggtccggacaagtaggcacgtacggtctgaatacctttacaaacatggaagcacagttaatccgtcagatggagggggagggaattttcaaaagcatccaacatctgactgctaccgaagagatcgccgtgcagaattggttggctcgagtcggccgcgaaagactctctcggatggccatttcgggcgacgattgcgtggttaagcccctggacgataggttcgcatcagcgctaacagcccttaacgacatggggaaggtgcgcaaagatatacagcagtgggagccaagcagaggatggaatgactggactcaagtccccttttgctcccaccacttccatgaactggtgatgaaggatggtcgggtactcgttgtgccttgtaggaaccaggacgagctgatcggccgagctcgtattagtcagggggccggatggtctttgaaagagaccgcatgcttaggcaagagctatgctcagatgtggacgctgatgtactttcacagacgcgatctccggcttgccgcaaacgccatctgttccgcggtcccatcacattgggtgccgacaagtaggaccacttggtctattcacgctaaacacgaatggatgacaaccgaggacatgctggccgtgtggaatagagtctggatccaagaaaacccctggatggaggataagactcctgttgaaagctgggaggaggtgccatatctaggtaagcgcgaagaccagtggtgcgggtccctgataggactcacctcacgggcaacatgggccaaaaatatccagacggctattaaccaggtaaggagcttgatcggcaatgaggaatacaccgactatatgccctctatgaagcgattcagacgggaggaagaggaggccggcgtgctgtggtga

SEQ ID NO: 15015 - RNA, 9876 nt, synthetic construct
  misc_feature 1..9876: note = derived and/or modified CDS sequence (opt3) from DENV-2__GQ398298__SS-prME
  source 1..9876: mol_type = other RNA
accgcaggagtgatcattatgctgatacccaccgctatggcattccacctcactacgcgaaacggggagcctcatatgatcgtcggaaggcaggaaaagggtaaaagccttctgtttaagaccgaggacggagttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggccgaacttactggctatggtaccgtaacaatggagtgtagtcccaggaccgggctggatttcaacgaaatggtgttgctccagatggaggacaaagcatggctggtccaccggcaatggtttttagatctgcctctcccatggcttcccggcgctgacactcagggaagcaattggatacagaaggagacactggtgacgttcaagaaccctcatgccaaaaagcaggacgttgtggtcttgggctctcaagaaggggcgatgcacaccgccctaactggagcaacagagattcagatgtcctcaggtaatctgctctttaccggccatctgaaatgccgtcttcgcatggataagctgcagttgaaagggatgagctacagtatgtgtacaggaaagttcaagatcgtgaaagaaatcgctgagactcaacacggcaccattgtaatcagagttcagtatgagggtgacgggtctccatgcaagattcccttcgaaataatggatctcgagaaaaggcatgtgctgggccggttaatcacggtcaacccgattgtggccgaaaaggactcccctgtcaacatcgaggctgaacccccatttggagatagctacatcattataggcgtggagcctgggcagctgaaactaaattggttcaagaagggatcgtctatcggtcagatgtttgagaccacaatgcgaggcgccaaacgcatggcaattctcggggacactgcctgggatttcggatccctgggcggtgtttttacctcaatcgggaaggcacttcaccaagtgttcggcgcgatttacggagcagcctttagtggcgtaagctggacaatgaaaatcttgataggggtcatcattacttggatcggaatgaactccagatctaccagcctgtcagtgagtctcgttctggtgggcgtcgtgacgctttatctgggtgctatggtacaggccgactccgggtgtgtggttagctggaagtctaaagaattgaagtgcggatcaggcattttcatcacagataatgtccacacctggactgagcagtacaagtttcagcccgaaagtccaagcaaactcgcatccgccatacaaaaggctcatgaggaaggtatttgtggcatcaggtctgtgacacggctggagaacttaatgtggaaacagattacccccgagctgaatcacatcctatcggaaaacgaggtgaagctcactataatgaccggggacatcaaaggaattatgcaggccggcaagcgcagcctgagacctcagccaacagaacttaaatattcctggaagacgtgggggaaggcaaaaatgttgtcaaccgagagtcataatcaaactttcctgatcgatggaccggaaacagcggagtgccccaacaccaatagggcttggaactctctcgaggtcgaagactacggctttggtgttttcacaactaatatttggctgaagttacgtgagaaacaggacgtgttttgtgatagcaagctgatgtccgccgcaatcaaagacaaccgggccgtgcacgctgatatggggtattggatagaatcagcccttaatgacacctggaagatggagaaggccagcttcattgaggtaaaatcttgccactggcctaagtcccatacgttgtggagtaacggagtcctcgaaagcgagatgatcatccccaagaatttcgctggccccgtgtctcagcacaactaccgacctggttatcatacacagaccgccggcccatggcacctggggaagctagaaatggattttgacttctgtgagggaactaccgttgtggtcacagaagattgcggcaacagagggccctccctgaggactaccacagcgtcaggaaaactcattacggagtggtgctgtcgcagttgcaccctgccgcctcttcggtacagaggcgaggacggttgttggtacgggatggaaatcaggccattgaaggagaaggaagagaatctggtgaacagcttagttactgccggacatggccaaattgataatttttcgctcggtctgcttggcatggctctgttcttggaagagatgctccgcacacgagtggggaccaaacacgcaatgctgctagtagtcgtgtcctttgtgactctgataacaggaaacatgtctttccgggacctcggccgtgtcatggttatggtgggggccaccatgacggatgacatcggaatgggcattacttatctggctcttttggccgcatttaaggtaagacccaccttcgcggccggtctgttactcaggaaactgacaagcaaggagcttatgatggctaccatcgggattgccctgctatcacagagtactatccctgaaacaatactcgagctgaccgatgcattggctctgggaatgatggtgttaaaaatcgtccgcaatatggaaaagtaccagctcgccgtgacaattatggcaatctcctgcgttcccaacgccgtgattctgcaaaatgcttggaaggtctcttgtactatccttgcggccgtgagcgtttccccactgttgctcacctcaagccagcagaaagcagactggatacctctggctctaacgattaagggcctgaaccccacagccatctttcttaccactctcagtcggacctctaaaaagagatcctggccactgaatgaggccatcatggctgtgggcatggtcagcattttggcatcgtcactgctaaagaacgacataccgatgacagggcctctcgtagccggaggtctgcttactgtgtgctatgttctgaccggcaggtctgcggatttggaactcgagcgagctgccgacgtgaagtgggaggatcaggcagaaatcagtgggtccagccccattctgtctatcacgattagcgaggacggatccatgtcaatcaaaaatgaagaggaggaacaaacactaaccatactgatccgcactggccttctcgtcattagtggtgtgttcccagtaagcatccccattacagccgctgcatggtacctgtgggaggtgaagaagcagcgggccggggtcttgtgggatgttccttctccaccccctgtgggaaaagcggaattagaggacggcgcttatagaatcaagcagaggggcatactggggtactcccagattggagccggtgtgtataaagaaggcacctttcacactatgtggcatgtcacacgtggggcagtgctcatgcaccgcggaaagcggatcgagccgtcatgggccgatatcaaaaaggacctgattagttacggcggtgggtggaaacttgagggagaatggaaagagggcgaagaggttcaagtactggctttggaaccaggcaagaaccccagagccgtgcagaccaaacctgggctattcaagacgaatactggaaccatcggtgcagtcagcctggatttttccccaggcacatctgggtcgcccatagtggacaggaaaggaaaggttgtgggcctctacggtaacggggtcgtgacccgaagcggagcttatgtatcagccattgcgcagacagagaagtccatcgaggataatcctgaaattgaggacgatatcttccggaaaaagcgcctgactataatggaccttcatccgggcgccggcaaaaccaagagatacttacccgcaattgtcagggaagctatcaaacgggggctgcgaacgctcatcttggccccaacaagagtggttgctgcagagatggaagaggccctgcgcggactccctattaggtatcagactcccgccatccgtgctgagcacaccggtcgggaaattgtggacctgatgtgtcatgcgacattcaccatgagacttctgagtccagtcagggtgcctaactacaacttgataatcatggatgaggcacactttactgaccccgcctctattgctgcccgcggctatatcagcacccgagttgaaatgggggaggcagccggaatcttcatgacagctacgccaccgggctccagagatccttttccccaatcaaatgcgccaattatggacgaggaacgggagatacccgaaaggtcttggaacagcggtcacgagtgggtgactgatttcaaggggaagaccgtctggtttgtgcctagtatcaaagccggaaatgacattgcagcttgcctacgcaagaacggcaaaaaggtaatccagctgtcccgtaaaacattcgatagcgaatacgtgaagaccagagccaatgactgggattttgttgtcactacagacatttctgagatgggcgcaaacttcaaggccgagcgggtgatcgatccaaggcgctgtatgaaacccgtgatactcaccgacggggaagaacgagtcatcttagctggacctatgccggtaacgcattcatccgccgcgcagagacggggtaggattggccgcaatccaaagaacgaaaatgaccaatatatctacatgggggagcccctggaaaacgatgaggactgcgcacactggaaagaggccaagatgcttctggataatattaacactcctgaaggaatcatacccagtatgtttgagccagaaagagagaaagtggacgctattgatggcgaatacaggctccggggtgaggcccgtaagacattcgttgacttgatgcgccgaggggatctgcctgtgtggctcgcttatagagtcgcagccgagggcatcaattacgctgacaggcggtggtgttttgatggcattcgcaacaatcagatcctggaagagaacgtggaagttgagatatggaccaaagagggcgaaagaaagaaacttaaacccaggtggctagacgcccggatctatagcgatccactggcattgaaggagttcaaagagttcgcggccgggcgaaagtcgttaaccctgaacctcattactgagatgggaagactgcctacatttatgacccagaaagctcgcgacgcccttgataatctggcagtgctccatacagctgaagccggtggcagggcatacaaccacgccttgtctgagctgccggagactctagaaacgctgctccttctgaccttattggctacagtcactgggggaatcttcctgtttctcatgtccggcaagggtattgggaagatgaccctgggcatgtgctgcatcataacagcgagcattcttctgtggtatgcccagatccaaccccactggatcgcagcttcaattatcctcgagttctttttgatagtgctgttaattccagaacctgagaaacagcggacaccacaggacaatcagctaacttacgtagtgatcgccattctgacggttgtcgccgcaaccatggctaacgaaatgggattcctcgagaagaccaaaaaggaccttggcctggggagtatcgccactcaagagtctgaatccaatatattggatatcgacctgcgtccagcgagcgcttggaccctctatgccgtggcaacaacctttgtgactcctatgctgagacattcaattgagaacagtagcgtcaatgtttcccttacagccatcgctaaccaggcaacggtgctcatgggactgggtaaaggctggcccttgtctaagatggatattggggtaccgctgttagccatcggatgttacagccaggtgaatccaattaccctaactgcggctctgctccttctggtcgcccactacgcaatcataggccctggtttgcaggccaaggctacaagggaagcccaaaaacgcgcagctgccgggattatgaagaaccccaccgtggacggcatcaccgttatcgatctggagccaattccctatgaccctaaattcgaaaagcagctcggacaggtgatgctgcttatattatgcgtcacacaggtactgatgatgcggactacgtgggcgctctgtgaggccttgaccctggcaacaggcccgatctccactctatgggaggggaatcccggacgattttggaacaccacaattgctgtgtcaatggccaatatcttcagaggctcttacctggctggtgctgggctcctttttagtattatgaaaaacaccactaatacgaggcgcggaacaggcaacatcggtgaaaccctgggcgagaagtggaagtcgcggttgaatgccctggggaaaagcgagttccaaatatataagaaatccggaatccaggaggttgatagaactctcgccaaggagggcattaaacgtggggaaaccgaccatcacgcggtgtctaggggatcagctaagctgcggtggtttgtcgagcgcaacatggtgacaccagaaggcaaagtcgtggatttaggttgcgggcgaggaggctggagctactattgtggtggccttaagaacgttagagaggtgaaggggctgactaaaggaggccctgggcatgaagaacccatccctatgtccacctacggatggaatctcgtaaggctacagagtggcgtggacgtcttcttcacaccacccgagaagtgcgatacgctgttgtgtgacattggtgaatctagccctaacccaaccatcgaggcagggcggactctgcgcgttctcaatcttgtggaaaactggctgaataacaatacacaattttgcataaaagtcttgaacccctatatgccgtcagtgattgagaagatggaaaccctgcagagaaaatacggaggcgccctcgtaaggaatcctttatcccgaaacagtactcacgagatgtactgggtgagcaatgctacaggcaacatcgtttcttccgtgaatatgatctcacggatgctgattaaccgtttcaccatgaagcacaagaaagccacgtatgagccagatgtcgaccttgggagcggaaccagaaatataggtatcgaatcggagattcccaacctggacatcattggcaagcgcatcgagaaaataaagcaggaacatgaaacatcttggcactacgatcaggaccatccttataaaacttgggcataccacgggagttatgagaccaagcaaacaggatccgccagctcaatggtgaacggcgtcgtgaggctactcactaagccatgggatgttgtacccatggtgacccagatggctatgacagacaccactccgtttggtcagcagcgggtcttcaaagagaaggtggatacgagaacacaagaacctaaagaggggaccaagaaactgatgaagatcactgcggaatggttgtggaaggagctgggcaaaaagaaaacaccccgcatgtgtacaagggaggaatttacgcgaaaggttcggtccaatgccgcactcggcgctattttcaccgacgagaacaaatggaagtctgccagagaagcagtggaggatagcaggttttgggaacttatcgaccgcgagcgtaatctgcacttagagggcaaatgcgaaacttgtgtctacaacatgatggggaagcgggagaagaaactgggagagttcggtaaggccaaaggcagtagagctatttggtatatgtggttgggggccaggtttctcgagttcgaagcgctgggatttctaaatgaggatcattggttctcccgcggcaacagcctttctggtgtggagggggaaggactgcaccgactcggctacatcctgcgggacgtatcaaagaaagagggcggggcaatgtacgccgatgacacagctggatgggacaccagaattactttggaagatctgaagaatgaggaaatggtgacaaaccatatgaagggtgagcacaaaaagctcgccgaggcaatatttaaacttacctatcagaataaggttgtcagggtgcagcgcccaacacctagaggcactgtgatggacatcattagtcggagggatcagcgtgggtccggacaagtcggcacctacggtctgaacacgttcaccaatatggaagctcagttaatccgacagatggagggggaaggaatcttcaaaagcattcaacatctgacagttactgaggagatagccgtgcagaactggttggctcgcgtaggcagagaacggctctctaggatggccatctcgggcgacgattgcgtggtcaagcccctggacgatcgctttgcatcagcgctaaccgcccttaatgacatggggaaggtgagaaaagatattcagcagtgggagccaagccggggatggaacgactggacacaagttcccttctgctcccaccactttcatgaactggtgatgaaggatggtagggtcctcgtggtaccttgtcgaaatcaggacgagctgatcggccgtgctagaattagtcagggggccggatggtctttgaaagaaactgcatgcttaggcaagagctatgctcagatgtggaccctgatgtacttccaccgccgggatctcaggcttgccgcaaacgccatctgttccgcggttccatcacattgggtgccgacgagtagaacaacctggtctatacacgctaaacacgagtggatgactacagaggacatgctggccgtctggaaccgcgtgtggatccaagaaaatccctggatggaggacaagacccctgtggaaagctgggaggaagtcccatatctaggtaagcgggaggatcagtggtgcgggtccctgattggactcacttcaagggcaacctgggccaaaaacatccagacagctattaatcaggttcggagcttgatcggcaacgaggaatacacggactatatgccctctatgaagagatttagaagggaggaagaggaagccggcgtgctgtggtga

SEQ ID NO: 15016 - RNA, 9876 nt, synthetic construct
  misc_feature 1..9876: note = derived and/or modified CDS sequence (opt3) from DENV-2__GQ398301__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggccgaacttactggctatggtaccgtaacaatggagtgtagtcccaggaccgggctggatttcaacgaaatggtgttgctccagatggaggacaaagcatggctggtccaccggcaatggtttttagatctgcctctcccatggcttcccggcgctgacactcagggaagcaattggatacagaaggagacactggtgacgttcaagaaccctcatgccaaaaagcaggacgttgtggtcttgggctctcaagaaggggcgatgcacaccgccctaactggagcaacagagattcagatgtcctcaggtaatctgctctttaccggccatctgaaatgccgtcttcgcatggataagctgcagttgaaagggatgagctacagtatgtgtacaggaaagttcaagatcgtgaaagaaatcgctgagactcaacacggcaccattgtaatcagagttcagtatgagggtgacgggtctccatgcaagattcccttcgaaataatggatctcgagaaaaggcatgtgctgggccggttaatcacggtcaacccgattgtggccgaaaaggactcccctgtcaacatcgaggctgaacccccatttggagatagctacatcattataggcgtggagcctgggcagctgaaactaaattggttcaagaagggatcgtctatcggtcagatgtttgagaccacaatgcgaggcgccaaacgcatggcaattctcggggacactgcctgggatttcggatccctgggcggtgtttttacctcaatcgggaaggctcttcaccaagtgttcggcgcgatttacggagcagcctttagtggcgtaagctggacaatgaaaatcttgataggggtcatcattacttggatcggaatgaactccagatctaccagcctgtcagtgagtctcgttctggtgggcgtcgtgacgctttatctgggtgctatggtacaggccgactccgggtgtgtggttagctggaagtctaaagaattgaagtgcggatcaggcattttcatcacagataatgtccacacctggactgagcagtacaagtttcagcccgaaagtccaagcaaactcgcatccgccatacaaaaggctcatgaggaaggtatttgtggcatcaggtctgtgacacggctggagaacttaatgtggaaacagattacccccgagctgaatcacatcctatcggaaaacgaggtgaagctcactataatgaccggggacatcaaaggaattatgcaggccggcaagcgcagcctgagacctcagccaacagaacttaaatattcctggaagacgtgggggaaggcaaaaatgttgtcaaccgagagtcataatcaaactttcctgatcgatggaccggaaacagcggagtgccccaacaccaatagggcttggaactctctcgaggtcgaagactacggctttggtgttttcacaactaatatttggctgaagttacgtgagaaacaggacgtgttttgtgatagcaagctgatgtccgccgcaatcaaagacaaccgggccgtgcacgctgatatggggtattggatagaatcagcccttaatgacacctggaagatggagaaggcaagcttcattgaggtaaaatcttgccactggcctaagtcccatacgttgtggagtaacggagtcctcgaaagcgagatgatcatcccaaaaaatttcgctggccccgtgtctcagcacaactaccgacctggttatcatacacagaccgccggcccatggcacctggggaagctagaaatggattttgacttctgtgagggaactaccgttgtggtcacagaagattgcggcaacagagggccctccctgaggactaccacagcgtcaggaaaactcattacggagtggtgctgtcgcagttgcaccctgccgcctcttcggtacagaggcgaggacggttgttggtacgggatggaaatcaggccattgaaggagaaggaagagaatctggtgaacagcttagttactgccggacatggccaaattgataatttttcgctcggtgtgctgggcatggctcttttcctggaagagatgttgcgcacacgagtagggaccaaacacgcaatgctcctggtcgccgcttcctttgtgactctaataacaggaaacatgtctttccgggacctgggccgtgtgatggtcatggttggggccaccatgacggatgacatcggaatgggcattacttatctcgcactgcttgcggcctttaaggtgagacccaccttcgctgccggtttgctgttaaggaaactcacaagcaaggagctgatgatggcaaccatcgggattgctcttctgtcacagagtactatccctgaaacaatactagagctcaccgatgccctggcattgggaatgatggtactgaaaatcgtgcgcaatatggaaaagtaccagttagccgtcacaattatggctatctcctgcgtgcccaacgcggttattctccaaaatgcctggaaggtgtcttgtactatcctggcagctgtcagcgtgtccccacttctgttgacctcaagccagcagaaagccgactggatacctctcgccctgacgattaagggcctaaaccccacagctatctttctgaccactcttagtcggacctctaaaaagagatcctggccactcaatgaggcaatcatggccgttggcatggtgagcattctggcgtcgtcattgctgaaaaacgacataccgatgacagggcctttagtcgctggaggtctcctgactgtatgctatgtgcttaccggcaggtctgccgatctggaattggagcgagcagccgacgttaagtgggaggatcaggctgaaatcagtgggtccagccccattctctctatcacgattagcgaggacggatccatgtcaatcaaaaatgaagaggaggaacaaacactgaccatactaatccgcactggcctgcttgtgattagtggtgtcttcccagtgagcatccccattacagcagccgcgtggtacctctgggaggtaaagaagcagcgggctggggtgctgtgggatgtcccttctccaccccctgttggaaaagccgaattggaggacggcgcatatagaatcaagcagaggggcatattagggtactcccagattggagccggtgtgtataaagaaggcacctttcacactatgtggcatgtgacacgtggggctgtcctgatgcaccgcggaaagcggatcgagccgtcatgggccgatgtgaaaaaggacctcatcagttacggcggtgggtggaagctggagggagaatggaaagagggcgaagaggttcaagtacttgcactggaaccaggcaagaaccccagagctgtgcagaccaaacctgggttgttcaagacgaatactggaaccattggtgccgtcagcctagatttttccccaggcacatctgggtcgcccatcgtggacaggaaaggaaaggttgtgggcctgtacggtaacggggtcgtgacccgaagcggagcgtatgtatcagccatagcacagacagagaagtccattgaggataatcctgaaatcgaggacgatattttccggaaaaagcgcctcactatcatggacctgcatccgggcgctggcaaaaccaagagataccttcccgccatagtcagggaagctattaaacgggggttacgaacgctgatcctcgcaccaacaagagtggttgccgccgagatggaagaggctttgcgcggactgcctatcaggtatcagactcccgcgattcgtgcagagcacaccggtcgggaaatcgtggacctcatgtgtcatgccacattcaccatgagactgcttagtccagtcagggtgcctaactacaacctgattataatggatgaggctcactttactgaccccgcctctatcgcagcccgcggctatattagcacccgagttgaaatgggggaggctgcgggaatcttcatgacagccacgccaccgggctccagagatccttttccccaatcaaatgcaccaatcatggacgaggaacgggagattcccgaaaggtcttggaacagcggtcacgagtgggtgactgatttcaaggggaagaccgtctggtttgtgcctagtataaaagctggaaatgacatcgccgcatgcttgcgcaagaacggcaaaaaggtaattcagctatcccgtaaaacattcgatagcgaatacgtgaagaccagagccaatgactgggattttgttgtcactacagacatctctgagatgggcgctaacttcaaggccgagcgggtgattgatccaaggcgctgtatgaaacccgtgatcctgaccgacggggaagagcgagtcatactcgcgggacctatgccggtaacgcattcatccgcagcccagagacggggtaggatcggccgcaatccaaagaacgaaaatgaccaatatatttacatgggggagcccttagaaaacgatgaggactgcgctcactggaaagaggccaagatgctgcttgataatatcaacactcctgaaggaattatccccagtatgtttgagccagaaagagagaaagtggacgctatagatggcgaatacaggctgcggggtgaggcacgtaagacattcgttgacctcatgcgccgaggggatttgcctgtgtggctggcctatagagtcgctgccgagggcattaattacgcagacaggcggtggtgttttgatggaatcaaaaacaatcagattctcgaagagaacgtggaagttgagatctggaccaaggagggcgaacgcaagaaactgaagcccagatggcttgacgcgaggatatatagcgatccactagccctgaaagagttcaaggaattcgctgccgggcggaaatcgttgaccttaaacctgatcactgagatgggacgactccctacatttatgacccagaaggcaagagacgctctggataatcttgccgtgctgcatacagcagaagccggtggccgcgcttacaaccacgcgctctctgagttgccggagactctggaaacgctactgctccttaccctgttagccacagtcactgggggaattttcttgtttctgatgtccggcaagggtatcgggaaaatgaccctcggcatgtgctgcattatcacagcaagcatactgctttggtatgctcagattcaaccccactggatcgccgcctcaatcattctggagttctttctcatcgtgttgctgataccagaacctgagaagcagaggaccccccaggacaatcagttaacttacgtagtgattgcaatcctaacggttgtcgctgccaccatggcgaacgaaatgggattcctggagaaaacaaagaaagacctcggccttgggagtattgctactcaagagtctgaatccaatatcctggatatagacttgcggccagccagcgcatggaccctgtatgccgtggctacaacctttgtgactcctatgctccgtcattcaatcgagaacagtagcgtcaatgtttccctgacagcaattgccaaccaggcgacggtgcttatgggactcggtaagggctggcccctgtctaagatggatatcggggtaccgttgctggctattggatgttacagccaggtgaatccaatcaccttaactgccgcactactgctccttgtcgcccactacgctattatcggccctggtctgcaggccaaagcaacaagagaagctcaaaagagggccgcggccgggataatgaaaaaccccaccgtggacggcattaccgttatcgatttggagccaatcccctatgaccctaagttcgaaaaacagctgggacaggtgatgctcctgattctttgcgtcacacaggtattaatgatgcgcactacgtgggcactgtgtgaggctctcaccttggccacaggcccgatatccactctgtgggaggggaatcccggacggttttggaacaccacaatcgcagtgtcaatggctaatattttccgaggctcttacctagccggtgccgggctgctctttagtatcatgaagaacaccactaatacgagaaggggaacaggcaacattggtgaaacccttggcgagaagtggaaatcgcgcctgaatgcgttggggaagagcgaattccaaatctataaaaagtccggaatacaggaggttgatcggactctggctaaagagggcatcaagagaggggaaaccgaccatcacgcagtgtctcgtggatcagccaaactcaggtggtttgtcgagcggaacatggtgacaccagaaggcaaggtcgtggatctgggttgcgggcgcggaggctggagctactattgtggtggcttaaagaacgttcgagaggtgaaagggcttactaagggaggccctgggcatgaagagcccattcctatgtccacctacggatggaatctggtaagactccagagtggcgtggacgtcttcttcacaccacccgagaaatgcgatacgctactgtgtgacatcggtgaatctagccctaacccaaccattgaggctgggaggactttgcgggttctgaatctcgtggaaaactggcttaataacaatacacaattttgcatcaaggtcctgaacccctatatgccgtcagtgatagagaaaatggaaaccttgcagcgcaagtacggaggcgccctggtaagaaatcctctctccaggaacagtactcacgagatgtactgggtgagcaatgcaacaggcaacattgtttcttccgtgaatatgatctcacgaatgttaatcaaccggttcaccatgaagcacaaaaaggccacgtatgagccagatgtcgacctggggagcggaacccgtaatattggtatagaatcggagatccccaaccttgacattatcggcaaaagaattgaaaagatcaaacaggagcatgaaacatcttggcactacgatcaggaccatccttataagacttgggcttaccacgggagttatgagaccaagcaaacaggatccgcgagctcaatggtgaacggcgtcgtgcgcctgctaactaaaccatgggatgttgtacccatggtgacccagatggccatgacagacaccactccgtttggtcagcagagggtcttcaaggagaaagtggatacgcggacacaagaacctaaggaggggaccaaaaagctcatgaagataactgcagaatggctgtggaaagagttgggaaaggagaaaacccccagaatgtgtacacgcgaagagtttacgaggaaggttcgatccaatgctgccctgggcgcaatcttcaccgacgaaaacaaatggaagtctgcccgggaggctgtggaagatagcagattttgggagctcattgacagggagcgcaatcttcacctggaaggcaaatgcgagacttgtgtctacaacatgatggggaagcgtgaaaagaaattaggagagttcggtaaggccaaaggcagtcgggcgatctggtatatgtggctgggggcaagatttttggaattcgaggccctcggatttctgaatgaggatcattggttctccaggggcaacagcctatctggtgtggaaggggagggacttcaccgcctgggctacattctccgagacgtatcaaagaaagaaggcggggctatgtacgccgatgacacagcaggatgggacacccggatcactctggaggatttgaagaatgaagagatggtgacaaaccatatgaagggtgagcacaaaaagctggctgaagccatttttaaactcacctatcagaataaggttgtcagagtgcagaggccaacacctcgcggcactgtgatggacataatcagtagacgggatcagagggggtccggacaagtcggcacctacggtcttaacacgttcaccaatatggaggctcagctgattcgtcagatggaaggggagggaatcttcaaaagcatccaacatttaacagttactgaggaaattgccgtgcagaactggctggcacgagtaggccgcgagagattgtctcggatggcgatatcgggcgacgattgcgtggtcaagcccctcgacgataggtttgcctcagctctgaccgccctaaatgacatggggaaggtgcgcaaagatatccagcagtgggaaccaagcagaggatggaacgactggacacaagttcccttctgctcccaccactttcatgagcttgtgatgaaggatggtcgggtcctggtggtaccttgtaggaatcaggacgaactcattggccgagcacgtatcagtcagggggctggatggtctctgaaagagactgcctgcttgggcaagagctatgcacagatgtggaccttaatgtacttccacagacgcgatctgcggctcgccgcgaacgctatttgttccgccgttccatcacattgggtgccgacgagtaggacaacctggtctatccacgcaaaacacgagtggatgactacagaagacatgcttgccgtctggaacagagtgtggatacaagagaatccctggatggaagacaagacccctgtggagagctgggaagaggtcccatatctgggtaagcgcgaggatcagtggtgcgggtccctaatcggactgacttcacgggctacctgggccaaaaacattcagacagcaatcaatcaggttaggagcctcattggcaacgaagagtacacggactatatgccctctatgaagcgatttagacgggaagaggaagaggctggcgtgttgtggtga

SEQ ID NO: 15017 - RNA, 9876 nt, synthetic construct
  misc_feature 1..9876: note = derived and/or modified CDS sequence (opt3) from DENV-2__GQ398312__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggccgaacttactggctatggtaccgtaacaatggagtgtagtcccaggaccgggctggatttcaacgaaatggtgttgctccagatggaggacaaagcatggctggtccaccggcaatggtttttagatctgcctctcccatggcttcccggcgctgacactcagggaagcaattggatacagaaggagacactggtgacgttcaagaaccctcatgccaaaaagcaggacgttgtggtcttgggctctcaagaaggggcgatgcacaccgccctaactggagcaacagagattcagatgtcctcaggtaatctgctctttaccggccatctgaaatgccgtcttcgcatggataagctgcagttgaaagggatgagctacagtatgtgtacaggaaagttcaagatcgtgaaagaaatcgctgagactcaacacggcaccattgtaatcagagttcagtatgagggtgacgggtctccatgcaagattcccttcgaaataatggatctcgagaaaaggcatgtgctgggccggttaatcacggtcaacccgattgtggccgaaaaggactcccctgtcaacatcgaggctgaacccccatttggagatagctacatcattataggcgtggagcctgggcagctgaaactaaattggttcaagaagggatcgtctatcggtcagatgtttgagaccacaatgcgaggcgccaaacgcatggcaattctcggggacactgcctgggatttcggatccctgggcggtgtttttacctcaatcgggaaggctcttcaccaagtgttcggcgcgatttacggagcagcctttagtggcgtaagctggacaatgaaaatcttgataggggtcatcattacttggatcggaatgaactccagatctaccagcctgtcagtgagtctcgttctggtgggcgtcgtgacgctttatctgggtgctatggtacaggccgactccgggtgtgtggttagctggaagtctaaagaattgaagtgcggatcaggcattttcatcacagataatgtccacacctggactgagcagtacaagtttcagcccgaaagtccaagcaaactcgcatccgccatacaaaaggctcatgaggaaggtatttgtggcatcaggtctgtgacacggctggagaacttaatgtggaaacagattacccccgagctgaatcacatcctatcggaaaacgaggtgaagctcactataatgaccggggacatcaaaggaattatgcaggccggcaagcgcagcctgagacctcagccaacagaacttaaatattcctggaagacgtgggggaaggcaaaaatgttgtcaaccgagagtcataatcaaactttcctgatcgatggaccggaaacagcggagtgccccaacaccaatagggcttggaactctctcgaggtcgaagactacggctttggtgttttcagcacaaatatttggctgaagttacgtgagaaacaggacgtgttttgtgattccaagctgatgtcagccgcaatcaaagacaaccgggccgtgcacgctgatatggggtattggatagaaagcgcccttaatgacacttggaagatggagaaggcatctttcattgaggtaaaatcctgccactggcctaagagtcataccttgtggagcaacggagtcctcgaatctgagatgatcatcccaaaaaatttcgctggccccgtgtcccagcacaactaccgacctggttatcatacgcagacagccggcccatggcacctggggaagctagaaatggattttgacttctgtgagggaaccactgttgtggtcaccgaagattgcggcaacagagggccctcactgaggacaactaccgcgagtggaaaactcattacagagtggtgctgtcgcagctgcacgctgccgcctcttcggtacagaggcgaggacggttgttggtacgggatggaaatcaggccattgaaggagaaggaagagaatctggtgaactcgttagttaccgccggacatggccaaattgataatttttccctcggtgtgctgggcatggctcttttcctggaagagatgttgcgcactcgagtagggacaaaacacgcaatgctcctggtcgccgtgtcttttgtgaccctaataactggaaacatgagcttccgggacctgggccgtgtcatggttatggtgggggctacaatgaccgatgacatcggaatgggcattacgtatctcgccctgcttgcagcgtttaaggtaagacccactttcgccgctggtttgctgttaaggaaactcacctcaaaggagctgatgatggccacaatcgggattgcacttctgagtcagtccaccatccctgaaactatactagagctcacagatgctctggccttgggaatgatggtgctgaaaatcgtccgcaatatggaaaagtaccagttagcagtgaccattatggccatctcttgcgttcccaacgctgtgattctccaaaatgcgtggaaggtcagctgtacaatcctggccgcagtgtccgtttcaccacttctgttgactagcagtcagcagaaagctgactggatacctctcgccctgaccattaagggcctaaaccccacggccatctttctgacaaccctttctcggacttccaaaaagagaagctggccactcaatgaggctatcatggcagtgggcatggtctcgattctggcctcatctttgctgaaaaacgacataccgatgaccgggcctttagtagcgggaggtctcctgacagtgtgctatgttcttactggcaggagtgctgatctggaattggagcgagccgcagacgtgaagtgggaggatcaggccgaaatctccgggagctctcccattctcagcatcaccatttccgaggacggatcaatgagtatcaaaaatgaagaggaggaacaaacgctgacaatactaatccgcaccggcctgcttgtcattagcggtgtgttcccagtatctatccccattactgctgcagcctggtacctctgggaggtgaagaagcagcgggcgggggtcctgtgggatgttccttccccaccccctgtgggaaaagctgaattggaggacggcgcctatagaatcaagcagaggggcatattagggtactcacagattggagcaggtgtgtataaagaaggcacatttcacaccatgtggcatgtcactcgtggggccgtgctgatgcaccgcggaaagcggatcgagccgagttgggctgatgttaaaaaggacctcatcagctacggcggtgggtggaagctggagggagaatggaaagagggcgaagaggtacaagtgcttgccctggaaccaggcaagaaccccagagcagtccagacaaaacctgggttgttcaagaccaatacgggaactattggtgctgtgtccctagatttttctccaggcacctcggggagccccatcgttgacaggaaaggaaaggtggtcggcctgtacggtaacggggtggtaacacgatcaggagcctatgtctccgcgatagcccagaccgagaagagtattgaggataatcctgaaatcgaggacgatattttccggaaaaagcgcctcacaatcatggacctgcatccgggcgcaggcaaaactaagagataccttcccgctatagtgagggaagccattaaacgggggttacgaaccctgatcctcgctccaacgagagttgtggcagccgagatggaagaggccttgcgcggactgcctatcaggtatcagacacccgctattcgtgcggagcacactggtcgggaaatcgtcgacctcatgtgtcatgcaaccttcacaatgagactgctttctccagtgagggttcctaactacaacctgattataatggatgaggcccactttaccgaccccgctagcatcgccgcacgcggctatatttccactcgagtggaaatgggggaggccgctggaatcttcatgaccgcgacaccaccgggctcaagagatccttttccccaatctaatgccccaatcatggacgaggaacgggagattcccgaaaggagctggaacagtggtcacgagtgggtcacggatttcaaggggaagactgtgtggtttgtaccttccataaaagcaggaaatgacatcgctgcctgcttgcgcaagaacggcaaaaaggtgattcagctaagccgtaaaaccttcgattctgaatacgttaagacaagagcaaatgactgggattttgtcgtgaccactgacatctcagagatgggcgccaacttcaaggctgagcgggtgattgatccaaggcgctgtatgaaacccgtcatcctgacagacggggaagagcgagtaatactcgccggacctatgccggtgacccattccagtgcggcacagagacggggtaggatcggccgcaatccaaagaacgaaaatgaccaatatatttacatgggggagcccttagaaaacgatgaggactgcgcccactggaaagaggctaagatgctgcttgataatatcaacacgcctgaaggaattatccccagcatgtttgagccagaaagagagaaagttgacgccatagatggcgaatacaggctgcggggtgaggctcgtaagactttcgtggacctcatgcgccgaggggatttgcctgtctggctggcatatagagtggccgctgagggcattaattacgccgacaggcggtggtgttttgatggaatcaaaaacaatcagattctcgaagagaacgttgaagtggagatctggacaaaggagggcgaacgcaagaaactgaagcccagatggcttgacgcaaggatatattcggatccactagcgctgaaagagttcaaggaattcgccgctgggcggaaatctttgaccttaaacctgatcaccgagatgggacgactccctacttttatgacacagaaggccagagacgcactggataatcttgctgtcctgcataccgccgaagcaggtggccgcgcctacaaccacgctctctccgagttgccggagacactggaaactctactgctccttacgctgttagcgaccgtgacagggggaattttcttgtttctgatgagcggcaagggtatcgggaaaatgactctcggcatgtgctgcattatcaccgcctcaatactgctttggtatgcacagattcaaccccactggatcgctgccagtatcattctggagttctttctcatcgtattgctgataccagaacctgagaagcagaggacaccccaggacaatcagttaacctacgtggttattgccatcctaactgtcgtggcagctacgatggccaacgaaatgggattcctggagaaaaccaagaaagacctcggccttgggtctattgcgacacaagagtccgaaagcaatatcctggatatagacttgcggccagcttcagcctggactctgtatgcagtggccaccacatttgtcacccctatgctccgtcatagtatcgagaacagctccgttaatgtgtctctgactgctattgcaaaccaggccacagtacttatgggactcggtaagggctggcccctgagcaagatggatatcggggtgccgttgctggcgattggatgttactcccaggtcaatccaatcacgttaattgctgccctactgctccttgtggcacactacgccatcataggccctggtctgcaggctaaagccaccagagaagcacaaaagagggctgccgcggggattatgaaaaaccccactgttgacggcatcacagtgatcgatttggagccaattccctatgaccctaagttcgaaaaacagctgggacaggtcatgctcctgatactttgcgtaacccaggtgttaatgatgcgcaccacatgggccctgtgtgaggcactcactttggctacgggcccgatctcaaccctgtgggaggggaatcccggacggttttggaacacaactattgccgtttctatggcaaatatcttccgaggcagttacctagctggtgccgggctgctcttttcgattatgaagaacaccacaaataccagaaggggaactggcaacatcggtgaaacgcttggcgagaagtggaaaagccgcctgaatgccttggggaagtccgaattccaaatatataaaaagtctggaatccaggaggtggatcggacactggcgaaagagggcattaagagaggggaaaccgaccatcacgctgtctcacgtggaagcgcaaaactcaggtggtttgtggagcggaacatggtcactccagaaggcaaggtggttgatctgggttgcgggcgcggaggctggtcctactattgtggtggcttaaagaacgtgcgagaggtaaaagggcttaccaagggaggccctgggcatgaagagcccatccctatgagtacatacggatggaatctggtgagactccagtctggcgtcgacgttttcttcactccacccgagaaatgcgataccctactgtgtgacattggtgaaagctcacctaacccaacaatcgaggccgggaggacgttgcgggtgctgaatctcgtcgaaaactggcttaataacaatacccaattttgcataaaggtgctgaacccctatatgccgtccgtaattgagaaaatggaaactttgcagcgcaagtacggaggcgctctggtgagaaatcctctcagtaggaacagcacacacgagatgtactgggtttctaatgccaccggcaacatcgtgtcctcagtcaatatgatcagccgaatgttaattaaccggttcactatgaagcacaaaaaggcaacatatgagccagatgtggacctggggtcgggaacccgtaatataggtatcgaatctgagattcccaaccttgacatcattggcaaaagaatcgaaaagataaaacaggagcatgaaacgagttggcactacgatcaggaccatccttataagacctgggcctaccacgggtcctatgagacaaagcaaactggaagcgcttcatccatggtcaacggcgtggttcgcctgctaaccaaaccatgggatgtagtgcccatggtcacacagatggcgatgactgacaccacaccgtttggtcagcagagggtgttcaaggagaaagttgatacccggactcaagaacctaaggaggggacgaaaaagctcatgaagatcacagccgaatggctgtggaaagagttgggaaagaaaaagacccccagaatgtgtactcgcgaggaatttaccaggaaagtgcgatctaatgcagctctgggcgccattttcacagacgagaacaagtggaaaagcgcacgggaagccgtcgaggatagtagattttgggaactcatcgacagggagcgcaatcttcacctggagggcaagtgcgaaacgtgtgtgtacaacatgatggggaagcgtgagaaaaagttaggagaattcggtaaagctaagggctcccgggccatttggtatatgtggctgggggcgagatttttggagttcgaagcactcggatttctgaatgaggatcattggttcagcaggggcaactctctatcaggtgtagagggggaaggacttcaccgcctgggctacatcctccgagacgtgagtaaaaaggagggcggggccatgtacgctgatgacaccgccggatgggacactcggattacactggaagatttgaagaatgaggaaatggttaccaaccatatgaaaggtgagcacaagaaactggcagaggctatatttaagctcacttatcagaataaagtcgtgagagtgcagaggccaacacctcgcggcaccgtcatggacatcatttccagacgggatcagagggggagcggacaagttggcacatacggtcttaacactttcaccaatatggaagcccagctgatccgtcagatggagggggaaggaatcttcaagtctattcaacatttaacggtgaccgaggagatagctgtacagaactggctggcccgagtgggccgcgaaagattgtcgcggatggcaatctcaggcgacgattgcgtcgtgaagcccctcgacgataggtttgcgagcgccctgacagctctaaatgacatggggaaagttcgcaaggatattcagcagtgggagccatccagaggatggaacgactggactcaagtgcccttctgcagtcaccactttcatgaacttgtcatgaaagatggtcgggtgctggtagttccttgtaggaatcaggacgagctcatcggccgagcccgtatttctcagggggcaggatggagcctgaaggaaaccgcttgcttgggcaaatcctatgcccagatgtggacattaatgtacttccacagacgcgatctgcggctcgcagccaacgcgatctgttcagctgtgccaagtcattgggtcccgacttctaggaccacgtggagcatacacgccaagcacgagtggatgacaaccgaggacatgcttgcagtgtggaacagagtgtggatccaagaaaatccctggatggaggacaagactcctgtcgaatcctgggaggaagttccatatctgggtaaacgcgaggatcagtggtgcgggtcactaattggactgacaagccgggccacctgggctaagaacatccagactgccattaatcaggtgaggtctctcatcggcaacgaggaatacaccgactatatgccctccatgaaacgatttagacgggaggaagaggaagcaggcgtattgtggtga

SEQ ID NO: 15018 - RNA, 9876 nt, synthetic construct
  misc_feature 1..9876: note = derived and/or modified CDS sequence (opt3) from DENV-2__GQ398289__SS-prME
  source 1..9876: mol_type = other RNA
accgcaggcgtgatcattatgctgatacccacggctatggcattccacctcactacgagaaacggggagcctcatatgatcgtcggaagacaggaaaagggtaaaagccttctgtttaagaccgaggacggcgttaatatgtgcacattgatggcaattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcgccatcatggcagccattttggcttacacaatcggcaccacgcactttcagcgcgcactcattttcatcctgctgactgccgttgctccatccatgacaatgagatgcatagggatttctaacagggattttgtggaaggagtctcgggtggctcatgggtggacatcgtactcgagcacgggagctgtgttaccactatggccaagaataagcccacattagatttcgaactgattaaaaccgaggcgaagcagcctgcaacgcttcggaaatattgcatcgaagccaagttgaccaacacaactaccgagagtcgctgtccaacacaaggagagccctccctgaatgaagaacaggacaaacgatttgtgtgcaagcattctatggtcgatagaggctggggtaacgggtgtggactattcggcaagggcgggatcgtgacttgcgctatgtttacctgcaaaaagaatatggaaggaaaagtggtcctccctgagaacctggaatacacaattgttataaccccacacagcggtgaggagcatgccgtgggcaatgacactgggaagcacggaaaagaaatcaagattacgccgcagtcctcaatcacagaggcagaacttaccggctatggtactgtaaccatggagtgtagtcccaggacagggctggatttcaacgaaatggtgttgctccagatggaggacaaggcttggctggtccaccggcaatggtttttagatctgcctctcccatggcttcccggcgccgacacccagggaagcaattggatacagaaggagactctggtgacattcaagaaccctcatgcgaaaaagcaggacgttgtggtcttgggctctcaagaaggggccatgcacacggcactaaccggagctactgagattcagatgtcctcaggtaatctgctctttacaggccatctgaaatgccgtcttcgcatggataagctgcagttgaaagggatgagctacagtatgtgtaccggaaagttcaagatcgtgaaagaaatcgccgagacacaacacggcactattgtaatcagagttcagtatgagggtgacgggtctccatgcaagattcccttcgaaataatggatctcgagaaaaggcatgtgctgggccggttaatcaccgtcaacccgattgtgacggaaaaggactcccctgtcaacatcgaggctgaacccccatttggagatagctacatcattataggcgtggagcctgggcagctgaaactaaattggttcaagaagggatcgtctatcggtcagatgtttgagaccacaatgcgaggcgccaaacgcatggcaattctcggggacactgcctgggatttcggatccctgggcggtgtttttacctcaatcgggaaggcacttcaccaagtgttcggcgcgatttacggagcagcctttagtggcgtaagctggacaatgaaaatcttgataggggtcatcattacttggatcggaatgaactccagatctaccagcctgtcagtgagtctcgttctggtgggcgtcgtgacgctttatctgggtgctatggtacaggccgactccgggtgtgtggttagctggaagtctaaagaattgaagtgcggatcaggcattttcatcacagataatgtccacacctggactgagcagtacaagtttcagcccgaaagtccaagcaaactcgcatccgccatacaaaaggctcatgaggaaggtatttgtggcatcaggtctgtgacacggctggagaacttaatgtggaaacagattacccccgagctgaatcacatcctatcggaaaacgaggtgaagctcactataatgaccggggacacaaaaggaatcatgcaggccggcaagcgcagcctgagacctcagccaacggaacttaaatattcctggaagacctgggggaaggcaaaaatgttgtcaactgagagtcataatcaaacattcctgattgatggaccggaaaccgcggagtgccccaacacaaatagggcttggaactctctcgaggtcgaagactacggctttggtgttttcactaccaatatctggctgaagttacgtgagaaacaggacgtgttttgtgatagcaagctgatgtccgccgcaattaaagacaaccgggccgtgcacgctgatatggggtattggatcgaatcagcccttaatgacacgtggaagatggagaaggccagcttcatagaggtaaaatcttgccactggcctaagtcccatacattgtggagtaacggagtcctcgaaagcgagatgattatccccaaaaatttcgctggccccgtgtctcagcacaactaccgacctggttatcatacccagactgccggcccatggcacctggggaagctagaaatggattttgacttctgtgagggaaccacagttgtggtcactgaagattgcggcaacagagggccctccctgaggaccacaacggcgtcaggaaaactcatcaccgagtggtgctgtcgcagttgcactctgccgcctcttcggtacagaggcgaggacggttgttggtacgggatggaaattaggccattgaaggagaaggaagagaatctggtgaacagcttagttacagccggacatggccaaatcgataatttttcgctcggtgtgctgggcatggctcttttcctggaagagatgttgcgcacccgagtagggactaaacacgcaattctcctgatagccgtctcctttgtgacactaatcaccggaaacatgtctttccgggacctgggccgtgtgatggtcatggttggggctacgatgactgatgacattggaatgggcgtgacctatctcgccctgcttgcagcgtttaaggtaagacccacattcgccgctggtttgctgttaaggaaactcaccagcaaggagctgatgatggccactatcgggattgcacttctgtcacagagtacaatccctgaaaccatactagagctcacagatgctctggccttgggaatgatggtgctgaaaatcgtccgcaatatggaaaagtaccagttagcagtgactattatggccatctcctgcgttcccaacgctgtgattctccaaaatgcgtggaaggtctcttgtaccatcctggccgcagtgagcgtttccccacttctgttgacgtcaagccagcagaaagctgactggatacctctcgccctgacaattaagggcctaaaccccaccgccatctttctgactacccttagtcggacatctaaaaagagatcctggccactcaatgaggctatcatggcagtgggcatggtcagcattctggcctcgtcattgctgaaaaacgacataccgatgactgggcctttagtagcgggaggtctcctgaccgtgtgctatgttcttacgggcaggtctgctgatctggaattggagcgagccgcagacgtgaagtgggaggatcaggccgaaatcagtgggtccagccccattctctctatcacaattagcgaggacggatccatgtcaatcaaaaatgaagaggaggaacaaaccctgactatactaatccgcacaggcctgcttgtcattagtggtgtgttcccagtaagcatccccattaccgctgcagcctggtacctctgggaggtgaagaagcagcgggcgggggtcctgtgggatgttccttctccaccccctgtgggaaaagctgaattggaggacggcgcctatagaatcaagcagaggggcatattagggtactcccagattggagctggtgtgtataaagaaggcacttttcacacaatgtggcatgtcacccgtggggccgtgctgatgcaccgcggaaagcggatcgagccgtcatgggctgatgttaaaaaggacctcatcagttacggcggtgggtggaagctggagggagaatggaaagagggcgaagaggtacaagtgcttgccctggaaccaggcaagaaccccagagcagtccagacgaaacctgggttgttcaagactaataccggaacaattggtgctgtgagcctagatttttccccaggcacctctgggtcgcccatcgttgacaggaaaggaaaggtggtcggcctgtacggtaacggggtggtaacacgaagcggagcctatgtctcagcgatagcccagactgagaagtccattgaggataatcctgaaatcgaggacgatattttccggaaaaagcgcctcaccatcatggacctgcatccgggcgcaggcaaaacgaagagataccttcccgctatagtgagggaagccattaaacgggggttacgaacactgatcctcgctccaactagagttgtggcagccgagatggaagaggccttgcgcggactgcctatcaggtatcagacccccgctattcgtgcggagcacacaggtcgggaaatcgtcgacctcatgtgtcatgcaaccttcactatgagactgcttagtccagtgagggttcctaactacaacctgattataatggatgaggcccactttaccgaccccgcttctatcgccgcacgcggctatattagcacacgagtggaaatgggggaggccgctggaatcttcatgacggcgactccaccgggctccagagatccttttccccaatcaaatgccccaatcatggacgaggaacgggagattcccgaaaggtcttggaacagcggtcacgagtgggtcaccgatttcaaggggaagacagtgtggtttgtacctagtataaaagcaggaaatgacatcgctgcctgcttgcgcaagaacggcaaaaaggtgattcagctatcccgtaaaaccttcgatagcgaatacgttaagactagagcaaatgactgggattttgtcgtgacaaccgacatctctgagatgggcgccaacttcaaggctgagcgggtgattgatccaaggcgctgtatgaaacccgtcatcctgacggacggggaagaacgagtaatactcgccggacctatgccggtgactcattcatccgcggcacagagacggggtaggatcggccgcaatccaaagaacgaaaatgaccaatatatttacatgggggagcccttagaaaacgatgaggactgcgcccactggaaagaggctaagatgctgcttgataatatcaacacacctgaaggaattatccccagtctgtttgagccagaaagagagaaagttgacgccatagatggcgaatacaggctccggggtgaggctcgtaagaccttcgtggacttgatgcgccgaggggatctgcctgtctggctcgcatatagagtggccgctgagggcattaattacgccgacaggcggtggtgttttgatggaatcaaaaacaatcagattctggaagagaacgttgaagtggagatctggaccaaggagggcgaacgcaagaaacttaagcccagatggctagacgcaaggatatatagcgatccactggcgttgaaagagttcaaggagttcgccgctgggcggaaatcgttaactctgaacctcatcacagagatgggacgactgcctacctttatgacacagaaggccagagacgcacttgataatctggctgtcctccatactgccgaagccggtggacgcgcatacaaccacgctttgtctgagctgccggagacgctagaaaccctgctccttctgacattattggcgactgtgaccgggggaattttcctgtttctcatgtccggcaggggtatcgggaagatgacactgggcatgtgctgcattatcaccgccagcatacttctgtggtatgcacagattcaaccccactggatcgctgcctcaatcattctcgagttctttttgatcgtactgttaataccagaacctgagaaacagcggactccccaggacaatcagctaacgtacgtggttattgccatcctgaccgtcgtggcagctacaatggccaacgaaatgggattcctcgagaagactaaaaaggaccttggcctggggagtattaccacacaagagtctgaatccaatatcttggatatagacctgcgtccagcgagcgcttggaccctctatgccgtggcaactacatttgtcacgcctatgctgagacattcaatcgagaacagtagcgttaatgtgtcccttaccgccattgctaaccaggcaactgtactcatgggactgggtaaaggctggcccttgtctaagatggatatcggggtgccgctgttagccattggatgttacagccaggtcaatccaatcacactaaccgcggctctgctccttctggtggcccactacgcaattatcggccctggtttgcaggccaaggctaccagggaagcccaaaaacgcgcagctgccgggataatgaagaaccccacagttgacggcattactgtgatcgatctggagccaatcccctatgaccctaaattcgaaaagcagctcggacaggtcatgctgcttattttatgcgtaacacaggtgctgatgatgcggaccacatgggcgctctgtgaggccttgactctggcaaccggcccgatatccacactatgggaggggaatcccggacgattttggaacaccactatcgctgtttcaatggccaatattttcagaggctcttacctggccggtgctgggctcctttttagtatcatgaaaaacacgacaaataccaggcgcggaactggcaacattggtgaaaccctgggcgagaagtggaagtcgcggttgaatgccctggggaaaagcgagttccaaatctataagaaatccggaatacaggaggtggatagaacactcgccaaggagggcatcaaacgtggggaaactgaccatcacgcggtctctaggggatcagctaagctgcggtggtttgtggagcgcaacatggtcaccccagaaggcaaagtggttgatttaggttgcgggcgaggaggctggagctactattgtggtggccttaagaacgtgagagaggtaaaggggctgacaaaaggaggccctgggcatgaagaaccaattcctatgtccacgtacggatggaatctcgtgaggctacagagtggcgtcgacgttttcttcaccccacccgagaagtgcgatactctgttgtgtgacatcggtgaatctagccctaacccaacaattgaggcagggcggaccctgcgcgtgctcaatcttgtcgaaaactggctgaataacaatactcaattttgcatcaaagtgttgaacccctatatgccgtcagtaatagagaagatggaaacactgcagagaaaatacggaggcgccctcgtgaggaatcctttatcccgaaacagtacccacgagatgtactgggttagcaatgctacgggcaacattgtgtcttccgtcaatatgatctcacggatgctgatcaaccgtttcaccatgaagcacaagaaagccacatatgagccagatgtggaccttgggagcggaactagaaatattggtatagaatcggagatccccaacctggacattatcggcaagcgcattgagaaaatcaagcaggaacatgaaacctcttggcactacgatcaggaccatccttataaaacatgggcataccacgggagttatgagactaagcaaaccggatccgccagctcaatggtcaacggcgtggttaggctactcacaaagccatgggatgtagtgcccatggtcacccagatggctatgactgacacgacaccgtttggtcagcagcgggtgttcaaagagaaggttgataccagaactcaagaacctaaagaggggaccaagaaactgatgaagataacagcggaatggttgtggaaggagctgggcaaaaagaaaacgccccgcatgtgtaccagggaggaatttactcgaaaagtgcggtccaatgccgcactcggcgctatcttcacagacgagaacaaatggaagtctgccagagaagcagtcgaggatagcaggttttgggaacttattgaccgcgagcgtaatctgcacttagagggcaaatgcgaaacctgtgtgtacaacatgatggggaagcgggagaagaaactgggagagttcggtaaggccaaaggcagtagagctatctggtatatgtggttgggggccaggtttctcgagttcgaagcgctgggatttctaaatgaggatcattggttctcccgccgaaacagcctttctggcgtagagggtgaagggctgcaccggctcggatacattctgagagacgtgtcaaagaaagagggcggcgcaatgtacgccgatgacactgctgggtgggacacaaggatcaccttggaagatctgaagaatgaggaaatggttacaaaccatatgaagggagagcacaaaaagctcgccgaggcaatttttaaacttacttatcagaataaggtcgtgcgcgtgcagagaccaacccctcggggtacggtcatggacataatcagtaggcgtgatcagcgaggctccgggcaagttggaacctacggcctgaacacattcactaatatggaagctcagttaattcgccagatggagggtgaagggatcttcaaaagcatccaacatctgaccgtgacagaggagattgccgtacagaactggttggctagagtgggacgggaaaggctctctcgcatggccatatcgggcgacgattgcgtcgtgaagcccctggacgatagatttgcatcagcgctaactgcccttaatgacatgggcaaggttcggaaagatatccagcagtgggagccaagcagggggtggaacgactggacccaagtgcccttctgctcccaccactttcatgaactggtcatgaaggatggacgagtgctcgtagttccttgtcgtaatcaggacgagctgattggtagagctcgcatcagtcagggcgccgggtggtctttgaaagaaacggcatgcttaggaaagagctatgctcagatgtggacactgatgtacttccaccggagggatctcagacttgccgcaaacgccatttgttccgcggtgccatcacattgggtcccgaccagtcgcactacatggtctatccacgctaaacacgagtggatgaccactgaggacatgctggccgtgtggaaccgggtgtggatacaagaaaatccctggatggaggacaagacccctgtcgaaagctgggaggaagttccatatctaggcaagagggaggatcagtggtgcggttccctgatcgggctcacatcacgagcaacgtgggccaaaaacattcagaccgctatcaatcaggtgaggagcttgattggaaacgaggaatacactgactatatgccctctatgaagcggtttaggcgcgaggaagaggaagccggcgtactgtggtga

SEQ ID NO: 15019 - RNA, 9876 nt, synthetic construct
  misc_feature 1..9876: note = derived and/or modified CDS sequence (opt3) from DENV-2__GQ398290__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacttcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgattttaacgaaatggtgctgttgcagatggaggacaaagcatggctcgtccaccggcaatggttcctggatttacctctgccatggctccccggcgctgacactcagggaagcaattggatacagaaggagacacttgtgacgtttaagaaccctcatgccaaaaagcaggacgttgtggtcctgggctctcaagaaggggcgatgcacaccgccttgactggagcaacagagattcagatgtcctcaggtaatctactgttcaccggccatctcaaatgccgtctgcgcatggataagcttcagctgaaagggatgagctacagtatgtgtacaggaaagttcaagatcgtgaaagaaatcgctgagactcaacacggcaccattgtaatcagagttcagtatgagggtgacgggtctccatgcaagattccctttgaaataatggatttggagaaaaggcatgtgctcggccggctgatcacggtcaacccgattgtgaccgaaaaggactcccctgtcaacatcgaggccgaacccccattcggagatagctacatcattataggcgtggagcctgggcagttaaaactgaattggtttaagaagggatcgtctatcggtcagatgttcgagacaactatgcgaggcgctaaacgcatggccattctaggggacaccgcatgggattttggatccctcggcggtgttttcacatcaatcgggaaggccctgcaccaagtgtttggcgctatttacggagcggcattcagtggcgtaagctggactatgaaaatccttataggggtcatcattacctggatcggaatgaactccagatctacgagcttgtcagtgagtctggttctcgtgggcgtcgtgacactgtatcttggtgccatggtacaggctgactccgggtgtgtggttagctggaagtctaaagaactgaagtgcggatcaggcatttttatcaccgataatgtccacacttggacagagcagtacaagttccagcccgaaagtccaagcaaattggcctccgcaatacaaaaggcccatgaggaaggtatttgtggcatcaggtctgtgacccggctcgagaacctgatgtggaaacagattactcccgagttaaatcacatcctgtcggaaaacgaggtgaagctaaccataatgacaggggacatcaaaggaattatgcaggctggcaagcgcagcctcagacctcagccaacggaactgaaatattcctggaagacctgggggaaggccaaaatgctttcaactgagagtcataatcaaacatttttgatcgatggaccggaaaccgcagagtgccccaacacaaatagggcgtggaactctctggaggtcgaagactacggcttcggtgtttttactaccaatatttggctcaagctgcgtgagaaacaggacgtgttctgtgatagcaagttaatgtccgctgccatcaaagacaaccgggcagtgcacgccgatatggggtattggatagaatcagctctgaatgacacgtggaagatggagaaggccagcttcattgaggtaaaatcttgccactggcctaagtcccatacactttggagtaacggagtcttggaaagcgagatgatcatcccaaaaaattttgcaggccccgtgtctcagcacaactaccgacctggttatcatacccagactgctggcccatggcacctcgggaagctggaaatggatttcgacctatgtgagggaaccacagttgtggtcactgaaaactgcggcaatagagggccctccctgaggaccacaacggcctcaggaaaactcattaccgagtggtgctgtcgcagttgcactctgccgcctcttcggtacagaggcgaggatggttgttggtacgggatggaaatcaggccattgaaggagaaggaagagaacctggtgaatagcttagttacagcgggacatggccaaattgacaacttttcgctcggtgtgctgggcatggcccttttcctggaagagatgttgcgcacccgagtagggactaaacacgctatactcctggtcgcagtgtcctttgtgacactaatcaccggaaatatgtctttccgggatctgggccgtgtcatggttatggtgggggccacgatgactgacgatattggaatgggcgtaacctatctcgctctgcttgccgcatttaaggtgagacccacattcgcggccggtttgctgttaaggaaactcaccagcaaggagctgatgatggctactatcgggattgcccttctgtcacagagtacaatccctgaaaccatactagagctcacagacgcactggctttgggaatgatggtcctgaaaatcgtgcgcaacatggaaaagtaccagttagccgttactattatggcaatctcctgcgtgcccaatgccgtcattctccaaaacgcttggaaggtgtcttgtaccatcctggcggccgttagcgtgtccccacttctgttgacgtcaagccagcagaaagcagattggatacctctcgctctgacaattaagggcctaaatcccaccgccatctttctgactacccttagtcggacatctaaaaagagatcctggccactcaacgaggccatcatggctgtcggcatggtaagcattctggcatcgtcattgctgaaaaatgacataccgatgactgggcctttagtggccggaggtctcctgaccgtttgctatgtgcttacgggcaggtctgcggacctggaattggagcgagctgccgatgtcaagtgggaggaccaggcagaaatcagtgggtccagccccattctctctatcacaattagcgaggatggatccatgtcaatcaaaaacgaagaggaggaacaaaccctgactatactaatccgcacaggcctgcttgtgattagtggtgtattcccagtgagcatccccattaccgccgctgcatggtacctctgggaggtcaagaagcagcgggccggggttctgtgggacgtgccttctccaccccctgtgggaaaagcggaattggaggatggcgcttatagaatcaagcagaggggcatattagggtactcccagattggagccggtgtctataaagaaggcacttttcacacaatgtggcatgtgacccgtggggcagttctgatgcaccgcggaaagcggatcgagccgtcatgggccgacgtaaaaaaggatctcatcagttacggcggtgggtggaagctggagggagaatggaaagagggcgaagaggtgcaagtccttgctctggaaccaggcaagaatcccagagccgtgcagacgaaacctgggttgttcaagactaacaccggaacaattggtgcagttagcctagacttttccccaggcacctctgggtcgcccatcgtggataggaaaggaaaggtcgtgggcctgtacggtaatggggtagtcacacgaagcggagcttatgtgtcagccatagcgcagactgagaagtccattgaggacaaccctgaaatcgaggatgacattttccggaaaaagcgcctcaccatcatggatctgcatccgggcgccggcaaaacgaagagataccttcccgcaatagttagggaagctattaaacgggggttacgaacactgatcctcgccccaactagagtggtcgctgcagagatggaagaggccttgcgcggactgcctatcaggtatcagacccccgccattcgtgctgagcacacaggtcgggaaatcgtggacctcatgtgtcatgcgaccttcactatgagactgcttagtccagttagggtgcctaactacaatctgattataatggacgaggcacactttaccgatcccgcctctatcgctgcccgcggctatattagcacacgagtcgaaatgggggaggcagccggaatcttcatgacggctactccaccgggctccagagacccttttccccaatcaaacgcgccaatcatggatgaggaacgggagattcccgaaaggtcttggaatagcggtcacgagtgggtgaccgacttcaaggggaagacagtatggtttgtgcctagtataaaagccggaaacgatatcgcagcttgcttgcgcaagaatggcaaaaaggttattcagctatcccgtaaaaccttcgacagcgaatacgtcaagactagagccaacgattgggactttgtggtgacaaccgatatctctgagatgggcgcaaatttcaaggccgagcgggtcattgacccaaggcgctgtatgaaacccgtaatcctgacggatggggaagagcgagtgatactcgctggacctatgccggttactcattcatccgccgcgcagagacggggtaggatcggccgcaacccaaagaatgaaaacgaccaatatatttacatgggggagcccttagaaaatgacgaggattgcgcacactggaaagaggccaagatgctgcttgacaacatcaatacacctgaaggaattatccccagtatgtttgagccagaaagagagaaagtggatgctatagacggcgaatacaggctgcggggtgaggcccgtaagaccttcgtcgatctcatgcgccgaggggacttgcctgtgtggctggcttatagagttgcagccgagggcattaactacgctgataggcggtggtgttttgacggaatcaaaaataaccagattctcgaagagaacgtggaagtcgagatctggaccaaggagggcgaacgcaagaaactgaagcccagatggcttgatgccaggatatatagcgacccactagcactgaaagagttcaaggaattcgcggccgggcggaaatcgttgactttaaatctgatcacagagatgggacgactccctacctttatgacacagaaggctagagatgccctggacaaccttgcagtgctgcatactgctgaagccggtggccgcgcatacaatcacgccctctctgagttgccggagacgctggaaaccctactgctccttacactgttagctactgtaaccgggggaattttcttgtttctgatgtccggcaggggtatcgggaagatgacactcggcatgtgctgcattatcaccgcgagcatactgctttggtatgcccagattcaaccccactggatcgcagcttcaatcattctggagttctttctcatcgtgttgctgataccagaacctgagaaacagcggactccccaggataaccagttaacgtacgttgtcattgccatcctaaccgtggtggccgcaacaatggctaatgaaatgggattcctggagaagactaaaaaggacctcggccttgggagtattaccacacaagagtctgaatccaacatcctggacatagatttgcgtccagccagcgcgtggaccctgtatgctgtcgccactacatttgttacgcctatgctcagacattcaatcgagaatagtagcgtgaacgtatccctgaccgcaattgccaatcaggctactgtgcttatgggactcggtaaaggctggcccctgtctaagatggacatcggggtcccgttgctggcaattggatgttacagccaggtgaacccaatcacattaaccgccgcgctactgctccttgttgctcactacgccattatcggccctggtctgcaggcaaaggccaccagggaagctcaaaaacgcgccgcagctgggataatgaagaatcccacagtggatggcattactgtcatcgacttggagccaatcccctatgatcctaaattcgaaaagcagctgggacaggtaatgctcctgattctttgcgtgacgcaggttttaatgatgcggaccacatgggccctgtgtgaggcgctcactttggccaccggcccgatatccacactgtgggaggggaaccccggacgattttggaataccactatcgcagtgtcaatggctaacattttcagaggctcttacctagccggtgcagggctgctctttagtatcatgaaaaatacgacaaacaccaggcgcggaactggcaatattggtgaaacccttggcgagaagtggaagtcgcggctgaacacattggggaaaagcgaattccaaatctataagaaatccggaatacaggaggtcgacagaactctggctaaggagggcatcaaacgtggggaaaccgatcatcacgccgtgtctaggggatcagccaagctccggtggtttgtcgagcgcaacatggtgacaccagaaggcaaagttgtggacctgggttgcgggcgaggaggctggagctactattgtggtggcttaaagaatgtaagagaggtgaaggggcttacgaaaggaggccctgggcatgaagagcccattcctatgtccacctacggatggaacctggtcaggctccagagtggcgttgatgtgttcttcactccacccgagaagtgcgacacactactgtgtgatatcggtgaatctagccctaatccaaccattgaggcggggcggactttgcgcgtcctgaacctcgtggaaaattggcttaacaataacacacaattttgcatcaaagtactgaatccctatatgccgtcagtgatagagaagatggaaaccttgcagagaaaatacggaggcgctctggttaggaaccctctctcccgaaatagtacgcacgagatgtactgggtgagcaacgcaaccggcaatattgtctcttccgtgaacatgatctcacggatgttaatcaatcgtttcacaatgaagcacaagaaagccacttatgagccagacgtcgatctggggagcggaaccagaaacattggtatagaatcggagatccccaaccttgacattatcggcaagcgcattgaaaaaatcaagcaggagcatgaaacatcttggcactacgaccaggatcatccttataaaacttgggcttaccacgggagttatgagaccaagcaaacaggatccgccagctcaatggtgaatggcgttgtaaggctgctaaccaagccatgggacgtggtccccatggtgactcagatggcaatgacggatacaaccccgtttggtcagcagcgggttttcaaagagaaggtggacactagaacccaagaacctaaagaggggacaaagaaactcatgaagataacggccgaatggctgtggaaggagttgggaaaaaagaaaaccccccgcatgtgtactagggaggaatttacacgaaaggtccggtccaacgctgcgctgggcgccatcttcaccgatgagaataaatggaagtctgcaagagaagctgtggaggacagcaggttttgggaactcattgatcgcgagcgtaaccttcacctggagggcaaatgcgaaacttgtgtatacaatatgatggggaagcgggagaagaaattaggagaattcggtaaggccaaaggcagtagagcaatctggtatatgtggctgggggccaggtttttggagttcgaagctctcggatttctgaacgaggaccattggttctcccgcggcaatagcctatctggtgtggagggggaaggacttcaccgactgggctacattctccgggatgtttcaaagaaagagggcggggccatgtacgcggacgatacagcaggatgggacaccagaatcacactggaagacttgaagaacgaggaaatggtcactaatcatatgaagggtgagcacaaaaagctggccgaggctatttttaaactcacctatcagaacaaggtggtgagggtccagcgcccaacgcctagaggcaccgttatggatataatcagtcggagggaccagcgtgggtccggacaagtgggcacatacggtcttaatactttcaccaacatggaagcccagctgattcgacagatggagggggaaggaatcttcaaaagcatccaacatttaacagcaactgaggagattgctgtacagaattggctggcccgcgtgggcagagaacggttgtctaggatggctatatcgggcgatgactgcgtcgtgaagcccctcgatgaccgctttgcctcagcactgaccgcgctaaacgatatggggaaggttagaaaagacatccagcagtgggagccaagccggggatggaatgattggacgcaagtgcccttctgctcccaccactttcatgaacttgtcatgaaggacggtagggtgctggtagttccttgtcgaaaccaggatgagctcattggccgtgccagaatcagtcagggggctggatggtctctgaaagaaacagcctgcttgggcaagagctatgcacagatgtggaccttaatgtacttccaccgccgggacctgaggctcgctgccaacgcaatttgttccgccgtgccatcacattgggtcccgactagtagaacaacctggtctatccacgcgaaacacgagtggatgactaccgaggatatgcttgctgtgtggaatcgcgtgtggatacaagaaaacccctggatggaggacaagacacctgtcgaaagctgggaggaagttccatatctgggtaagcgggaggaccagtggtgcgggtccctaatcggactgacgtcaagggccacctgggcaaaaaatattcagactgccatcaaccaggtgcgaagcctcattggcaatgaggaatacacagattatatgccctctatgaagagatttcggagggaggaagaggaagctggcgtattgtggtga

SEQ ID NO: 15020 - RNA, 9876 nt, synthetic construct
  misc_feature 1..9876: note = derived and/or modified CDS sequence (opt3) from DENV-2__GQ398284__SS-prME
  source 1..9876: mol_type = other RNA
accgccggcgtgatcattatgctgatacccacagctatggcgttccacctcactacgcggaatggggagcctcatatgatcgtcggaaagcaggaaaagggtaagagccttctgtttaaaaccgaggacggcgttaatatgtgcacattgatggccattgatttaggggaactgtgtgaggacactatcacctacaagtgcccactactcaggcaaaacgaaccggaggatattgactgttggtgcaattccacatctacctgggtgacttatggaacatgtaccacgactggcgagcaccggcgcgaaaaacgatcagtggcgctggtgccccatgtcggtatggggcttgagacccgtacagaaacttggatgagtagcgagggagcttggaagcacgtgcagcggatcgagacctggatactgaggcatcctggcttcacaatcatggccgctattttggcctacaccatcggcacgactcactttcagcgggctctcattttcatcctgctgacagcagttgccccatccatgaccatgcgctgcatagggatttctaacagagattttgtggaaggagtctcgggtggctcatgggtggacatcgtcctcgagcacgggagctgtgttactacaatggctaagaataaacccaccttagatttcgaactgattaagacggaggccaaacagcctgcgacccttaggaagtattgcatcgaagcaaaattgacaaacactaccacagagagtcggtgtccaactcaaggagagccctccctgaatgaggaacaggacaagcgctttctatgcaagcattctatggtggatcgaggctggggtaacgggtgtggactcttcggcaaaggcgggatcgtaacctgcgccatgtttacatgcaagaaaaatatggaaggaaaggtggtgcagcctgagaacctggaatacaccattgtcataactccacacagcggtgaggagcatgctgttggcaatgacacggggaaacacggaaaggaaatcaaaattacaccgcagtcctcaatcaccgaggccgaacttactggctatggtaccgtgacaatggagtgtagtcccagaaccgggctggatttcaacgaaatggtattgctccaaatggaggacaaggcatggctggtgcacaggcagtggtttttagatctgcctctcccatggcttcccggcgctgacactcagggaagcaattggatacagaaggagacactggtcacgttcaaaaaccctcatgccaagaaacaagacgtggttgcgttgggctctcaggaaggggccatgcacaccgcactaactggagctacagagattcagatgtcctcaggtaatctgctctttaccggccatctgaagtgccggcttcgtatggataaactgcaattgaaggggatgagctacagtatgtgtacaggaaagttcaaaatcgtgaaggaaatcgccgagactcagcacggcaccattgtcatccgcgtgcagtatgagggtgacgggtctccatgcaaaattcccttcgaaataatggatctcgagaagagacatgtactgggcaggttaatcacggttaacccgattgtgaccgaaaaagactcccctgtcaacatcgaggctgaacccccatttggagatagctacatcattataggcgtggagcctgggcagctgaagctaaattggttcaagaaaggatcgtctatcggtcaaatgtttgagacaactatgcggggcgccaagcgaatggcaattctcggggacaccgcctgggatttcggatccctgggcggtgtctttacatcaatcgggaaagcacttcaccaggtgttcggcgcgatttaccgcgcagcctttagtggagttagctggactatgaagatcttgataggcgtgatcattacctggatcgggatgaactccagatctacgagcctgtcagtaagtctcgtcctggtgggagttgtgacactttatctgggcgctatggtccaggccgactccggttgtgtggtaagctggaaaaataaggaattgaagtgcgggtctggaattttcatcaccgataacgtgcacacttggacagagcagtacaaatttcaacccgaatcaccaagtaagctcgcaagcgccatacagaaagctcatgaggaaggcatttgtggtatcaggtccgttacccggctggagaatttaatgtggaagcagattactcccgagctgaaccacatcctatctgaaaatgaggtcaaactcaccataatgacaggcgacatcaaggggattatgcaggccggaaaacgctcgctgagacctcaaccaacggaacttaagtatagctggaagacctggggcaaagcaaagatgttgtccactgagtcacataaccagacattcctgatcgatgggccggaaaccgcggagtgccccaatacaaacagggcttggaatagtctcgaggtggaagactacggatttggcgtgttcactaccaacatttggctgaaattacgtgagaagcaggacgtcttttgtgattctaaactgatgagcgccgcaatcaaggacaatcgggccgttcacgctgatatgggttattggatagaatccgcccttaacgacacgtggaagatggagaaagcatcattcattgaggtaaagagctgccactggcctaaatctcatacattgtggtccaatggggtgctcgaaagtgagatgatcatcccaaagaacttcgctggacccgtaagccagcacaactaccgacctggctatcatacccaaactgccggtccatggcacctgggcaaactagaaatggattttgacttctgtgaggggaccacagtcgtggttactgaagattgcggaaatagaggcccctctctgaggaccacaacggcgtccgggaagctcattaccgagtggtgctgtcgctcatgcactctgccgcctcttcggtacagaggagaggacggctgttggtacggtatggaaatcaggccattgaaggagaaagaagagaacctggtgaatagtttagtcacagccgggcatggacagattgataactttagcctcggcgtgctgggtatggctcttttcctggaagagatgttgcgcacccgagttggcactaagcacgcaatactcctggtggccgtatcgtttgtcacactaatcaccgggaatatgtccttccgggacctgggacgtgtgatggtgatggtcggcgctacgatgactgatgacattgggatgggagttacctatctcgccctgcttgcagcgtttaaagtgagacccacattcgccgctggcttgctgttaaggaagctcacctctaaagagctgatgatggccactatcggtattgcacttctgagccagtcaacaatccctgaaaccatactagagctcacagatgctctggccttggggatgatggtactgaagatcgtgcgcaacatggaaaagtaccaattagcagtcactattatggccatcagttgcgtgcccaatgctgttattctccagaacgcgtggaaagtgtcctgtaccatcctggccgcagtctctgtgagcccacttctgttgacgtcctcacagcagaaggctgactggatacctctcgccctgacaattaaaggactaaatcccaccgccatctttctgactacccttagccggacaagtaagaaaagatcttggccactcaacgaggctatcatggcagttggcatggtgtccattctggccagctcgttgctgaagaatgacataccgatgactggccctttagtcgcagggggactcctgaccgtatgctatgtgcttacgggtaggtcagctgatctggaattggagcgagccgcagacgttaaatgggaggatcaagccgaaatctctggcagttcccccattctcagcatcacaatttctgaggacgggagcatgtccatcaagaacgaagaggaggaacagaccctgactatactaatccgcacaggactgcttgtgatttcaggcgtcttcccagtgagtatccccattaccgctgcagcctggtacctctgggaggtaaagaaacagcgggcgggtgtgctgtgggatgtccctagcccaccccctgttgggaaggctgaattggaggacggagcctatagaatcaaacagaggggcatattaggctactctcaaattggggcaggagtgtataaggaaggtacttttcacacaatgtggcatgtgacccgtggcgccgtcctgatgcaccgcgggaaacggatcgagccgtcctgggctgatgtgaagaaggacctcatctcatacggaggcggttggaaactggagggggaatggaaggagggagaagaggttcaggtacttgccctggaaccaggcaaaaatcccagagcagtgcagacgaagcctggcttgttcaaaactaacaccgggacaattggagctgtcagtctagattttagcccaggtacctccggctctcccatcgtggacaggaaggggaaggttgtgggactgtacggcaatggtgtcgtgacacgatcgggggcctatgtaagcgcgatagcccagactgagaaatcaattgaggataaccctgaaatcgaggacgatattttccggaagaaacgcctcaccatcatggacctgcatccgggagcaggcaagacgaaaagataccttcccgctatagtcagggaagccattaagcggggcttacgaacactgatcctcgctccaactagagtggttgcagccgagatggaagaggccttgcgcgggctgcctatcaggtatcaaacccccgctattcgtgcggagcacacaggacgggaaatcgtggacctcatgtgtcatgcaaccttcactatgagactgctttccccagtcagggtgcctaactacaatctgattataatggatgaggcccactttaccgaccccgctagtatcgccgcacgcggttatatttctacacgagttgaaatgggcgaggccgctgggatcttcatgacggcgactccaccgggaagcagagatccttttccccagtccaacgccccaatcatggacgaggaacgggagattcccgaaaggtcatggaactctggccacgagtgggtgaccgatttcaagggtaaaacagtctggtttgtgcctagcataaaggcagggaacgacatcgctgcctgcttgcgcaaaaatggaaagaaagtaattcagctaagtcgtaagaccttcgattccgaatacgtgaagactagagcaaacgactgggattttgttgtcacaaccgacatcagcgagatgggcgccaatttcaaagctgagcgggtgattgatccaaggcgctgtatgaagcccgtgatcctgacggacggcgaagaacgagtcatactcgccgggcctatgccggtaactcattcttcagcggcacaaagacggggaaggatcggtcgcaaccccaaaaatgaaaacgaccagtatatttacatgggcgagccattagaaaatgatgaggactgcgcccactggaaggaggctaaaatgctgcttgataacatcaatacacctgaagggattatcccctccatgtttgagccagaaagagagaaggtggacgccatagatggagaatacaggctgcggggcgaggctcgtaaaaccttcgttgacctcatgcgccgaggtgatttgcctgtgtggctggcatatagagtcgccgctgaggggattaactacgccgacaggcggtggtgttttgatggcatcaagaataaccagattctcgaagagaacgtggaagttgagatctggaccaaggagggagaacgcaaaaagctgaaacccagatggcttgacgcaaggatatatagtgatccactagcgctgaaggagttcaaagagttcgccgctggcagaaagagcttgactttaaatctgatcacagagatggggcgactccctacctttatgacacagaaggccagagacgcactggataaccttgctgtgctgcatactgccgaagcaggaggtaaagcctacaatcacgctctctcggagttgccggagacgctggaaaccctactgctccttacactgttagcgactgtcaccggcgggattttcttgtttctgatgtctggaaagggcatcggtaaaatgacactcgggatgtgctgcattatcaccgcctccatactgctttggtatgcacaaattcagccccactggatcgctgccagcatcattctggagttctttctcatcgtgttgctgataccagaacctgagaagcagcgcactccccaggacaaccaattaacgtacgtagtgattgccatcctaaccgttgtcgcagctacaatggccaatgaaatgggcttcctggagaaaactaagaaggacctcggacttggctcaattatcacccaggagagtgaatctaacatactggatatcgacttgaggccagcgtccgcttggacactgtatgccgtggcaaccacttttgtgacacctatgctccggcatagcattgaaaattcaagtgtcaacgttagcctgacggccatcgctaatcaggcaaccgtgcttatggggctcggaaaaggttggcccctgtccaagatggatattggcgtaccgttgctggccatcgggtgttactctcaggtgaacccaattactttaacagcggctctactgctccttgtcgcccactacgcaatcataggacctggcctgcaagccaaagctacccgtgaagcccagaagagagcagctgccggtattatgaaaaatcccaccgtggacgggatcacagttatcgatttggagccaattccctatgaccctaagttcgaaaagcagctgggccaggtgatgctcctgatactttgcgtcactcaagtattaatgatgaggacgacctgggcgctgtgtgaggccctcacattggcaactggaccgatcagcaccctgtgggagggcaaccccgggcgcttttggaatacaaccattgctgtgtccatggccaacatcttccggggatcatacctagcaggcgctggtctgctcttttctattatgaaaaatactacgaacacacgaagagggaccggaaatatcggcgaaactcttggtgagaagtggaaaagtaggctgaacgccttgggcaagtcggagttccagatatataaaaagagcgggatccaggaggttgatcgcaccctggccaaagagggaattaagcggggcgaaacagaccatcacgcggtgtccagagggtctgctaagctccgttggtttgtcgagaggaacatggtgactccagaaggaaaagtcgtggatctgggctgcggtagagggggatggtcatactattgtggcggtttaaagaatgttcgcgaggtgaaaggccttaccaaagggggacctggccatgaagaacccatccctatgagcacatacgggtggaacctggtacgactccaatccggagtggacgtcttcttcacgccacccgagaaatgcgataccctactgtgtgacattggcgaaagttctcctaatccaactatcgaggcaggtagaacattgagggttctgaacctcgtggaaaattggcttaacaataacacccagttttgcataaaggtcctgaatccctatatgccgagcgtgattgagaagatggaaactttgcagcggaaatacgggggagccctggtacgcaaccctctctcaagaaattccacacacgagatgtactgggtgagtaacgctaccggcaatatcgttagctctgtgaacatgatctccaggatgttaattaatcgattcacgatgaagcacaaaaaggccacctatgagccagatgtcgacctgggctcagggacacggaacataggaatcgaaagcgagattcccaaccttgacatcattggtaaacgtatcgaaaagataaagcaggagcatgaaacttcgtggcactacgatcaagaccatccttataaaacctgggcataccacggctcttatgagacaaagcagactgggagtgcctccagcatggtgaatggagtcgtgagactgctaaccaaaccatgggatgttgtacccatggtgacacagatggctatgaccgacactacgccgtttggccagcaacgcgtcttcaaggagaaagtggatacaaggacccaggaacctaaggagggtactaagaaactcatgaagatcaccgcggaatggctgtggaaagagttggggaagaaaaagacaccccggatgtgtacgagagaggaatttacccgcaaagttaggtcaaacgccgcactgggagctattttcactgacgagaataagtggaagtccgcccgagaagcagtggaggattctcggttttgggaactcgtcgacagagagaggaaccttcacctggagggcaaatgcgaaacatgtgtgtacaatatgatgggcaagcgcgagaaaaagttaggggagttcggaaaagccaagggtagccgtgctatctggtatatgtggctgggcgcccggtttttggagttcgaagcgctcgggtttctgaacgaggatcattggttcagtagaggaaattccctaagcggcgtagagggtgaagggcttcacaggctgggatacattctccgcgacgtgtctaagaaagagggcggcgcaatgtacgccgatgacaccgctgggtgggacactcgaatcacactggaagatttgaagaacgaggaaatggttaccaatcatatgaaaggagagcacaagaaactggccgaggcaatttttaagctcacatatcagaacaaggtcgtgcgggtgcagagaccaactcctaggggtaccgtcatggacataatctcacgcagagatcaacggggcagtgggcaggttggaacgtacggccttaataccttcacaaacatggaagctcagctgattaggcaaatggagggtgaagggatcttcaaatccatccagcatttaactgtgaccgaggagattgccgtacagaattggctggctcgtgtgggacgagaacgcttgagcagaatggccatatctggcgacgattgcgtcgtgaagcccctcgacgatcggtttgcatcggcgctgacagccctaaacgacatgggcaaagttaggaaggatatccagcaatgggagccatcacgcgggtggaatgactggactcaggtgcccttctgcagccaccactttcatgaacttgtcatgaaagatggaagagtgctggtagttccttgtcggaaccaggacgagctcattggtagggctcgaatctcccagggcgccgggtggagtctgaaggaaaccgcatgcttgggaaagtcttatgctcaaatgtggacgttaatgtacttccaccgtagagatctgcgcctcgccgcaaacgccatttgtagcgcggtgccatcccattgggtcccgacatcacggaccacttggagtatccacgctaatcacgagtggatgacaaccgaggacatgcttgccgtgtggaacagggtgtggatacaggaaaatccctggatggaggacaaaactcctgtcgaatcttgggaggaagttccatatctgggcaagagagaggatcagtggtgcggtagcctaatcgggctgacctcccgcgcaacatgggccaaaaacattcagacggctatcaatcaagtgcggtcactcattggaaacgaggaatacaccgactatatgcccagcatgaagaggtttcgaagagaggaagaggaagccggcgtattgtggtga

SEQ ID NO: 15021 - RNA, 9876 nt, synthetic construct
  misc_feature 1..9876: note = derived and/or modified CDS sequence (opt3) from DENV-2__GQ398308__SS-prME
  source 1..9876: mol_type = other RNA
accgcaggcgtgatcattatgctgatacccacagctatggcattccacctcactacgagaaacggggaacctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggccgaacttactggctatggtaccgtaacaatggagtgtagtcccaggaccgggctggatttcaacgaaatggtgttgctccagatggaggacaaagcatggctggtccaccggcaatggtttttagatctgcctctcccatggcttcccggcgctgacactcagggaagcaattggatacagaaggagacactggtgacgttcaagaaccctcatgccaaaaagcaggacgttgtggtcttgggctctcaagaaggggcgatgcacaccgccctaactggagcaacagagattcagatgtcctcaggtaatctgctctttaccggccatctgaaatgccgtcttcgcatggataagctgcagttgaaagggatgagctacagtatgtgtacaggaaagttcaagatcgtgaaagaaatcgctgagactcaacacggcaccattgtaatcagagttcagtatgagggtgacgggtctccatgcaagattcccttcgaaataatggatctcgagaaaaggcatgtgctgggccggttaatcacggtcaacccgattgtggccgaaaaggactcccctgtcaacatcgaggctgaacccccatttggagatagctacatcattataggcgtggagcctgggcagctgaaactaaattggttcaagaagggatcgtctatcggtcagatgtttgagaccacaatgcgaggcgccaaacgcatggcaattctcggggacactgcctgggatttcggatccctgggcggtgtttttacctcaatcgggaaggcacttcaccaagtgttcggcgcgatttacggagcagcctttagtggcgtaagctggacaatgaaaatcttgataggggtcatcattacttggatcggaatgaactccagatctaccagcctgtcagtgagtctcgttctggtgggcgtcgtgacgctttatctgggtgctatggtacaggccgactccgggtgtgtggttagctggaagtctaaagaattgaagtgcggatcaggcattttcatcacagataatgtccacacctggactgagcagtacaagtttcagcccgaaagtccaagcaaactcgcatccgccatacaaaaggctcatgaggaaggtatttgtggcatcaggtctgtgacacggctggagaacttaatgtggaaacagattacccccgagctgaatcacatcctatcggaaaacgaggtgaagctcactataatgaccggggacatcaaaggaattatgcaggccggcaagcgcagcctgagacctcagccaacagaacttaaatattcctggaagacgtgggggaaggcaaaaatgttgtcaaccgagagtcataatcaaactttcctgatcgatggaccggaaacagcggagtgccccaacaccaatagggcttggaactctctcgaggtcgaagactacggctttggtgttttcagcacaaatatttggctgaagttacgtgagaaacaggacgtgttttgtgattccaagctgatgtcagccgcaatcaaagacaaccgggccgtgcacgctgatatggggtattggatagaaagcgcccttaatgacacttggaagatggagaaggcatctttcattgaggtaaaatcctgccactggcctaagagtcataccttgtggagcaacggagtcctcgaatctgagatgatcatccccaaaaatttcgctggccccgtgtcccagcacaactaccgacctggttatcatacgcagacagccggcccatggcacctggggaagctagaaatggattttgacttctgtgagggaaccactgttgtggtcaccgaagattgcggcaacagagggccctcactgaggacaactaccgcgagtggaaaactcattacagagtggtgctgtcgcagctgcacgctgccgcctcttcggtacagaggcgaggacggttgttggtacgggatggaaatcaggccattgaaggagaaggaagagaatctggtgaactcgttagttaccgccggacatggccaaattgataatttttccctcggtgtgctgggcatggctcttttcctggaagagatgttgcgcactcgagtagggacaaaacacgcaatgctcctggtcgccgtgtcttttgtgaccctaataactggaaacatgagcttccgggacctgggccgtgtcatggttatggtgggggctacaatgaccgatgacatcggaatgggcattacgtatctcgccctgcttgcagcgtttaaggtaagacccactttcgccgctggtttgctgttaaggaaactcacctcaaaggagctgatgatggccacaatcgggattgcacttctgagtcagtccaccatccctgaaactatactagagctcacagatgctctggccttgggaatgatggtgctgaaaatcgtccgcaatatggaaaagtaccagttagcagtgaccattatggccatctcttgcgttcccaacgctgtgattctccaaaatgcgtggaaggtcagctgtacaatcctggccgcagtgtccgtttcaccacttctgttgactagcagtcagcagaaagctgactggatacctctcgccctgaccattaagggcctaaaccccacggccatctttctgacaaccctttctcggacttccaaaaagagaagctggccactcaatgaggctatcatggcagtgggcatggtctcgattctggcctcatctttgctgaaaaacgacataccgatgaccgggcctttagtagcgggaggtctcctgacagtgtgctatgttcttactggcaggagtgctgatctggaattggagcgagccgcagacgtgaagtgggaggatcaggccgaaatctccgggagctctcccattctcagcatcaccatttccgaggacggatcaatgagtatcaaaaatgaagaggaggaacaaacgctgacaatactaatccgcaccggcctgcttgtcattagcggtgtgttcccagtatctatccccattactgctgcagcctggtacctctgggaggtgaagaagcagcgggcgggggtcctgtgggatgttccttccccaccccctgtgggaaaagctgaattggaggacggcgcctatagaatcaagcagaggggcatattagggtactcacagattggagctggtgtgtataaagaaggcacatttcacaccatgtggcatgtcactcgtggggccgtgctgatgcaccgcggaaagcggatcgagccgagttgggctgatgttaaaaaggacctcatcagctacggcggtgggtggaagctggagggagaatggaaagagggcgaagaggtacaagtgcttgccctggaaccaggcaagaaccccagagcagtccagacaaaacctgggttgttcaagaccaatacgggaactattggtgctgtgtccctagatttttctccaggcacctcggggagccccatcgttgacaggaaaggaaaggtggtcggcctgtacggtaacggggtggtaacacgatcaggagcctatgtctccgcgatagcccagaccgagaagagtattgaggataatcctgaaatcgaggacgatattttccggaaaaagcgcctcacaatcatggacctgcatccgggcgcaggcaaaactaagagataccttcccgctatagtgagggaagccattaaacgggggttacgaaccctgatcctcgctccaacgagagttgtggcagccgagatggaagaggccttgcgcggactgcctatcaggtatcagacacccgctattcgtgcggagcacactggtcgggaaatcgtcgacctcatgtgtcatgcaaccttcacaatgagactgctttctccagtgagggttcctaactacaacctgattataatggatgaggcccactttaccgaccccgctagcatcgccgcacgcggctatatttccactcgagtggaaatgggggaggccgctggaatcttcatgaccgcgacaccaccgggctcaagagatccttttccccaatctaatgccccaatcatggacgaggaacgggagattcccgaaaggagctggaacagtggtcacgagtgggtcacggatttcaaggggaagactgtgtggtttgtaccttccataaaagcaggaaatgacatcgctgcctgcttgcgcaagaacggcaaaaaggtgattcagctaagccgtaaaaccttcgattctgaatacgttaagacaagagcaaatgactgggattttgtcgtgaccactgacatctcagagatgggcgccaacttcaaggctgagcgggtgattgatccaaggcgctgtatgaaacccgtcatcctgacagacggggaagaacgagtaatactcgccggacctatgccggtgacccattccagtgcggcacagagacggggtaggatcggccgcaatccaaagaacgaaaatgaccaatatatttacatgggggagcccttagaaaacgatgaggactgcgcccactggaaagaggctaagatgctgcttgataatatcaacacgcctgaaggaattatccccagcatgtttgagccagaaagagagaaagttgacgccatagatggcgaatacaggctgcggggtgaggctcgtaagactttcgtggacctcatgcgccgaggggatttgcctgtctggctggcatatagagtggccgctgagggcattaattacgccgacaggcggtggtgttttgatggaatcaaaaacaatcagattctcgaagagaacgttgaagtggagatctggacaaaggagggcgaacgcaagaaactgaagcccagatggcttgacgcaaggatatattcggatccactagcgctgaaagagttcaaggagttcgccgctgggcggaaatctttgaccttaaacctgatcaccgagatgggacgactccctacttttatgacacagaaggccagagacgcactggataatcttgctgtcctgcataccgccgaagccggtggccgcgcctacaaccacgctctctccgagttgccggagacactggaaactctactgctccttacgctgttagcgaccgtgacagggggaattttcttgtttctgatgagcggcaagggtatcgggaaaatgactctcggcatgtgctgcattatcaccgcctcaatactgctttggtatgcacagattcaaccccactggatcgctgccagtatcattctggagttctttctcatcgtattgctgataccagaacctgagaagcagaggacaccccaggacaatcagttaacctacgtggttattgccatcctaactgtcgtggcagctacgatggccaacgaaatgggattcctggagaaaaccaagaaagacctcggccttgggtctattgcgacacaagagtccgaaagcaatatcctggatatagacttgcggccagcttcagcctggactctgtatgcagtggccaccacatttgtcacccctatgctccgtcatagtatcgagaacagctccgttaatgtgtctctgactgctattgcaaaccaggccacagtacttatgggactcggtaagggctggcccctgagcaagatggatatcggggtgccgttgctggcgattggatgttactcccaggtcaatccaatcacgttaaccgctgccctactgctccttgtggcacactacgccattatcggccctggtctgcaggctaaagccactagagaagcacaaaagagggctgccgcggggataatgaaaaaccccacagttgacggcattaccgtgatcgatttggagccaatcccctatgaccctaagttcgaaaaacagctgggacaggtcatgctcctgattctttgcgtaacccaggtgttaatgatgcgcacaacttgggccctgtgtgaggcactcacgttggctaccggcccgatatcaacactgtgggaggggaatcccggacggttttggaacactaccatcgccgtttctatggcaaatattttccgaggcagttacctagctggtgccgggctgctcttttcgatcatgaagaacacaaccaatactagaaggggaacgggcaacattggtgaaacacttggcgagaagtggaaaagccgcctgaatgccttggggaagtccgagttccaaatctataaaaagtctggaatacaggaggtggatcggaccctggcgaaagagggcatcaagagaggggaaactgaccatcacgctgtctcacgtggaagcgcaaaactcaggtggtttgtggagcggaacatggtcaccccagaaggcaaggtggttgatctgggttgcgggcgcggaggctggtcctactattgtggtggcttaaagaacgtgcgagaggtaaaagggcttacaaagggaggccctgggcatgaagaaccaattcctatgagtacttacggatggaatctggtgagactccagtctggcgtcgacgttttcttcaccccacccgagaaatgcgatacactactgtgtgacatcggtgaaagctcacctaacccaacgattgaggccgggaggaccttgcgggtgctgaatctcgtcgaaaactggcttaataacgatactcaattttgcatcaaggtgctgaatccctatatgccgtccgtaatagagaaaatggaaacattgcagcgcaagtacggaggcgctattgtgagaaaccctctgagtaggaatagcacccacgagatgtactgggtttctaacgccactggcaatatcgtgtcctcagtcaacatgatcagccgaatgctcattaatcggttcacaatgaagcacaaaaaggcaacctatgagccagacgtggacttagggtcgggaacgcgtaacataggtatcgaatctgagattcccaatctggatatcattggcaaaagaatcgaaaagataaaacaggagcatgaaaccagttggcactacgaccaggatcatccttataagacatgggcctaccacgggtcctatgagactaagcaaaccggaagcgcttcatccatggtcaacggcgtggttcgccttctgacaaaaccatgggacgtagtgcccatggtcactcagatggcgatgaccgatacaaccccgtttggtcagcagagggtgttcaaggagaaagttgacactcggacgcaagaacctaaggaggggaccaaaaagctaatgaagatcacagccgaatggctctggaaagagctgggaaagaaaaagactcccagaatgtgtacccgcgaggaatttacaaggaaagtgcgatctaacgcagctttgggcgccattttcacggatgagaataagtggaaaagcgcacgggaagccgtcgaggacagtagattttgggaactgatcgatagggagcgcaacctccaccttgagggcaagtgcgaaacctgtgtgtacaatatgatggggaagcgtgagaaaaagctgggagagttcggtaaagctaagggctcccgggccatttggtatatgtggttaggggcgagatttctggagttcgaagcattgggatttctcaacgaggaccattggttcagcaggggcaattctctgtcaggtgtagagggggaaggactacaccgccttggctacatcctgcgagatgtgagtaaaaaggagggcggggccatgtacgctgacgacactgccggatgggatacacggattaccctcgaagacctgaagaacgaggaaatggttactaatcatatgaaaggtgagcacaagaaattggcagaggctatatttaagctgacatatcagaacaaagtcgtgagagtgcagaggccaacccctcgcggcacagtcatggatatcatttccagacgggaccagagggggagcggacaagttggcacttacggtctcaataccttcacgaacatggaagcccagcttatccgtcagatggagggggaaggaatcttcaagtctattcaacatctgaccgtgacagaggagatagctgtacagaattggttagcccgagtgggccgcgaaagactgtcgcggatggcaatctcaggcgatgactgcgtcgtgaagcccttggatgacaggtttgcgagcgccctcactgctctgaacgatatggggaaagttcgcaaggacattcagcagtgggagccatccagaggatggaatgattggacccaagtgcccttctgcagtcaccactttcatgagctagtcatgaaagacggtcgggtgcttgtagttccttgtaggaaccaggatgagctgatcggccgagcccgtatttctcagggggcaggatggagcctcaaggaaacagcttgcctgggcaaatcctatgcccagatgtggactttgatgtacttccacagacgcgacttacggctggcagccaatgcgatctgttcagctgtgccaagtcattgggtcccgacctctaggacgacatggagcatacacgccaagcacgagtggatgaccactgaggacatgctcacagtgtggaacagagtgtggatccaagaaaacccctggatggaggataagacccctgtcgaatcctgggaggaagttccatatcttggtaaacgcgaggaccagtggtgcgggtcactgattggactaactagccgggcaacctgggccaagaatatccagacagctattaaccaggtgaggtctctgatcggcaatgaggaatacacggattatatgccctccatgaaacgatttagacgggaggaagaggaagccggcgtactctggtga

SEQ ID NO: 15022 - RNA, 9876 nt, synthetic construct
  misc_feature 1..9876: note = derived and/or modified CDS sequence (opt3) from DENV-2__GQ398287__SS-prME
  source 1..9876: mol_type = other RNA
accgcaggagtgataattatgctgatacccacagctatggctttccacctcactacgagaaacggggagcctcatatgatcgtcgggagacaggaaaagggtaaaagccttctgtttaagaccgaggacggagttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcgccatcatggcagccattttggcttacacaatcggcaccacgcactttcagcgcgcactcattttcatcctgctgactgccgttgctccatccatgacaatgagatgcatagggatttctaacagggattttgtggaaggagtctcgggtggctcatgggtggacatcgttctcgagcacgggagctgtgttaccactatggccaagaataagcccacattagatttcgaactgattaaaaccgaggcgaagcagcctgcaacgcttcggaaatattgcatcgaagccaagttgaccaacacaactaccgagagtcgctgtccaacacaaggagagccctccctgaatgaggaacaggacaaacgatttgtgtgcaagcattctatggtcgatagaggctggggtaacgggtgtggactattcggcaagggcgggatcgtgacttgcgctatgtttacctgcaaaaagaatatggaaggaaaagtggtcctccctgagaacctggaatacacaattgttataaccccacacagcggtgaggagcatgccgtgggcaatgacactgggaagcacggaaaagaaatcaagattacgccgcagtcctcaatcacagaggcagaacttaccggctatggtactgtaaccatggagtgtagtcccaggacagggctggatttcaacgaaatggtgttgctccagatggaggacaaggcttggctggtccaccggcaatggtttttagatctgcctctcccatggcttcccggcgccgacacccagggaagcaattggatacagaaggagactctggtgacattcaagaaccctcatgcgaaaaagcaggacgttgtggtcttgggctctcaagaaggggccatgcacacggcactaaccggagctactgagattcagatgtcctcaggtaatctgctctttacaggccatctgaaatgccgtcttcgcatggataagctgcagttgaaagggatgagctacagtatgtgtaccggaaagttcaagatcgtgaaagaaatcgccgagacacaacacggcactattgtaatcagagttcagtatgagggtgacgggtctccatgcaagattcccttcgaaataatggatctcgagaaaaggcatgtgctgggccggttaatcaccgtcaacccgattgtgacggaaaaggactcccctgtcaacatcgaggctgaacccccatttggagatagctacatcattataggcgtggagcctgggcagctgaaactaaattggttcaagaagggatcgtctatcggtcagatgtttgagaccacaatgcgaggcgccaaacgcatggcaattctcggggacactgcctgggatttcggatccctgggcggtgtttttacctcaatcgggaaggcacttcaccaagtgttcggcgcgatttacggagcagcctttagtggcgtaagctggacaatgaaaatcttgataggggtcatcattacttggatcggaatgaactccagatctaccagcctgtcagtgagtctcgttctggtgggcgtcgtgacgctttatctgggtgctatggtacaggccgactccgggtgtgtggttagctggaagtctaaagaattgaagtgcggatcaggcattttcatcacagataatgtccacacctggactgagcagtacaagtttcagcccgaaagtccaagcaaactcgcatccgccatacaaaaggctcatgaggaaggtatttgtggcatcaggtctgtgacacggctggagaacttaatgtggaaacagattacccccgagctgaatcacatcctatcggaaaacgaggtgaagctcactataatgaccggggacatcaaaggaattatgcaggccggcaagcgcagcctgagacctcagccaacagaacttaaatattcctggaagacgtgggggaaggcaaaaatgttgtcaaccgagagtcataatcaaactttcctgatcgatggaccggaaacagcggagtgccccaacaccaatagggcttggaactctctcgaggtcgaagactacggctttggtgttttcacaactaatatttggctgaagttacgtgagaaacaggacgtgttttgtgatagcaagctgatgtccgccgcaatcaaagacaaccgggccgtgcacgctgatatggggtattggatagaatcagcccttaatgacacctggaagatggagaaggccagcttcattgaggtaaaatcttgccactggcctaagtcccatacgttgtggagtaacggagtcctcgaaagcgagatgatcatccccaaaaatctggctggccccgtgtctcagcacaactaccgacctggttatcatacacagaccgccggcccatggcacctagggaagctggaaatggatttcgacttttgtgagggaactaccgttgtggtcacagaagattgcggcaacagagggccctccctcaggactaccacagcgtcaggaaaactgattacggagtggtgctgtcgcagttgcacccttccgcctttgcggtacagaggcgaggacggttgttggtacgggatggaaatcaggccactgaaggagaaggaagagaatttagtgaacagcctcgttactgccggacatggccaaattgataatttctcgctgggtgtgcttggcatggctctgtttttggaagagatgctccgcacacgagtagggaccaaacacgcaatactgctaatcgccgtctccttcgtgactctgattacaggaaacatgtcttttcgggacctcggccgtgtgatggtcatggttggggctaccatgacggatgacatcggaatgggcgtgacttatctggcccttttggcagcgttcaaggtaagacccacctttgccgctggtctgttactcaggaaactgacaagcaaggagcttatgatggccaccattgggatcgcactgctatcacagagtactatacctgaaacaatcctcgagctgaccgatgctttggccctgggaatgatggtgttaaaaattgtccgcaatatggaaaagtaccagctcgcagtgacaatcatggccatttcctgcgttcccaacgctgtgatcctgcaaaatgcgtggaaggtctcttgtactatacttgccgcagtgagcgtttccccactgttgctcacctcaagccagcagaaagctgactggattcctctggccctaacgatcaagggcctgaaccccacagccatcttccttaccactctcagtcggacctctaaaaagagatcctggccactgaatgaggctattatggcagtgggcatggtcagcatattggcctcgtcactgctcaaaaacgacatcccgatgacagggcctctagtagcgggaggtctgcttactgtgtgctatgttctgaccggcaggtctgctgatttggaactcgagcgagccgcagacgtgaagtgggaggatcaggccgaaattagtgggtccagccccatcctgtctattacgatcagcgaggacggatccatgtcaatcaaaaatgaagaggaggaacaaacactaaccatcctgattcgcactggccttctcgtcatcagtggtgtgtttccagtaagcattcccatcacagctgcagcctggtacctgtgggaggtgaagaagcagcgggcgggggtcttgtgggatgttccttctccaccccctgtggaaaaagctgagttagaagacggagcctatagaataaagcagaggggcattctgggctactcccagatcggggcaggagtgtataaagagggtaccttccacactatgtggcatgtcacacgtggcgccgtgctcatgcaccgcgggaagcggatcgagccgtcatgggctgatgttaaaaaggacctgattagttacggaggcggttggaaacttgaaggggagtggaaagaaggagaggaagtacaagtgctggccttggagccaggcaagaaccccagagcagtccagaccaaacctggcctatttaagacgaatactgggaccatcggagctgtgagcctggatttctccccaggtacatctggctcgcccatagttgacaggaaagggaaggtggtcggactctacggcaacggtgtggtaacccgaagcggggcctatgtctcagcgattgcccagacagagaagtccatcgaagataatcctgagattgaagacgatatctttcggaaaaagcgcctgactataatggaccttcatccgggagcaggcaaaaccaagagatacttacccgctattgtgagggaggccatcaaacggggcctgcgaacgctcatcttggctccaacaagagttgtggcagccgaaatggaggaggccctgcgcgggctccctattaggtatcagactcccgctatccgtgcggaacacaccggacgggagattgtcgacctgatgtgtcatgcaacattcaccatgagacttctgagtccagtgagggttcctaactacaacttgataatcatggatgaagcccacttcactgaccccgcttctattgccgcacgcggttatatcagcacccgagtggagatgggcgaggccgctgggatctttatgacagcgacgccaccgggatccagagatcctttcccccaatcaaatgccccaattatggacgaggaacgggaaatacccgagaggtcttggaacagcggccacgaatgggtcactgattttaagggtaagaccgtgtggttcgtacctagtatcaaagcagggaatgacattgctgcctgcctacgcaagaacggcaaaaaggtgatccagctgtcccgtaaaacatttgatagcgagtacgttaagaccagagcaaatgactgggatttcgtcgtgactacagacatttctgagatgggcgccaactttaaggctgaacgggtgatcgatccaaggcgctgtatgaaacccgtcatactcaccgacggcgaggaacgagtaatcttagccgggcctatgccggtgacgcattcatccgcggcacagagacggggaaggattggtcgcaatccaaagaacgagaatgaccaatatatctacatgggcgaacccctggagaacgatgaggactgcgcccactggaaagaagctaagatgcttctggataatattaacactcctgaggggatcatacccagtctcttcgaaccagagagagaaaaagttgacgccattgatggagagtacaggttgcggggcgaggctcgtaagacatttgtggacctgatgcgccgaggtgatctccctgtctggctggcatatagagtggccgctgaagggatcaattacgccgacaggcggtggtgtttcgatggcattaaaaacaatcagatccttgaggaaaacgttgaggtggagatatggaccaaggaaggagagcgcaagaaactaaagcccagatggctggacgcaaggatctatagcgatccattggcgttaaaagaatttaaggagttcgccgctggccggaaatcgctgaccctcaacctgattactgaaatggggcgacttcctacattcatgacccagaaggccagagacgcactggataatctcgctgtcttgcatacagccgaggcaggaggtcgcgcctacaaccacgctctgtctgagctaccggaaactctggagacgctccttctgttaaccttgctggcgacagtgactggcgggatctttctcttcctgatgtccggaaggggcattggtaagatgacccttgggatgtgctgcatcataacagccagcattctgctctggtatgcacagatccaaccccactggatcgctgcctcaattatcttggaatttttcctgatagtattactaattccagagcctgaaaaacagcggacaccacaggacaatcagctgacttacgtggttatcgccattctcacggtcgtggcagctaccatggccaacgagatgggctttcttgagaagaccaaaaaggacctgggattgggcagtatcactacccaagaatctgagtccaatatactggatatcgacctccgtccagcgagcgcttggacactgtatgccgtggcaaccactttcgtcacacctatgcttagacattcaattgaaaacagtagcgttaatgtgtccctcacggccatcgctaaccaggcaaccgtactgatggggttgggaaaaggttggcccctgtctaagatggatattggcgtgccgttactagccatcgggtgttacagccaggtcaatccaattactctgacagcggctctccttctgttggtggcccactacgcaatcataggacctggcctgcaggccaaggctaccagggaggcccaaaaacgcgcagctgccggtattatgaagaaccccaccgttgacgggatcacagtgatcgatctcgaaccaattccctatgaccctaaatttgagaagcagctgggccaggtcatgcttttaatactgtgcgtaactcaggtgctcatgatgcggacgacctgggcgttgtgtgaggccctgacactagcaactggaccgatctccaccctgtgggaaggcaatcccgggcgattctggaacacaaccattgctgtttcaatggccaatatctttagaggatcttacctcgcaggcgctggtcttctgttcagtattatgaaaaacactacgaatacaaggcgcgggaccggaaacatcggcgagactttgggtgaaaagtggaagtcgcggctgaatgccctcggcaaaagcgagtttcaaatatataagaaatccgggatccaggaggtggatagaaccctggccaaggaaggaattaaacgtggcgagacagaccatcacgcggtctctagggggtcagctaagttacggtggttcgtggaacgcaacatggtcactccagagggaaaagtggttgatcttggctgcggtcgagggggatggagctactattgtggcggtctgaagaacgtgagagaagtaaagggcctcaccaaagggggacctggccatgaggagcccatccctatgtccacatacgggtggaatctagtgaggctgcagagtggagtcgacgtatttttcacgccacccgaaaagtgcgataccgtgttgtgtgacattggcgagtctagccctaacccaactatcgaagcaggtcggacactgcgcgtcctcaatcttgtggagaactggctgaataacaatacccaattctgcataaaagtattgaacccctatatgccgtcagtgattgaaaagatggagactctgcagagaaaatacgggggagccctcgttaggaatcctttatcccgaaacagtacacacgagatgtactgggtgagcaatgctaccggcaacatcgtctcttccgtgaatatgatctcacggatgctgattaaccgttttacgatgaagcacaagaaagccacctatgaaccagatgtcgaccttggcagcgggacaagaaatataggaatcgagtcggaaattcccaacctggacatcattggtaagcgcatcgagaaaataaagcaggaacatgagacttcttggcactacgatcaggaccatccttataaaacctgggcataccacggcagttatgagacaaagcaaactgggtccgccagctcaatggtgaacggagttgtaaggctactcaccaagccatgggatgtggtccccatggtgacacagatggctatgaccgacactacgccgttcggccagcagcgggtttttaaagaaaaggtggatacaagaacccaagagcctaaagaaggtactaagaaactgatgaagatcaccgcggagtggttgtggaaggagctggggaaaaagaaaacaccccgcatgtgtacgagggaagagttcacccgaaaggtccggtccaatgccgcactcggagctatttttactgacgaaaacaaatggaagtctgccagagaggcagtggaagatagcaggttctgggagcttatcgaccgcgagcgtaatctgcacttagaaggcaaatgcgagacatgtgtatacaacatgatgggcaagcgggaaaagaaactgggggagtttggaaaggccaaaggtagtagagctatttggtatatgtggttgggcgccaggttcctcgaatttgaggcgctggggttcctaaatgaggatcattggttttcccgccgaaacagcctttctggagtggaaggcgagggtctgcaccggctcgggtacatcctgagagacgtttcaaagaaagaaggaggcgcaatgtacgccgatgacaccgctggctgggacactaggattacattggaggatctgaagaatgaagagatggtcaccaaccatatgaagggggagcacaaaaagctcgccgaagcaatattcaaacttacatatcagaataaggtggtgcgcgtccagagaccaactcctcggggaaccgttatggacatcattagtaggcgtgatcagcgaggttccggccaagtggggacgtacggactgaacacctttacaaatatggaggctcagttaatccgccagatggaaggcgagggtatcttcaaaagcattcaacatctgactgtaaccgaggaaatagccgtgcagaactggttggctagagtcgggcgggagaggctctctcgcatggccatctcgggagacgattgcgtggttaagcccctggacgatagattcgcatcagcgctaacagcccttaatgacatgggcaaggtgcggaaagatattcagcagtgggaaccaagcaggggctggaacgactggactcaagtccccttttgctcccaccacttccatgagctggtgatgaaggatgggcgagtactcgttgtgccttgtcgtaatcaggacgaactgatcggcagagctcgcattagtcagggtgccggctggtctttgaaagagaccgcatgcttaggaaagagctatgctcagatgtggacgctgatgtactttcaccggagggatctcagacttgccgcaaacgccatctgttccgcggtcccatcacattgggtgccgacaagtcgcaccacttggtctatacacgctaaacacgagtggatgacaaccgaagacatgctggccgtgtggaaccgggtctggatccaagagaatccctggatggaagacaagactcctgttgagagctgggaagaggtgccatatctaggaaagagggaggatcagtggtgcggctccctgattggtctcacctcacgagcaacatgggccaaaaacatccagacggctattaatcaggtaaggagcttgatcgggaacgaagagtacaccgactatatgccctctatgaagcggttcaggcgcgaagaggaagaggccggagtgctgtggtga

SEQ ID NO: 15023 - RNA, 9876 nt, synthetic construct
  misc_feature 1..9876: note = derived and/or modified CDS sequence (opt3) from DENV-2__GQ398302__SS-prME
  source 1..9876: mol_type = other RNA
accgccggcgtgatcattatgctgatacccacagctatggcattccacctcactacgagaaacggggagcctcatatgatcgtcagcaggcaggaaaagggaaaatcccttctgtttaagaccgaggacggtgttaatatgtgcacattgatggccattgatttaggcgaactgtgtgaggacactatcacctacaaatgcccactactccggcaaaacgaaccggaggatattgactgttggtgcaattctacatcaacctgggtgacttatgggacatgtaccacgactggagagcaccgccgagaaaagcgtagtgtagcgctggtgccccatgtcggcatgggtcttgagaccagaacagaaacttggatgagctccgagggggcttggaaacacgtgcagaggatcgagacctggatactgcggcatcctggattcacaatcatggccgcaattttggcctacaccatcggcacgactcactttcagcgcgctctcattttcatcctgctgacagcagttgccccatctatgaccatgagatgcataggcatttcgaacagggattttgtggaaggggtctcaggaggtagctgggtggacatcgtactcgagcacggcagttgtgttactacaatggctaagaataagcccaccttagatttcgaactgattaaaacggaggccaagcagcctgcgacccttcggaaatattgcatcgaagcaaagttgacaaacactaccacagagtcccgctgtccaactcaaggggagccctctctgaatgaagagcaggacaaacgatttgtgtgcaagcatagcatggtcgatagaggatggggcaacggttgtgggctattcggaaagggcggcatcgtgacctgcgccatgtttacatgcaaaaagaatatggaagggaaagtggtcctccctgagaacctggaatacaccattgttataactccacactccggagaggagcatgctgtgggtaatgacacgggcaagcacgggaaagaaatcaagattacaccgcagtcaagtatcaccgaggccgaacttactggatatggcaccgtaacaatggagtgtagccccaggaccggtctggatttcaacgaaatggtgttgctccagatggaggacaaagcatggctggtccaccggcaatggtttttagatctgcctctcccatggcttcccggggctgacactcagggctctaattggatacagaaggagacactggtgacgttcaagaaccctcatgccaaaaagcaggacgttgtggtcttgggatcccaagaaggcgcgatgcacaccgccctaactggggcaacagagattcagatgtcaagcggaaatctgctctttaccggtcatctgaaatgccgtcttcgcatggataagctgcagttgaaaggcatgagttactctatgtgtacagggaagttcaagatcgtgaaagaaatcgctgagactcaacacggaaccattgtaatcagagttcagtatgagggcgacggttccccatgcaagattcccttcgaaataatggatctcgagaaaaggcatgtgctggggcggttaatcacggtcaacccgattgtggccgaaaaggacagccctgtcaacatcgaggctgaacccccatttggcgattcgtacatcattataggagtggagcctggccagctgaaactaaattggttcaagaaggggtcttccatcggacagatgtttgagaccacaatgcgaggtgccaaacgcatggcaattctcggcgacactgcctgggatttcgggtcactgggaggcgtttttaccagtatcggtaaggctcttcaccaagtgttcggggcgatttacggcgcagcctttagcggagtatcctggacaatgaaaatcttgataggcgtcatcattacttggatcgggatgaactctagaagcacctcactgagtgtgtccctcgttctggtgggagtcgtgacgctttatctgggcgctatggtacaggccgacagcggttgtgtggtttcttggaagtcaaaagaattgaagtgcgggagtggaattttcatcacagataatgtccacacctggactgagcagtacaagtttcagcccgaaagcccatccaaactcgcatctgccatacaaaaggctcatgaggaaggcatttgtggtatcaggtcggtgacacggctggagaacttaatgtggaaacagattacccccgagctgaatcacatcctaagcgaaaacgaggtgaagctcactataatgaccggcgacatcaaagggattatgcaggccggaaagcgctccctgagacctcagccaacagaacttaaatattcatggaagacgtggggcaaggcaaaaatgttgagtaccgagtctcataatcaaactttcctgatcgatgggccggaaacagcggagtgccccaacaccaatagggcttggaacagcctcgaggtcgaagactacggatttggcgttttcacaactaatatttggctgaagttacgtgagaaacaggacgtgttttgtgattccaagctgatgtcagccgcaatcaaagacaaccgggccgtgcacgctgatatgggttattggatagaaagcgcccttaatgacacctggaagatggagaaggcatctttcattgaggtaaaatcctgccactggcctaagagtcatacgttgtggagcaacggggtcctcgaatctgagatgatcatcccaaaaaatttcgctggacccgtgtcccagcacaactaccgacctggctatcatacacagaccgccggtccatggcacctgggcaagctagaaatggattttgacttctgtgaggggactaccgttgtggtcacagaagattgcggaaacagaggcccctcactgaggactaccacagcgagtgggaaactcattacggagtggtgctgtcgcagctgcaccctgccgcctcttcggtacagaggagaggacggctgttggtacggtatggaaatcaggccattgaaggagaaggaagagaatctggtgaactcgttagttactgccgggcatggacaaattgataatttttccctcggcgtgctgggtatggctcttttcctggaagagatgttgcgcacacgagtaggcaccaaacacgcaatgctcctggtcgccgtgtcttttgtgactctaataacagggaacatgagcttccgggacctgggacgtgtcatggttatggtgggcgctaccatgacggatgacatcgggatgggaattacttatctcgccctgcttgcagcgtttaaggtaagacccaccttcgccgctggcttgctgttaaggaaactcacatcaaaggagctgatgatggccaccatcggtattgcacttctgagtcagtccactatccctgaaacaatactagagctcaccgatgctctggccttggggatgatggtgctgaaaatcgtccgcaatatggaaaagtaccagttagcagtgacaattatggccatctcttgcgttcccaacgctgtgattctccaaaatgcgtggaaggtcagctgtactatcctggccgcagtgtccgtttcaccacttctgttgaccagcagtcagcagaaagctgactggatacctctcgccctgacgattaagggactaaaccccacagccatctttctgaccactctttctcggacctccaaaaagagaagctggccactcaatgaggctatcatggcagtgggcatggtctcgattctggcctcatctttgctgaaaaacgacataccgatgacaggccctttagtagcggggggactcctgactgtgtgctatgttcttaccggtaggagtgctgatctggaattggagcgagccgcagacgtgaagtgggaggatcaggccgaaatctccggcagctctcccattctcagcatcacgatttccgaggacgggtcaatgagtatcaaaaatgaagaggaggaacaaacactgaccatactaatccgcactggactgcttgtcattagcggcgtgttcccagtatctatccccattacagctgcagcctggtacctctgggaggtgaagaagcagcgggcgggtgtcctgtgggatgttccttccccaccccctgtggggaaagctgaattggaggacggagcctatagaatcaagcagaggggcatattaggctactcacagattggggcaggagtgtataaagaaggtacctttcacactatgtggcatgtcacacgtggcgccgtgctgatgcaccgcgggaagcggatcgagccgagttgggctgatgttaaaaaggacctcatcagctacggaggcggttggaagctggagggggaatggaaagagggagaagaggtacaagtgcttgccctggaaccaggcaagaaccccagagcagtccagaccaaacctggcttgttcaagacgaatactgggaccattggagctgtgtccctagatttttctccaggtacatcgggcagccccatcgttgacaggaaagggaaggtggtcggactgtacggcaacggtgtggtaacccgatcaggggcctatgtctccgcgatagcccagacagagaagagtattgaggataatcctgaaatcgaggacgatattttccggaaaaagcgcctcactatcatggacctgcatccgggagcaggcaaaaccaagagataccttcccgctatagtgagggaagccattaaacggggcttacgaacgctgatcctcgctccaacaagagttgtggcagccgagatggaagaggccttgcgcgggctgcctatcaggtatcagactcccgctattcgtgcggagcacaccggacgggaaatcgtcgacctcatgtgtcatgcaacattcaccatgagactgctttctccagtgagggttcctaactacaacctgattataatggatgaggcccactttactgaccccgctagcatcgccgcacgcggttatatttccacccgagtggaaatgggcgaggccgctgggatcttcatgacagcgacgccaccgggatcaagagatccttttccccaatctaatgccccaatcatggacgaggaacgggagattcccgaaaggagctggaacagtggccacgagtgggtcactgatttcaagggtaagaccgtgtggtttgtaccttccataaaagcagggaatgacatcgctgcctgcttgcgcaagaacggaaaaaaggtgattcagctaagccgtaaaacattcgattctgaatacgttaagaccagagcaaatgactgggattttgtcgtgactacagacatctcagagatgggcgccaacttcaaggctgagcgggtgattgatccaaggcgctgtatgaaacccgtcatcctgaccgacggcgaagagcgagtaatactcgccgggcctatgccggtgacgcattccagtgcggcacagagacggggaaggatcggtcgcaatccaaagaacgaaaatgaccaatatatttacatgggcgagcccttagaaaacgatgaggactgcgcccactggaaagaggctaagatgctgcttgataatatcaacactcctgaagggattatccccagcatgtttgagccagaaagagagaaagttgacgccatagatggagaatacaggctgcggggcgaggctcgtaagacattcgtggacctcatgcgccgaggtgatttgcctgtctggctggcatatagagtggccgctgaggggattaattacgccgacaggcggtggtgttttgatggcatcaaaaacaatcagattctcgaagagaacgttgaagtggagatctggaccaaggagggagaacgcaagaaactgaagcccagatggcttgacgcaaggatatattcggatccactagcgctgaaagagttcaaggaattcgccgctggccggaaatctttgaccttaaacctgatcactgagatggggcgactccctacatttatgacccagaaggccagagacgcactggataatcttgctgtcctgcatacagccgaagcaggaggtcgcgcctacaaccacgctctctccgagttgccggagactctggaaacgctactgctccttaccctgttagcgacagtgactggcgggattttcttgtttctgatgagcggaaagggcatcggtaaaatgaccctcgggatgtgctgcattatcacagcctcaatactgctttggtatgcacagattcaaccccactggatcgctgccagtatcattctggagttctttctcatcgtattgctgataccagaacctgagaagcagaggaccccccaggacaatcagttaacttacgtggttattgccatcctaacggtcgtggcagctaccatggccaacgaaatgggcttcctggagaaaacaaagaaagacctcggacttggctctattgcgactcaagagtccgaaagcaatatcctggatatagacttgcggccagcttcagcctggaccctgtatgcagtggccacaacctttgtcactcctatgctccgtcatagtatcgagaacagctccgttaatgtgtctctgacagctattgcaaaccaggccacggtacttatggggctcggaaagggttggcccctgagcaagatggatatcggcgtgccgttgctggcgattgggtgttactcccaggtcaatccaatcaccttaactgctgccctactgctccttgtggcacactacgccattatcggacctggcctgcaggctaaagccacaagagaagcacaaaagagggctgccgcgggtataatgaaaaaccccaccgttgacgggattaccgtgatcgatttggagccaatcccctatgaccctaagttcgaaaaacagctgggccaggtcatgctcctgattctttgcgtaacacaggtgttaatgatgcgcactacgtgggccctgtgtgaggcactcaccttggctacaggaccgatatcaactctgtgggagggcaatcccgggcggttttggaacaccacaatcgccgtttctatggcaaatattttccgaggaagttacctagctggcgccggtctgctcttttcgatcatgaagaacaccactaatacgagaagggggacaggaaacattggcgaaacccttggtgagaagtggaaaagccgcctgaatgccttgggcaagtccgaattccaaatctataaaaagtctgggatacaggaggtggatcggactctggcgaaagagggaatcaagagaggcgaaaccgaccatcacgctgtctcacgtgggagcgcaaaactcaggtggtttgtggagcggaacatggtcacaccagaaggaaaggtggttgatctgggctgcggtcgcgggggatggtcctactattgtggcggtttaaagaacgtgcgagaggtaaaaggccttactaaggggggacctggccatgaagagcccattcctatgagtacctacgggtggaatctggtgagactccagtctggagtcgacgttttcttcacaccacccgagaaatgcgatacgctactgtgtgacatcggcgaaagctcacctaacccaaccattgaggccggtaggactttgcgggtgctgaatctcgtcgaaaactggcttaataacaatacacaattttgcatcaaggtgctgaacccctatatgccgtccgtaatagagaaaatggaaaccttgcagcgcaagtacgggggagctctggtgagaaatcctctcagtaggaacagcactcacgagatgtactgggtttctaatgccacaggcaacattgtgtcctcagtcaatatgatcagccgaatgttaatcaaccggttcaccatgaagcacaaaaaggcaacgtatgagccagatgtggacctgggctcggggacccgtaatattggaatagaatctgagatccccaaccttgacattatcggtaaaagaattgaaaagatcaaacaggagcatgaaacaagttggcactacgatcaggaccatccttataagacttgggcctaccacggctcctatgagaccaagcaaacagggagcgcttcatccatggtcaacggagtggttcgcctgctaactaaaccatgggatgtagtgcccatggtcacccagatggcgatgacagacaccactccgtttggccagcagagggtgttcaaggagaaagttgatacgcggacacaagaacctaaggagggtaccaaaaagctcatgaagataactgccgaatggctgtggaaagagttggggaagaaaaagacccccagaatgtgtacacgcgaggaatttacgaggaaagtgcgatctaatgcagctctgggagccatcttcaccgacgagaacaagtggaaaagcgcacgggaagccgtcgaggatagtagattttgggaactcattgacagggagcgcaatcttcacctggagggcaagtgcgaaacttgtgtgtacaacatgatgggcaagcgtgagaaaaagttaggggaattcggaaaagctaagggttcccgggccatctggtatatgtggctgggcgcgagatttttggagttcgaagcactcgggtttctgaatgaggatcattggttcagcaggggaaactctctatcaggcgtagagggtgaagggcttcaccgcctgggatacattctccgagacgtgagtaaaaaggagggcggcgccatgtacgctgatgacacagccgggtgggacacccggatcactctggaagatttgaagaatgaggaaatggttacaaaccatatgaaaggagagcacaagaaactggcagaggctatttttaagctcacctatcagaataaagtcgtgagagtgcagaggccaacacctcgcggtactgtcatggacataatctccagacgggatcagaggggcagcgggcaagttggaacctacggccttaacacgttcaccaatatggaagcccagctgattcgtcagatggagggtgaagggatcttcaagtctatccaacatttaacagtgactgaggagattgctgtacagaactggctggcccgagtgggacgcgaaagattgtcgcggatggcaatatcaggcgacgattgcgtcgtgaagcccctcgacgataggtttgcgagcgccctgaccgctctaaatgacatgggcaaagttcgcaaggatatccagcagtgggagccatccagagggtggaacgactggacacaagtgcccttctgcagtcaccactttcatgaacttgtcatgaaagatggacgggtgctggtagttccttgtaggaatcaggacgagctcattggtcgagcccgtatctctcagggcgcagggtggagcctgaaggaaactgcttgcttgggaaaatcctatgcccagatgtggaccttaatgtacttccacagacgcgatctgcggctcgcagccaacgcgatttgttcagctgtgccaagtcattgggtcccgacgtctaggacaacctggagcatccacgccaagcacgagtggatgactacagaggacatgcttgcagtgtggaacagagtgtggatacaagaaaatccctggatggaggacaagacccctgtcgaatcctgggaggaagttccatatctgggcaaacgcgaggatcagtggtgcggttcactaatcgggctgactagccgggccacctgggctaagaacattcagacagccatcaatcaggtgaggtctctcattggaaacgaggaatacacggactatatgccctccatgaaacgatttagacgggaggaagaggaagcaggcgtattgtggtga

SEQ ID NO: 15024 - RNA, 9876 nt, synthetic construct
  misc_feature 1..9876: note = derived and/or modified CDS sequence (opt3) from DENV-2__GQ398272__SS-prME
  source 1..9876: mol_type = other RNA
accgccggcgtgatcattatgctgatacccacagctatggcattccacctcactacgaggaacggggagcctcatatgatcgtcgggaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggattctgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttatctgcaagcattctatggtggatagaggctggggtaacgggtgtggactattcggcaagggcgggattgtcacatgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgactccgggtgtgtggttagctggaagaataaagaattgaagtgcggatctggcatcttcataaccgataacgtccacacttggacagagcagtacaagtttcagcccgaatcaccaagtaaactcgctagcgccattcaaaaggcacatgaggaaggtatctgtggcattaggtccgtgacccggctggagaatttaatgtggaaacagatcactcccgagctgaaccacatactatctgaaaatgaggtgaagctcaccatcatgacaggggacattaaaggaatcatgcaggccggcaagcgctcgctgagacctcagccaacggaacttaaatatagctggaagacctgggggaaggctaaaatgttgtccactgagtcacataaccaaacattcctgattgatggaccggaaaccgccgagtgccccaatacaaacagggcatggaatagtctcgaggtcgaagactacggctttggtgttttctctactaacatctggctgaagttacgtgagaaacaggacgtgttttgtgatagcaagctgatgtccgcggctataaaagacaatcgggccgtgcacgcagatatggggtattggattgaatcagcccttaacgacacctggaagatggagaaggctagcttcatcgaggtaaaatcttgccactggcctaagtcccatacgttgtggagtaatggagtcctcgaaagcgagatgatcattcccaagaacttcgccggccccgtgtctcagcacaactaccgacctggttatcatacacagaccgcaggcccatggcacctggggaagctagaaatggattttgacttctgtgagggaactaccgttgtggtcacagaagattgcggcaatagagggccctccctgaggactaccacagcttcaggaaaactcatcacggagtggtgctgtcgcagttgcaccctgccgcctcttcggtacagaggcgaggacggttgttggtacgggatggaaattaggccattgaaggagaaggaagagaacctggtgaatagcttagttactgccggacatggccaaatagataacttttcgctcggtgtgctgggcatggcgcttttcctggaagagatgttgcgcacacgagtagggaccaaacacgccatcctcctggtcgctgtgtcctttgtgactctaattacaggaaatatgtctttccgggacctgggccgtgtcatggttatggtgggggcaaccatgacggatgacatcggaatgggcgtaacttatctcgccctgcttgctgcctttaaggtgagacccaccttcgcagcgggtttgctgttaaggaaactcacaagcaaggagctgatgatggccaccattgggatcgcacttctgtcacagagtactatacctgaaacaatcctagagctcaccgatgccctggcattgggaatgatggtcctgaaaattgtgcgcaacatggaaaagtaccagttagctgttacaatcatggccatttcctgcgtgcccaatgcagtcatcctccaaaacgcctggaaggtgtcttgtactatactggctgcggttagcgtgtccccacttctgttgacctcaagccagcagaaagccgactggattcctctcgcactgacgatcaagggcctaaatcccacagctatctttctgaccactcttagtcggacctctaaaaagagatcctggccactcaacgaggccgtcatggccgtaggcatggtgagcattctggcttcgtcattgctgaaaaatgacataccgatgacagggcctttagttgcaggaggtctcctgactgtgtgctatgtccttaccggcaggtctgccgatctggaattggagcgagcggctgacgtgaagtgggaggatcaggccgaaatcagtgggtccagccccattctctctatcacgattagcgaggacggatccatgtcaatcaaaaacgaagaggaggaacaaacactgaccatactaatccgcactggcctgcttgtaattagtggtgtgttcccagtcagcatccccattacagcagccgcttggtacctctgggaggttaagaagcagcgggcaggggtgctgtgggatgtgccttctccaccccctgtcggaaaagccgaattggaggacggcgcgtatagaatcaagcagaggggcatatttgggtactcccagattggagctggtgtgtataaagaaggcaccttccacactatgtggcatgttacacgtggggccgtattaatgcaccgcggaaagcggatcgagccgtcatgggcagatgtgaaaaaggacctgatcagttacggcggtgggtggaagctcgagggagaatggaaagagggcgaagaggtccaagtgctggcccttgaaccaggcaagaatcccagagctgttcagaccaaacctgggctgtttaagacgaacactggaaccattggtgccgtgagcttggatttctccccaggcacatctgggtcgcccatcgtcgacaggaaaggaaaggtggtaggcctatacggtaatggggtcgtgacccgaagcggagcatatgtttcagctatagcccagacagagaagtccattgaggataaccctgaaatcgaggacgatattttccggaaaaagcgcctgactatcatggacctccatccgggcgcgggcaaaaccaagagatacctgcccgccatagtgagggaagcaattaaacgggggcttcgaacgttaatcctggctccaacaagagtcgtggccgctgagatggaagaggcactccgcggattgcctatcaggtatcagactcccgccattcgtgccgagcacaccggtcgggaaatcgttgacctgatgtgtcatgctacatttaccatgagactcctgagtccagtgagggtccctaactacaatcttattataatggatgaggcgcacttcactgaccccgcatctatcgccgctcgcggctatattagcacccgagtggaaatgggggaggccgcaggaatctttatgacagccacgccaccgggctccagagatcctttcccccaatcaaacgctccaatcatggacgaggaacgggagattcccgaaaggtcttggaatagcggtcacgagtgggtaactgattttaaggggaagaccgtgtggttcgttcctagtataaaagcgggaaacgacatcgccgcatgcctgcgcaagaatggcaaaaaggtcattcagttgtcccgtaaaacatttgatagcgaatacgtgaagaccagagctaacgactgggatttcgtggtcactacagacatctctgagatgggcgccaattttcgggcagagagggtaattgatccacgccgatgtatgaagcccgtgatcctaaccgacggggaagagagagttatactggccggacctatgccggtgacgcattcatccgctgcccagcggaggggtcgcatcggcagaaaccccaaaaatgaaaacgaccaatatatttacatgggggagcccctcgaaaatgatgaggactgcgcgcactggaaggaggcaaaaatgttactggataacatcaatactcctgaaggaattatccccagtatgttcgagccagaaagggagaaggtcgacgccatagatggcgaataccggcttcgtggtgaggctcgcaaaacatttgtggacctgatgcgaagaggggatctccctgtttggttggcctatagggtggctgcagagggcattaactacgccgaccggcgctggtgtttcgatggaatcaagaataaccagattctggaagagaacgtcgaagtggagatctggaccaaagagggcgaaagaaagaagctcaaacccaggtggctggacgctcggatatatagcgatccacttgccctaaaggagttcaaagaatttgcagcggggcgaaagtcgctgaccttgaatttaatcactgagatgggaagactgcctacattcatgacccagaaagcccgcgacgctctcgataacctggccgtacttcatacagcagaagtgggtggcagggcttacaatcacgccctgtctgagctcccggagactttggaaacgctgctactgctcacccttctggcaacagttactgggggaatatttttattcttgatgtccggcaagggtatcgggaagatgaccctgggcatgtgctgcattatcacagccagcatactcctgtggtatgctcagattcaaccccactggatcgcggcctcaatcattcttgagtttttcctgatcgtcctcttgataccagaacctgagaaacagcggaccccacaggacaaccagctgacttacgtggtgattgcaatcttaacggtcgttgctgccaccatggccaatgaaatgggatttctagagaagaccaaaaaggacctgggcctcgggagtattatcactcaagagtctgaatccaacatacttgatatcgacctgcgtccagcaagcgcttggaccttgtatgccgtggcgacaaccttcgtaactcctatgctgagacattcaattgagaatagtagcgtgaacgtctccctcacagctatcgccaatcaggcaacggtgctgatgggacttggtaggggctggcccctctctaaaatggatattggggttccgctgttggccatcggatgttacagccaggtgaacccaattaccctgatcgctgcattactactgctcgtcgcccactacgcgataattggccctggtcttcaggctaaggccactcgcgaagcacaaaagcgggccgctgccgggatcatgaaaaatcccacagtagacggcatcaccgtgattgatctggagccaataccctatgaccctaagtttgaaaaacagttgggacaggttatgctgctcgtgctgtgcgtcacccaggtgcttatgatgcgaacaacttgggcattatgtgaggctctgacgctcgccaccggcccgatctccacattgtgggaggggaaccccggaagattctggaatactaccattgcggtctcaatggccaacatctttaggggctcttacctggctggtgctgggctactgttcagtattatgaagaatacaaccaacactcgccggggaacgggcaatatcggtgaaacactcggcgagaaatggaagtcgagacttaacgccctgggaaagagcgaatttcaaatatataaaaagtccggaatccaggaggtggatcgtaccttggcaaaagagggcattaagagaggggaaactgaccatcacgctgtttctcggggatcagccaaactgcgctggttcgtggagcgaaacatggtaaccccagaaggcaaggtggtcgatctcggttgcgggagaggaggctggagctactattgtggtggcctgaaaaatgttagggaggtgaaggggttaacaaagggaggccctgggcatgaagaaccaatccctatgtccacttacggatggaaccttgtccggctgcagagtggcgtggacgtattctttaccccacccgagaaatgcgatacactcctatgtgacattggtgaatctagccctaatccaacgatcgaggccgggcgcaccctgagagtgttgaacctggttgaaaattggctcaacaataacactcaattctgcataaaggtgcttaatccctatatgccgtcagtcattgagaaaatggaaacactgcagaggaagtacggaggcgcgttggtgcgaaaccctctgtcccggaatagtacccacgagatgtactgggtcagcaacgctactggcaatatcgtgtcttccgttaacatgatctcacgtatgctcattaatagatttacaatgaaacacaagaaggcaacctatgagccagatgtagacttagggagcggaacgcgcaacataggtatcgaaaacgagattcccaatctggacatcattggcaaaaggatcgaaaagataaaacaggagcatgaaacctcgtggcactacgatcaggaccatccttataagacatgggcctaccacgggtcttatgagactaaacaaaccggaagtgcttccagcatggtgaacggcgtcgtgcggcttctgacaaagccatgggatgttgtgcccatggtcactcagatggccatgaccgacacaaccccgttcggtcagcagagagtgtttaaggagaaagtagatactcgcacgcaagaacctaaggaggggaccaaaaagctaatgaggatcacagcagaatggctctggaaagagctgggaaagaagaaaactccccgaatgtgtacccgggaggagttcacaagaaaggtgaggtcaaatgccgctttgggcgcgatttttacggacgagaacaaatggaagtccgcccgcgaagcagttgaggattctcgtttctgggaactggtcgaccgggagagaaatctccaccttgagggcaaatgcgaaacctgtgtgtacaacatgatggggaagagggagaaaaagctgggagaatttggtaaggctaaaggcagccgcgccatctggtatatgtggttaggggcacgattcctggagtttgaagccttgggattcctcaatgaggatcattggtttagtcggggcaactccctgagcggtgtggagggggaaggactacacaaacttggctacattctgagagacgtctctaaaaaggagggcggggctatgtacgccgatgacactgcgggatgggacacaaggatcaccctcgaagatctgaaaaatgaggaaatggttactaaccatatgaagggtgagcacaagaaattggcagaggccattttcaagctgacatatcagaataaagtggtacgcgtgcagagaccaacccctcggggcacagtcatggacataatctcaaggaaggatcagcgtgggagtggacaagtgggcacttacggtctcaacaccttcacgaatatggaagctcagcttattcgacagatggagggggaaggaatctttaaatccatccaacatctgaccgttacagaggagattgccgtgcagaactggttagcacgcgtcggcagagaacggctgagcaggatggctatatctggcgacgattgcgtggtaaagcccttggacgatcgcttcgcctcggctctcactgccctgaatgacatggggaaggttagaaaagatatccagcagtgggagccatcacggggatggaacgactggacccaagtgcccttttgcagccaccacttccatgagctagtcatgaaggatggtagggtgcttgtggtcccttgtcgaaaccaggacgagctgattggccgtgcaagaatctcccagggggcgggatggagtctcaaagaaacagcctgcctgggcaagtcttatgctcagatgtggactttgatgtactttcaccgccgggatttaaggctggccgcaaatgctatttgtagcgccgttccatcccattgggtgccgacctcaagaacgacatggagtatccacgcaaaacacgagtggatgaccactgaggacatgctcgccgtatggaaccgcgtgtggatacaagaaaatccctggatggaggacaagacacctgtcgaatcttgggaggaagtgccatatcttggtaagcgggaggatcagtggtgcgggagcctgatcggactaacctccagggcgacttgggctaaaaacattcagaccgccatcaatcaggttcgatcactgattggcaacgaggaatacacagactatatgcccagcatgaagagattccggaaagaggaagaggaagcaggcgtgctctggtga

SEQ ID NO: 15025 - RNA, 9876 nt, synthetic construct
  misc_feature 1..9876: note = derived and/or modified CDS sequence (opt3) from DENV-2__GQ398292__SS-prME
  source 1..9876: mol_type = other RNA
accgcaggcgtgttcatcatgctgattcccactgctatggcatttcacctcactacgagaaacggggagcctcatatgatagtcgggaggcaggaaaagggtaaaagccttctgttcaagaccgaggacggcgttaatatgtgcacattgatggccatcgatttaggggaactgtgtgaggacactattacctacaaatgcccactactccggcaaaacgaaccggaggatatcgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggattgagacctggatcatgcggcatcctggctttacaataatggccgcaatcctggcctacaccattggcacgactcacttccagcgcgctttgatctttattctcctgacagcagttgccccatccatgaccatgagatgcatcgggatatctaacagggatttcgtggaaggagtctcgggtggctcatgggtggacattgtactggagcacgggagctgtgttactacaatggctaagaataagcccaccctcgattttgaattaatcaaaacggaggccaagcagcctgcgaccctgcggaaatattgcattgaagcaaaacttacaaacactaccacagagagtcgctgtccaactcaaggagagccctccttgaatgaagaacaggacaaacgattcgtgtgcaagcattctatggtcgatagaggctggggtaacgggtgtggactgtttggcaagggcgggatcgtgacctgcgccatgttcacatgcaaaaagaatatggaaggaaaagtggtcctacctgagaacctcgaatacaccatcgttattactccacacagcggtgaggagcatgctgtgggcaatgacacggggaagcacggaaaagaaataaagatcacaccgcagtcctcaattaccgaggccgaactgactggctatggtaccgtaacaatggagtgtagtcccaggaccgggcttgattttaacgaaatggtgctgttgcagatggaggacaaagcatggctcgtccaccggcaatggttcctggatttacctctgccatggctccccggcgctgacactcagggaagcaattggatccagaaggagacacttgtgacgtttaagaaccctcatgccaaaaagcaggacgttgtggtcctgggctctcaagaaggggcgatgcacaccgccttgactggagcaacagagatacagatgtcctcaggtaatctactgttcaccggccatctcaaatgccgtctgcgcatggataaacttcagctgaaagggatgagctacagtatgtgtacaggaaagttcaagattgtgaaagaaatcgctgagactcaacacggcaccatcgtaattagagttcagtatgagggtgacgggtctccatgcaagatcccctttgaaattatggatttggagaaaaggcatgtgctcggccggctgataacggtcaacccgatcgtggccgaaaaggactcccctgtcaacattgaggctgaacccccattcggagatagctacatcatcattggcgtggagcctgggcagttaaaactgaattggtttaagaagggatcgtctataggtcagatgttcgagaccacaatgcgaggcgccaaacgcatggcaatcctaggggacactgcctgggattttggatccctcggcggtgttttcacctcaattgggaaggctctgcaccaagtgtttggcgcgatctacggagcagccttcagtggcgtaagctggacaatgaaaattcttatcggggtcataatcacttggattggaatgaactccagatctaccagcttgtcagtgagtctggttctcgtgggcgtcgtgacgctgtatcttggtgctatggtacaggccgactccgggtgtgtggttagctggaagtctaaagaactgaagtgcggatcaggcatctttattacagataatgtccacacctggactgagcagtacaagttccagcccgaaagtccaagcaaattggcatccgccatccaaaaggctcatgaggaaggtatatgtggcattaggtctgtgacacggctcgagaacctgatgtggaaacagatcacccccgagttaaatcacattctgtcggaaaacgaggtgaagctaactatcatgaccggggacataaaaggaatcatgcaggccggcaagcgcagcctcagacctcagccaacagaactgaaatattcctggaagacgtgggggaaggcaaaaatgctttcaaccgagagtcataatcaaacatttttgattgatggaccggaaacagcggagtgccccaacaccaatagggcttggaactctctggaggtcgaagactacggcttcggtgtttttacaactaatatctggctcaagctgcgtgagaaacaggacgtgttctgtgatagcaagttaatgtccgccgcaattaaagacaaccgggccgtgcacgctgatatggggtattggatcgaatcagccctgaatgacacctggaagatggagaaggcatcattcatagaggtaaaatcttgccactggcctaagtcccatacgctttggagtaacggagtcttggaaagcgagatgattatccccaagaattttgctggccccgtgtctcagcacaactaccgacctggttatcatacacagaccgccggcccatggcacctcgggaagctggaaatggatttcgacttttgtgagggaactaccgttgtggtcacagaagattgcggcaacagagggccctccctaaggactaccacagcgtcaggaaaactgatcacggagtggtgctgtcgcagttgcaccctcccgcctctgcggtacagaggcgaggacggttgttggtacgggatggaaattaggccacttaaggagaaggaagagaatttggtgaacagcctggttactgccggacatggccaaatcgataatttctcgttaggtgtgctcggcatggctctgtttcttgaagagatgctgcgcacacgagtagggaccaaacacgcaatgttgctcgtcgccgtgtccttcgtgactctgattacaggaaacatgtcttttcgggacctaggccgtgtcatggttatggtgggggctaccatgacggatgacataggaatgggcatcacttatctggccctcctggcagcgttcaaggtaagacccacctttgccgctggtcttttgctgaggaaattaacaagcaaggagctcatgatggccaccattgggatcgcactgctttcacagagtactattcctgaaacaatcctggagctaaccgatgctctcgccctgggaatgatggtgttgaaaatagtccgcaatatggaaaagtaccagctggcagtgacaatcatggccatttcctgcgttcccaacgctgtgatcttacaaaatgcgtggaaggtctcttgtactattctcgccgcagtgagcgtttccccactgcttctgacctcaagccagcagaaagctgactggatccctttggccctcacgataaagggcctgaaccccacagccattttcctaaccactctgagtcggacctctaaaaagagatcctggccacttaatgaggctatcatggcagtgggcatggtcagcatcctcgcctcgtcactgttgaaaaacgacattccgatgacagggcctctggtagcgggaggtttactcactgtgtgctatgttctgaccggcaggtctgctgatcttgaactggagcgagccgcagacgtgaagtgggaggatcaggccgaaataagtgggtccagccccatcttgtctattacgatcagcgaggacggatccatgtcaattaaaaatgaagaggaggaacaaacactcaccatcctgatacgcactggcctactggtcatcagtggtgtgtttccagtaagcattcccatcacagctgcagcctggtacctttgggaggtgaagaagcagcgggcgggggtcctctgggatgttccttctccaccccctgtgggaaaagctgaactggaggacggcgcctatagaattaagcagaggggcatcttggggtactcccagataggagccggtgtgtataaagaaggcaccttccacactatgtggcatgtcacacgtggggcagtgttaatgcaccgcggaaagcggattgagccgtcatgggctgatgttaaaaaggacctgatcagttacggcggtgggtggaagctcgagggagaatggaaagagggcgaagaggtacaagtgctggcccttgaaccaggcaagaaccccagagcagtccagaccaaacctgggctgtttaagacgaatactggaaccatcggtgctgtgagcttggatttctccccaggcacatctgggtcgcccattgttgacaggaaaggaaaggtggtcggcctatacggtaacggggtggtaacccgaagcggagcctatgtctcagcgatcgcccagacagagaagtccatagaggataatcctgaaattgaggacgatatcttccggaaaaagcgcctgactattatggacctccatccgggcgcaggcaaaaccaagagatacctgcccgctatcgtgagggaagccataaaacgggggcttcgaacgttaattctggctccaacaagagttgtggcagccgagatggaagaggccctccgcggattgcctatcaggtatcagactcccgctatccgtgcggagcacaccggtcgggaaattgtcgacctgatgtgtcatgcaacatttaccatgagactcctgagtccagtgagggttcctaactacaaccttatcattatggatgaggcccacttcactgaccccgcttctatagccgcacgcggctatatcagcacccgagtggaaatgggggaggccgctggaatttttatgacagcgacgccaccgggctccagagatcctttcccccaatcaaatgccccaatcatggacgaggaacgggagatccccgaaaggtcttggaacagcggtcacgagtgggtcactgattttaaggggaagaccgtgtggttcgtacctagtattaaagcaggaaatgacatagctgcctgcctgcgcaagaacggcaaaaaggtgatccagttgtcccgtaaaacatttgatagcgaatacgttaagaccagagcaaatgactgggatttcgtcgtgactacagacatttctgagatgggcgccaactttaaggctgagcgggtgatcgatccaaggcgctgtatgaaacccgtcattctaaccgacggggaagaacgagtaatcctggccggacctatgccggtgacgcattcatccgcggcacagagacggggtaggataggccgcaatccaaagaacgaaaatgaccaatatatctacatgggggagcccctcgaaaacgatgaggactgcgcccactggaaagaggctaagatgttactggataatattaacactcctgaaggaatcattcccagtatgttcgagccagaaagagagaaagttgacgccatcgatggcgaatacaggcttcggggtgaggctcgtaagacatttgtggacctgatgcgccgaggggatctccctgtctggttggcatatagagtggccgctgagggcataaattacgccgacaggcggtggtgtttcgatggaattaaaaacaatcagatcctggaagagaacgttgaagtggagatttggaccaaggagggcgaacgcaagaaactcaagcccagatggctggacgcaaggatctatagcgatccacttgcgctaaaagagttcaaggaatttgccgctgggcggaaatcgctgaccttgaacttaataactgagatgggacgactgcctacattcatgacccagaaggccagagacgcactcgataatctggctgtccttcatacagccgaagccggtggccgcgcctacaaccacgctctgtctgagctcccggagactttggaaacgctgctactgctcacccttctggcgacagtgactgggggaatctttttattcttgatgtccggcaagggtattgggaaaatgaccctgggcatgtgctgcatcattacagccagcatcctcctgtggtatgcacagatacaaccccactggattgctgcctcaatcatccttgagtttttcctgattgtactcttgatcccagaacctgagaagcagaggaccccacaggacaatcagctgacttacgtggttatagccattttaacggtcgtggcagctaccatggccaacgaaatgggatttctagagaaaacaaagaaagacctgggcctcgggagtatcgcgactcaagagtctgaatccaatattcttgatatcgacctgcggccagctagcgcctggaccttgtatgcagtggccacaaccttcgtcactcctatgctgcgtcattcaatagagaacagtagcgttaatgtgtccctcacagctatcgcaaaccaggccacggtactgatgggacttggtaagggctggcccctctctaagatggatattggggtgccgctgttggcgatcggatgttacagccaggtcaatccaattaccctgactgctgccttactactgctcgtggcacactacgccatcattggccctggtcttcaggctaaagccacaagagaagcacaaaagagggctgccgcggggatcatgaaaaaccccaccgttgacggcataaccgtgattgatctggagccaatcccctatgaccctaagtttgaaaaacagttgggacaggtcatgctgctcatcctgtgcgtaacacaggtgcttatgatgcgcactacgtgggccttatgtgaggcactgaccctcgctacaggcccgatttccactttgtgggaggggaatcccggacggttctggaacaccacaatagccgtttcaatggcaaatatctttcgaggctcttacctggctggtgccgggctactgttcagtattatgaagaacaccactaatacgagaaggggaacaggcaacatcggtgaaaccctcggcgagaagtggaaatcgcgccttaatgccctgggaaagagcgaatttcaaatttataaaaagtccggaatccaggaggtggatcggactttggcgaaagagggcataaagagaggggaaaccgaccatcacgctgtctctcgtggatcagcaaaactgaggtggttcgtggagcggaacatggtcacaccagaaggcaaggtggttgatctcggttgcgggcgcggaggctggagctactattgtggtggcctgaagaacgtgcgagaggtaaaagggttaactaagggaggccctgggcatgaggaacccatccctatgtccacctacggatggaatcttgtgagactgcagagtggcgtcgacgttttctttacaccacccgagaaatgcgatacgctcctatgtgacattggtgaatctagccctaacccaaccatcgaggccgggaggactctgcgggtgttgaatctggtcgaaaactggctcaataacaatacacaattctgcattaaggtgcttaacccctatatgccgtcagtaatcgagaaaatggaaaccctgcagcgcaagtacggaggcgctttggtgagaaatcctctgtccaggaacagtactcacgagatgtactgggttagcaatgccacaggcaacatagtgtcttccgtcaatatgatttcacgaatgctcatcaaccggtttaccatgaagcacaaaaaggcaacgtatgagccagatgtggacttagggagcggaacccgtaatatcggtattgaatcggagatacccaacctggacatcattggcaaaagaatcgaaaagattaaacaggagcatgaaacatcttggcactacgatcaggaccatccttataagacttgggcctaccacgggagttatgagaccaagcaaacaggatccgctagctcaatggtcaacggcgtggttcgccttctgactaaaccatgggatgtagtgcccatggtcacccagatggcgatgacagacaccactccgttcggtcagcagagggtgtttaaggagaaagttgatacgcggacacaagaacctaaggaggggaccaaaaagctaatgaagatcactgccgaatggctctggaaagagctgggaaagaaaaagacccccagaatgtgtacacgcgaggagttcacgaggaaagtgcgatccaatgcagctttgggcgccatatttaccgacgagaacaagtggaaatctgcacgggaagccgtcgaggatagcagattctgggaactgatcgacagggagcgcaatctccaccttgagggcaagtgcgaaacttgtgtgtacaacatgatggggaagcgtgagaaaaagctgggagaatttggtaaagctaagggcagtcgggccatttggtatatgtggttaggggcgagattcctggagtttgaagcattgggattcctcaatgaggatcattggttttccaggggcaacagcctgtctggtgtagagggggaaggactacaccgccttggctacatcctgcgagacgtgagcaagaaggagggcggggccatgtacgctgatgacacagccggatgggacacccggattactctcgaagatctgaagaatgaggaaatggttacaaaccatatgaaaggtgagcacaagaaattggcagaggctatcttcaagctgacctatcagaataaagtcgtgagagtgcagaggccaacacctcgcggcactgtcatggacattataagtagacgggatcagagggggtccggacaagttggcacctacggtctcaacacgttcaccaatatggaagcccagcttatccgtcagatggagggggaaggaatttttaagagcatccaacatctgacagtgactgaggagatcgctgtacagaactggttagcccgagtgggccgcgaaagactgtctcggatggcaatttcgggcgacgattgcgtcgtgaagcccttggacgataggttcgcgtcagccctcaccgctctgaatgacatggggaaagttcgcaaggatatacagcagtgggagccaagcagaggatggaacgactggacacaagtgcccttttgctcccaccacttccatgagctagtcatgaaagatggtcgggtgcttgtagttccttgtaggaatcaggacgagctgatcggccgagcccgtattagtcagggggcaggatggtctctcaaggaaactgcttgcctgggcaaaagctatgcccagatgtggaccttgatgtactttcacagacgcgatttacggctggcagccaacgcgatctgttccgctgtgccatcacattgggtcccgacgagtaggacaacctggtctattcacgccaagcacgagtggatgactacagaggacatgctcgcagtgtggaacagagtgtggatccaagaaaatccctggatggaggacaagacccctgtcgaaagctgggaggaagttccatatcttggtaaacgcgaggatcagtggtgcgggtccctgataggactaacttcacgggccacctgggctaagaacatccagacagccattaatcaggtgaggagcctgatcggcaacgaggaatacacggactatatgccctctatgaaacgattcagacgggaggaagaggaagcaggcgtactctggtga

SEQ ID NO: 15026 - RNA, 9876 nt, synthetic construct
  misc_feature 1..9876: note = derived and/or modified CDS sequence (opt3) from DENV-2__GQ398267__SS-prME
  source 1..9876: mol_type = other RNA
accgccggaatcattataatgatgatccccacagtgatggctttccacctgactacgcgaaacggggagcctcatatgattgtcagcaggcaggaaaagggaaaatccctcctttttaagaccgagaatggtgttaacatgtgcaccctgatggcaatggacttgggcgaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgttgcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgaggtgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacaccctgcgacgctgcggaagtactgcgtggaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaaggtcgttcagcctgaaaacctagagtatacaatcgtgattaccccacactccggagaagagaatgccgtaggtaacgatactggcaaacatgggaaggagataaaagtgacgccgcagtcaagtatcacagaagcagagctcaccggatacggcactgtcaccatggaatgtagccccaggacaggtctggacttcaatgagatggtgcttctgcagatggaaaacaaggcttggttggttcaccggcaatggtttctcgatctgcctttaccatggctgcccggggccgacacccagggctctaactggattcagaaagagactctcgtgacattcaagaatcctcacgcgaagaaacaggatgtcgtggtacttggatcccaagagggcgccatgcatacggcactgaccggggctactgaaatccagatgtcaagcggaaacttgctatttacaggtcacctgaagtgccgtctccgcatggacaaactgcagcttaagggcatgagttattctatgtgtaccgggaaattcaaggttgtgaaggagatagccgaaacacaacatggaactattgtcatcagagtgcagtacgagggcgacggttccccatgcaaaatccccttcgagattatggatctggaaaagaggcacgtcttggggcggctcatcaccgtgaatccgattgttacggagaaagacagccctgtgaacatagaagctgagcccccatttggcgattcgtacatcattatcggagtagaacctggccagctgaagttatcttggttcaaaaaggggtcctcaatcggacagatgtttgagaccacaatgcgaggtgccaagcgcatggcaattctgggcgacactgcctgggatttcgggagtctaggaggcgtctttaccagcataggtaaagctctccatcaagtgttcggggcgatctatggcgcagccttttccggagtttcttggacaatgaagattctgatcggcgtggtcattacttggatcgggatgaatagcagatcaaccagtctttccgtgagcttggtactggtgggagttgtcacgctctacctgggcgtgatggtgcaggctgactctggttgtgtcgtttcatggaaaaacaaggagcttaaatgcgggagtggaatattcatcacagataatgtgcacacctggactgaacagtataagtttcagcccgagagcccatccaagctggcctctgcaattcaaaaagcccacgaagagggcatctgtggtattaggtcggtgacacggttggaaaacctcatgtggaagcagatcacccccgagctgaatcatatattaactgagaacgaagtaaaactgaccattatgacaggcgacatcaaggggattatgcaggctggaaaacgcagcctaagacctcagccaacggagctcaagtactcctggaaagcctggggcaaggcaaagatgctgtcaaccgaacttcacaatcatactttcttgatcgatgggccggagacagcggaatgccccaacaccaatagggcttggaacagtctggaggtcgaggactatggatttggcgtgttcacaactaatatatggctcaaactgaaggaacgtcaagatgtattttgtgactctaaattaatgagcgccgcaatcaaggacaaccgggccgtgcacgctgatatgggttactggattgagtccgccctgaacgacacctggaaaatcgaaaaggcatcattcattgaggtcaagagctgccactggcctaaatctcatacgctttggtccaatggggtgttggagagtgaaatgatcataccaaagaacttcgctggacccgttagccagcacaattatcgacctggctaccatacacagaccgccggtccatggcacctcggcagactggagatggattttgacttctgtgaagggactaccgtggtagtcacagaggattgcggaaacaggggcccctctctacgcactaccacagcgtccgggaaactgattacggaatggtgctgtcggtcatgcaccctcccgcctctgagatacaggggagaggacggctgttggtatggtatggagatccgcccacttaaggaaaaagaggaaaatttggtgaacagtctggtgactgccgggcatggacagatcgataattttagcttaggcgtcctcggtatggctctgttccttgaggaaatgctgcgaacacgggttggcaccaagcacgcaattttgctcgtggccgtatcgtttgtgactctgatcacagggaacatgtccttccgtgacctaggaagagtcatggtgatggttggcgctaccatgacggatgacattgggatgggagtgacttacctggccctcctggcagcgtttaaggtcaggcccaccttcgccgctggccttttgctgcgcaaattaacatctaaggagctcatgatgaccactataggtatcgtgctgcttagccaatcaacaattcctgagagtatcctggaactaaccgatgccctcgcactggggatgatggttttgaaaattgtgcggaatatggagaagtatcagctggctgtcacaatcatggccatattatgcgtacccaacgcagtgatcctccagaatgcctggaaagtttcctgtactaccctggctgtggtctctgtgagcccacttctgttgacgtcctcacaacagaaggcggactggattcctctcgccctgacaatcaagggactaaaccccaccgcaatttttctgactacccttagcagaacaagtaaaaagaggtcttggccactcaatgaagctatcatggccgtaggcatggtgtccatactggccagctcgttgctgaaaaacgatattccgatgactggccctttagtcgctgggggactcctgaccgtttgctacgtgcttacgggtcgatcagcagacctggagttggaacgcgccgcggacgtgcggtgggaggagcaggctgaaatctctggcagttcccccatcctcagcattacaatatctgaggatgggagcatgtccatcaagaatgaagaggaggaacagaccctgactattctaatcagaacaggactgcttgtcatttcaggcctcttcccagtgagtatccccataaccgccgcagcctggtatctgtgggaggttaaaaagcaaagggctggtgtattgtgggacgtgcctagcccaccccctgtcgggaaagcagaattagaggatggagcctaccgtatcaagcagaagggcattctgggctattctcagatcggggcgggagtgtacaaagaaggtacttttcacacaatgtggcatgttacccgcggcgctgtgctcatgcacaaggggaaacggattgagccgtcctgggccgacgtcaagaaagatctgatctcatacggaggcggttggaaacttgagggggaatggaaggagggagaagaggtgcaggtactggcattggaaccaggcaaaaaccccagagccgtccaaacgaagcctggcctattcaaaactaacaccgggacaataggagctgtgagtctggactttagcccaggtacctccggctctcccattgttgataagaaagggaaggtggtcggactctatggcaatggtgtggttacaaggtcggggacttacgtgagcgccatcgcacagaccgagaagtcaatcgaggacaaccctgaaattgaggatgacatcttcagaaagaaacggctgacgataatggatcttcatccgggagctggcaaaacaaagcgctatttacccgccattgtcagagaagcgatcaaaaggggcctgcggactctcattttggccccaacccgagtggtagcagctgagatggaagaggccctgagagggctccctatccgctaccagacacccgctataagggcagagcacaccggacgtgaaattgtggacctgatgtgtcatgccactttcaccatgcggcttctgtccccaatcagagttcctaattataacttgatcattatggatgaggcccactttacagaccccgctagtatcgcggcaaggggttacatttctacgcgcgtcgaaatgggcgaggccgctgggatattcatgactgccaccccaccgggaagccgagacccttttccccagtccaatgcaccaatcatggatgaggaaagagagattcccgaacggtcatggaactctggccacgagtgggtgacagacttcaagggtaagaccgtgtggtttgtccctagcatcaaagccgggaatgatatcgctgcgtgcctaaggaagaacggcaagaaggtaattcaactgagtcgcaaaactttcgactccgaatatataaagacacgtaccaatgattgggactttgtggttacgactgatatcagcgagatgggcgccaacttcaaggcagagagagtgattgacccacggaggtgtatgaaacccgtcatcctcacagatggcgaagaacgcgtgattttagctgggcctatgccggttacccattcttcagccgcacagcgaagaggacgggtgggtaggaatccaaagaacgaaaatgaccagtacatctacatgggcgagcccctggaaaacgatgaggactgcgcccactggaaagaggctaagatgcttctggacaatataaacacccctgaagggatcattccctccatgtttgagccagaacgcgagaaagtcgatgccatcgacggagaatatagactcaggggcgaggcgcggaagactttcgtggatttgatgcgtcgcggtgacctgcctgtatggctcgcataccgagtggccgctgaggggattaactatgccgatagaaggtggtgttttgacggcgttaaaaataaccaaatcctggaagagaatgtcgaagtggagatatggacaaaggagggagaacggaagaaacttaagccccgctggctagatgctagaatttacagtgacccactggcattgaaagagttcaaggagttcgccgctggcaggaagtcgttaaccctgaacctcatcacagagatggggcggctgcctacttttatgacgcagaaggccaagaatgcacttgataacctggcggtgctccataccgccgaagctggaggtcgagcctataatcacgcattgagcgagctgccggagacactagaaactctgctccttctgaccttattggctacagtcaccggcgggattttcctgtttctcatgtctggaaaaggcatcggtaagatgactctggggatgtgctgcataatcacggcctccattcttctgtggtacgcacagatccagccccactggattgccgctagcatcatactcgagttctttttgattgttctgttaatcccagaacctgagaaacaaagaacaccccaggacaaccagctaacatatgtggtaatcgcgattctgactgtggtcgccgcaaccatggctaatgaaatgggcttcctcgagaagaccaagaaggattttggacttggctcaatcaccactcagcaaccagagagtaacatactggacattgatttgcgccctgcctctgcctggacactgtacgcagtggctacgaccttcatcactcccatgctcaggcattccattgaaaatagctcagttaacgtgagtctgacagccatcgcgaatcaggctaccgtccttatggggctcggaaagggttggccgctgagcaaaatggacataggcgtaccattgctggccatcgggtgttactcccaggtgaaccctattaccttaatcgcagccctactgctccttgttgctcactatgcaattatcggacccggcctgcaggccaaggcgacacgggaggctcaaaaacgtgccgcagccggtattatgaagaatccaactgtggacgggatgacggtcatcgatttggaccccataccttacgatccgaaatttgaaaagcagctgggccaggtgatgctcctggtcctttgcgtgacccaggttttaatgatgagaacaacttgggctctgtgtgaggccctcaccttggcaacaggacccatttctaccctgtgggaaggcaacccagggaggttctggaatactacgatcgctgtgagcatggccaacatctttcgcggatcctatctagcgggcgccggtctactcttctcaattatgaagaacacagcaaatacccggcgagggactggaaacataggcgagacccttggtgagaaatggaagaatagactgaacgctttgggcaaatctgaatttcaaatctacaagaaaagtgggattcaggaggtagacaggacactggccaaggaaggaatcaaacgcggcgagactgatcatcacgcagtgtcgcgggggagcgctaagctcagatggttcgtcgagcgtaatctggttacccctgaaggaaaggtggtcgacttaggctgcggtagagggggatggtcctattactgtggcggtcttaaaaacgtgaaggaggtaaaaggcctgacaaaagggggacccggccatgaagaacctattccaatgtctacgtatgggtggaatctcgtgcggctacagtcaggagttgatgtgttctttacaccccctgaaaaatgcgacactctgttgtgtgatatcggcgagagctccccaaaccccacagtcgaggccggtcgcaccctgcgagtgctcaatcttgtcgaaaactggctgaataacaatactcaattctgcataaaggtgttgaacccgtacatgcctagtgttatcgagaagatggaagccctgcagagaaaatacgggggagcgctcgtaaggaatccattatctcggaacagcacacacgagatgtattgggtgtcaaacgcttccggcaatattgtcagtagcgtgaacatgatctctcgcatgctgattaatagatttaccatgaggcacaagaaagcaacgtacgaacccgacgttgatcttggctccgggacccgaaacatcggaatagagtcagagacacctaatctggacattatcggtaagcggatcgagaaaattaagcaggagcatgaaactagctggcactatgatcaggaccatccatacaagacctgggcctatcacggctcgtacgagacaaaacaaactgggtctgctagttccatggtgaacggagtcgtgcgtctactcaccaagccctgggacgtaataccgatggtgacacagatggccatgaccgatactacgcctttcggccagcagagagtttttaaagaaaaggtcgacacacgcacccaagagcccaaagagggtactaagaagctgatgaaaatcaccgcagaatggttgtggaaggagctggggaaaaagaaaacaccaaggatgtgtacgcgggaagagttcaccagaaaggtgcgcagcaatgccgctctcggagcgatttttactgatgagaacaaatggaagtcagccagggaagcagtggaggactccggcttctgggaacttgtcgataaggagcgaaatctgcacttagaaggcaaatgcgagacatgtgtttataacatgatggggaagcgggagaaaaagctgggagaatttggtaaagctaagggctctagagccatctggtacatgtggttgggggcaaggttcctcgagtttgaagccctgggattcctaaatgaggaccattggtttagccgcgaaaacagtctttccggcgtggagggtgaggggctgcacaagctcggatacattctgcgtgatgtaagcaaaaaggaaggcggcgctatgtatgccgacgataccgcggggtgggacactcggatcacattggaggatctgaaaaatgaagagatggtgaccaaccatatggaaggagagcacaagaaactcgcagaggccatattcaaacttacataccagaataaggtcgtgagagttcagaggcctactccccgcggtaccgtgatggacatcatttctcgacgggaccagagaggctcagggcaagtcgtgacgtatggactgaacaccttcacaaacatggaagctcagttaatcaggcagatggagggcgaaggtgtatttaaaagtattcaacagctgactgttaaggaggagatcgccgtgaaaaattggttgattcgcgtcgggagagaacggctctccaggatggcaataagcggagatgactgcgtggtgaagccactggatgaccgtttcgcttctgccctaatcgctcttaacgatatgggcaaagtccgaaaggacattcagcagtgggagccctcgcgcggctggaatgattggacccaagttcctttttgctcacatcacttccacgaactgatcatgaaggacgggagagtgctcgtagtgccatgtcggaaccaggatgagctgatcggaagggcccgcattagccagggtgcaggctggtccttgagagaaacagcgtgcttagggaaaagttacgcccagatgtggtctctgatgtattttcatcggagggacctccgacttgctgccaatgcaatatgtagcgctgtcccgtcccactgggtgcccacttcacgtaccacgtggagtatccatgccacacacgagtggatgaccactgaggatatgctgacagtttggaacagagtgtggattcaagaaaatccttggatggaggacaagaccccagtcgaatcttgggaggaaatcccctacctaggaaaacgcgaggatcagtggtgcggcagcctgattggtctcacttcccgggcaacctgggccaagaacatccagacagcgataaatcaggtgaggtcattgatcgggaacgaggaatatacggactacatgcctagcatgaaaagattccgccgggaggaagaggaagctggagtactgtggtga

SEQ ID NO: 15027 - RNA, 9876 nt, synthetic construct
  misc_feature 1..9876: note = derived and/or modified CDS sequence (opt3) from DENV-2__GQ398266__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacaccctgcgacgctgcggaagtactgcgtggaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaaggtcgttcagcctgaaaacctagagtatacaatcgtgattaccccacactccggagaagagaatgccgtaggtaacgatactggcaaacatgggaaggagataaaagtgacgccgcagtcaagtatcacagaagcagagctcaccggatacggcactgtcaccatggaatgtagccccaggacaggtctggacttcaatgagatggtgcttctgcagatggaaaacaaggcttggttggttcaccggcaatggtttctcgatctgcctttaccatggctgcccggggccgacacccagggctctaactggattcagaaagagactctcgtgacattcaagaatcctcacgcgaagaaacaggatgtcgtggtacttggatcccaagagggcgccatgcatacggcactgaccggggctactgaaatccagatgtcaagcggaaacttgctatttacaggtcacctgaagtgccgtctccgcatggacaaactgcagcttaagggcatgagttattctatgtgtaccgggaaattcaaggttgtgaaggagatagccgaaacacaacatggaactattgtcatcagagtgcagtacgagggcgacggttccccatgcaaaatccccttcgagattatggatctggaaaagaggcacgtcttggggcggctcatcaccgtgaatccgattgttacggagaaagacagccctgtgaacatagaagctgagcccccatttggcgattcgtacatcattatcggagtagaacctggccagctgaagttatcttggttcaaaaaggggtcctcaatcggacagatgtttgagaccacaatgcgaggtgccaagcgcatggcaattctgggcgacactgcctgggatttcgggagtctaggaggcgtctttaccagcataggtaaagctctccatcaagtgttcggggcgatctatggcgcagccttttccggagtttcttggacaatgaagattctgatcggcgtggtcattacttggatcgggatgaatagcagatcaaccagtctttccgtgagcttggtactggtgggagttgtcacgctctacctgggcgtgatggtgcaggctgactctggttgtgtcgtttcatggaaaaacaaggagcttaaatgcgggagtggaatattcatcacagataatgtgcacacctggactgaacagtataagtttcagcccgagagcccatccaagctggcctctgcaattcaaaaagcccacgaagagggcatctgtggtattaggtcggtgacacggttggaaaacctcatgtggaagcagatcacccccgagctgaatcatatattaactgagaacgaagtaaaactgaccattatgacaggcgacatcaaggggattatgcaggctggaaaacgcagcctaagacctcagccaacggagctcaagtactcctggaaagcctggggcaaggcaaagatgctgtcaaccgaacttcacaatcatactttcttgatcgatgggccggagacagcggaatgccccaacaccaatagggcttggaacagtctggaggtcgaggactatggatttggcgtgttcacaactaatatatggctcaaactgaaggaacgtcaagatgttttttgtgactctaaattaatgagcgccgcaatcaaggacaaccgggccgtgcacgctgatatgggttactggattgagtccgccctgaacgacacctggaaaatcgaaaaggcatcattcattgaggtcaagagctgccactggcctaaatctcatacgctttggtccaatggggtgttggagagtgaaatgatcataccaaagaacttcgctggacccgttagccagcacaattatcgacctggctaccatacacagaccgccggtccatggcacctcggcagactggagatggattttgacttctgtgaagggactaccgtggtagtcacagaggattgcggaaacaggggcccctctctacgcactaccacagcgtccgggaaactgattacggaatggtgctgtcggtcatgcaccctcccgcctctgagatacaggggagaggacggctgttggtatggtatggagatccgcccacttaaggaaaaagaggaaaatttggtgaacagtctggtgactgccgggcatggacagatcgataattttagcttaggcgtcctcggtatggctctgttccttgaggaaatgctgcgaacacgggttggcaccaagcacgcaattttgctcgtggccgtatcgtttgtgactctgatcacagggaacatgtccttccgtgacctaggaagagtcatggtgatggttggcgctaccatgacggatgacattgggatgggagtgacttacctggccctcctggcagcgtttaaggtcaggcccaccttcgccgctggccttttgctgcgcaaattaacatctaaggagctcatgatgaccactataggtatcgtgctgcttagccaatcaacaattcctgagagtatcctggaactaaccgatgccctcgcactggggatgatggttttgaaaattgtgcggaatatggagaagtatcagctggctgtcacaatcatggccatattatgcgtacccaacgcagtgatcctccagaatgcctggaaagtttcctgtactaccctggctgtggtctctgtgagcccacttctgttgacgtcctcacaacagaaggcggactggattcctctcgccctgacaatcaagggactaaaccccaccgcaatttttctgactacccttagcagaacaaataaaaagaggagttggccactcaacgaagctatcatggccgtaggcatggtgtctatactggcctccagcttgctgaaaaatgatattccgatgactggccctttagtcgctgggggactcctgaccgtttgctacgtgcttacgggtcgatcggcagacctggagttggaacgcgccgcggacgtgcggtgggaggagcaggctgaaatctcaggctctagtcccatcctctccattacaataagcgaggatgggtctatgagcatcaagaacgaagaggaggaacagaccctgactattctaatcagaacaggactgcttgtcatttccggcctcttcccagtgtcaatccccataaccgccgcagcctggtatctgtgggaggttaaaaagcaaagggctggtgtattgtgggacgtgcctagtccaccccctgtcgggaaagcagaattagaggatggagcctaccgtatcaagcagaagggcattctgggctatagccagatcggggcgggagtgtacaaagaaggtacttttcacacaatgtggcatgttacccgcggcgctgtgctcatgcacaaggggaaacggattgagccgtcttgggccgacgtcaagaaagatctgatctcctacggaggcggttggaagcttgagggggaatggaaggagggagaagaggtgcaggtactggcattggaaccaggcaaaaaccccagagccgtccaaacgaagcctggcctattcaaaactaataccgggacaataggagctgtgtcactggactttagtccaggtaccagcggctcccccattgttgataagaaagggaaggtggtcggactctatggcaacggtgtggttacaaggtctgggacttacgtgtcggccatcgcacagaccgagaagagcatcgaggacaatcctgaaattgaggatgacatcttccgaaaaaagcggctgacgataatggatcttcatccgggagctggcaaaacaaagcgctatttacccgccattgtcagagaagcgatcaaaaggggcctgcggactctcattttggccccaacccgagtggtagcagctgagatggaagaggccctgagagggctccctatccgctaccagacacccgctataagggcagagcacaccggacgtgaaattgtggacctgatgtgtcatgccactttcaccatgcggcttctgtcaccaatcagagttcctaactataatttgatcattatggatgaggcccactttacagaccccgcttccatcgcggcaaggggttacattagtacgcgcgtcgaaatgggcgaggccgctgggatattcatgactgccaccccaccgggatctcgagacccttttccccagagcaacgcaccaatcatggatgaggaaagagagattcccgaacggtcctggaattcaggccacgagtgggtgacagacttcaagggtaagaccgtgtggtttgtcccttctatcaaagccgggaacgatatcgctgcgtgcctaaggaagaatggaaaaaaggtaattcaactgagccgcaaaactttcgacagtgaatatataaagacacgtaccaacgattgggactttgtggttacgactgatatctccgagatgggcgccaatttcaaggcagagagagtgattgacccacggaggtgtatgaaacccgtcatcctcacagatggcgaagagcgcgtgattttagctgggcctatgccggttacccatagctctgccgcacagcgaagaggacgggtgggtaggaacccaaagaatgaaaacgaccagtacatctacatgggcgagcccctggaaaatgatgaggactgcgcccactggaaagaggctaagatgcttctggacaacataaacacccctgaagggatcattccctcaatgtttgagccagaacgcgagaaagtcgatgccatcgacggagaatatagactcaggggcgaggcgcggaagactttcgtggatttgatgcgtcgcggtgacctgcctgtatggctcgcataccgagtggccgctgaggggattaattatgccgatagaaggtggtgttttgacggcgttaaaaacaatcaaatcctggaagagaacgtcgaagtggagatatggacaaaggagggagaacggaagaaacttaagccccgctggctagatgctagaatttactccgacccactggcattgaaagagttcaaggaattcgccgctggcaggaaaagtttaaccctgaatctcatcacagagatggggcggctgcctacttttatgacgcagaaggccaagaacgcacttgataatctggcggtgctccataccgccgaagctggaggtcgagcctataaccacgcattgagcgagctgccggagacactagaaactctgctccttctgaccttattggctacagtcaccggcgggattttcctgtttctcatgtcgggaaaaggcatcggtaagatgactctggggatgtgctgcataatcacggcctctattcttctgtggtacgcacagatccagccccactggattgccgcttccatcatactcgagttctttttgattgttctgttaatcccagaacctgagaaacaaagaaccccccaggacaatcagctaacatatgtggtaatcgcgattctgactgtggtcgccgcaaccatggctaacgaaatgggcttcctcgagaagacaaaaaaggattttggacttggcagcatcaccactcagcaaccagagtcaaatatactggacattgatttgcgccctgccagtgcctggacactgtacgcagtggctacgaccttcatcactcccatgctcaggcattctattgaaaactccagcgttaatgtgtcactgacagccatcgcgaaccaggctaccgtccttatggggctcggaaagggttggccgctgagtaaaatggacataggcgtaccattgctggccatcgggtgttacagccaggtgaatcctattaccttaatcgcagccctactgctccttgttgctcactatgcaattatcggacccggcctgcaggccaaggcgacacgggaggctcaaaaacgtgccgcagccggtattatgaagaacccaactgtggacgggatgacggtcatcgatttggaccccataccttacgatccgaaatttgaaaagcagctgggccaggtgatgctcctggtcctttgcgtgacccaggttttaatgatgagaacaacttgggctctgtgtgaggccctcaccttggcaacaggacccatttccaccctgtgggaaggcaatccagggaggttctggaacactacgatcgctgtgtctatggccaacatctttcgcggaagctatctagcgggcgccggtctgctcttctccattatgaagaatacagcaaacacccggcgagggactggaaataccggcgagacacttggtgagaaatggaagaacagactgaatgctttgggcaaatcagaatttcaaatatacaagaaatctgggatccaggaggtagacaggactctggccaaggaaggaattaaacgcggcgagaccgatcatcacgcagtgagtcgggggtcggctaagctcagatggttcgtcgagcgtaacctggttacacctgaaggaaaggtggtcgacttaggctgcggtagggggggatggagctattactgtggcggtcttaaaaatgtgaaggaggtaaaaggcctgacgaaggggggacccggccatgaagagcctatcccaatgtccacctatgggtggaacctcgtgcggctacagtctggagttgatgtgttctttactccccctgaaaaatgcgacacactgttgtgtgatattggcgagtcaagcccaaatcccaccgtcgaggccggtcgcactctgcgagtgctcaaccttgtcgaaaattggctgaacaataacacacaattctgcatcaaggtgttgaatccgtacatgccttccgttatagagaagatggaagccctgcagagaaaatacgggggagcgctcgtaaggaacccattaagtcggaactctacccacgagatgtattgggtgagcaatgcttcaggcaacatcgtctccagtgtgaatatgattagccgcatgctgatcaacagatttacgatgaggcacaagaaagcaacctacgaacccgacgttgatcttggctctgggacacgaaatattggaatcgagtccgagactcctaacctggacataattggtaagcggatcgaaaaaatcaagcaggagcatgaaacctcatggcactatgatcaggaccatccatacaagacatgggcctatcacggcagctacgagactaaacaaaccgggtcggcttctagtatggtgaatggagtcgtgcgtctactcacaaagccctgggacgtaattccgatggtgacccagatggccatgactgatacgacacctttcggccagcagagagtttttaaagaaaaggtcgacacccgcactcaagagcccaaagagggtaccaagaagctgatgaaaataacagcagaatggttgtggaaggagctggggaaaaagaaaacgccaaggatgtgtacccgggaagagttcactagaaaggtgcgctccaacgccgctctcggagcgatctttacagatgagaataaatggaagagcgccagggaagcagtggaggactcaggcttctgggaacttgtcgataaggagcgaaacctgcacttagaaggcaaatgcgagacctgtgtttataatatgatggggaagcgggagaaaaagctgggagaatttggtaaagctaagggctccagagccatttggtacatgtggttgggggcaaggttcctcgagtttgaagccctgggattcctaaacgaggaccattggttttctcgcgaaaatagccttagtggcgtggagggtgaggggctgcacaagctcggatacatcctgcgtgatgtatccaaaaaggaaggcggcgctatgtatgccgacgatactgcggggtgggacacacggattaccttggaggatctgaaaaacgaagagatggtgacaaatcatatggaaggagagcacaagaaactcgcagaggccatcttcaagcttacttaccagaacaaggtcgtgagagttcagaggcctaccccccgcggtacggtgatggacataatcagccgacgggaccagagaggctctgggcaagtcgtgacctatggactgaacacattcactaatatggaagctcagttaattaggcagatggagggcgaaggtgtatttaaatcaatccaacagctgaccgttaaggaggagattgccgtgaaaaactggttgatccgcgtcgggagagaacggctcagtaggatggcaatttccggagatgactgcgtggtgaagccactggatgaccgtttcgctagcgccctaacagctcttaatgatatgggcaaagtccgaaaggacatacagcagtgggagccctctcgcggctggaacgattggactcaagttcctttttgctcgcatcacttccacgaactgatcatgaaggacgggagagtgctcgtagtgccatgtcggaatcaggatgagctgattggaagggcccgcatctcacagggtgcaggctggagcttgagagaaaccgcgtgcttagggaaatcctacgcccagatgtggagtctgatgtattttcatcggagggacctccgacttgctgccaacgcaatctgttctgctgtcccgagccactgggtgcccacgtcccgtacaacctggtcaattcatgccactcacgagtggatgacaaccgaggatatgctgactgtttggaatagagtgtggatacaagaaaacccttggatggaggacaagaccccagtcgaaagttgggaggaaatcccctacctaggaaaacgcgaggatcagtggtgcggctctctgattggtctcacaagccgggcaacgtgggccaagaatatccagaccgcgattaaccaggtgaggtccttgatcgggaatgaggaatatactgactacatgccttcaatgaaaagattccgccgggaggaagaggaagctggagtactgtggtga

SEQ ID NO: 15028 - RNA, 9876 nt, synthetic construct
  misc_feature 1..9876: note = derived and/or modified CDS sequence (opt3) from DENV-2__GQ398265__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacaccctgcgacgctgcggaagtactgcgtggaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaaggtcgttcagcctgaaaacctagagtatacaatcgtgattaccccacactccggagaagagaatgccgtaggtaacgatactggcaaacatgggaaggagataaaagtgacgccgcagtcaagtatcacagaagcagagctcaccggatacggcactgtcaccatggaatgtagccccaggacaggtctggacttcaatgagatggtgcttctgcagatggaaaacaaggcttggttggttcaccggcaatggtttctcgatctgcctttaccatggctgcccggggccgacacccagggctctaactggattcagaaagagactctcgtgacattcaagaatcctcacgcgaagaaacaggatgtcgtggtacttggatcccaagagggcgccatgcatacggcactgaccggggctactgaaatccagatgtcaagcggaaacttgctatttacaggtcacctgaagtgccgtctccgcatggacaaactgcagcttaagggcatgagttattctatgtgtaccgggaaattcaaggttgtgaaggagatagccgaaacacaacatggaactattgtcatcagagtgcagtacgagggcgacggttccccatgcaaaatccccttcgagattatggatctggaaaagaggcacgtcttggggcggctcatcaccgtgaatccgattgttacggagaaagacagccctgtgaacatagaagctgagcccccatttggcgattcgtacatcattatcggagtagaacctggccagctgaagttatcttggttcaaaaaggggtcctcaatcggacagatgtttgagaccacaatgcgaggtgccaagcgcatggcaattctgggcgacactgcctgggatttcgggagtctaggaggcgtctttaccagcataggtaaagctctccatcaagtgttcggggcgatctatggcgcagccttttccggagtttcttggacaatgaagattctgatcggcgtggtcattacttggatcgggatgaatagcagatcaaccagtctttccgtgagcttggtactggtgggagttgtcacgctctacctgggcgtgatggtgcaggctgactctggttgtgtcgtttcatggaaaaacaaggagcttaaatgcgggagtggaatattcatcacagataatgtgcacacctggactgaacagtataagtttcagcccgagagcccatccaagctggcctctgcaattcaaaaagcccacgaagagggcatctgtggtattaggtcggtgacacggttggaaaacctcatgtggaagcagatcacccccgagctgaatcatatattaactgagaacgaagtaaaactgaccattatgacaggcgacatcaaggggattatgcaggctggaaaacgcagcctaagacctcagccaacggagctcaagtactcctggaaagcctggggcaaggcaaagatgctgtcaaccgaacttcacaatcatactttcttgatcgatgggccggagacagcggaatgccccaacaccaatagggcttggaacagtctggaggtcgaggactatggatttggcgtgttcacaactaatatatggctcaaactgaaggaacgtcaagatgttttttgtgactctaaattaatgagcgccgcaatcaaggacaaccgggccgtgcacgctgatatgggttactggattgagtccgccctgaacgacacctggaaaatcgaaaaggcatcattcattgaggtcaagagctgccactggcctaaatctcatacgctttggtccaatggggtgttggagagtgaaatgatcataccaaagaacttcgctggacccgttagccagcacaattatcgacctggctaccatacacagaccgccggtccatggcacctcggcagactggagatggattttgacttctgtgaagggactaccgtggtagtcacagaggattgcggaaacaggggcccctctctacgcactaccacagcgtccgggaaactgattacggaatggtgctgtcggtcatgcaccctcccgcctctgagatacaggggagaggacggctgttggtatggtatggagatccgcccacttaaggaaaaagaggaaaatttggtgaacagtctggtgactgccgggcatggacagatcgataattttagcttaggcgtcctcggtatggctctgttccttgaggaaatgctgcgaacacgggttggcaccaagcacgcaattttgctcgtggccgtatcgtttgtgactctgatcacagggaacatgtccttccgtgacctaggaagagtcatggtgatggttggcgctaccatgacggatgacattgggatgggagtgacttacctggccctcctggcagcgtttaaggtcaggcccaccttcgccgctggccttttgctgcgcaaattaacatctaaggagctcatgatgaccactataggtatcgtgctgcttagccaatcaacaattcctgagagtatcctggaactaaccgatgccctcgcactggggatgatggttttgaaaattgtgcggaatatggagaagtatcagctggctgtcacaatcatggccatattatgcgtacccaacgcagtgatcctccagaatgcctggaaagtttcctgtactaccctggctgtggtctctgtgagcccacttctgttgacgtcctcacaacagaaggcggactggattcctctcgccctgacaatcaagggactaaaccccaccgcaatttttctgactacccttagcagaacaaataaaaagaggagttggccactcaacgaagctatcatggccgtaggcatggtgtctatactggcctccagcttgctgaaaaatgatattccgatgactggccctttagtcgctgggggactcctgaccgtttgctacgtgcttacgggtcgatcggcagacctggagttggaacgcgccgcggacgtgcggtgggaggagcaggctgaaatctcaggctctagtcccatcctctccattacaataagcgaggatgggtctatgagcatcaagaacgaagaggaggaacagaccctgactattctaatcagaacaggactgcttgtcatttccggcctcttcccagtgtcaatccccataaccgccgcagcctggtatctgtgggaggttaaaaagcaaagggctggtgtattgtgggacgtgcctagtccaccccctgtcgggaaagcagaattagaggatggagcctaccgtatcaagcagaagggcattctgggctatagccagatcggggcgggagtgtacaaagaaggtacttttcacacaatgtggcatgttacccgcggcgctgtgctcatgcacaaggggaaacggattgagccgtcttgggccgacgtcaagaaagatctgatctcctacggaggcggttggaagcttgagggggaatggaaggagggagaagaggtgcaggtactggcattggaaccaggcaaaaaccccagagccgtccaaacgaagcctggcctattcaaaactaataccgggacaataggagctgtgtcactggactttagtccaggtaccagcggctcccccattgttgataagaaagggaaggtggtcggactctatggcaacggtgtggttacaaggtctgggacttacgtgtcggccatcgcacagaccgagaagagcatcgaggacaatcctgaaattgaggatgacatcttccgaaaaaagcggctgacgataatggatcttcatccgggagctggcaaaacaaagcgctatttacccgccattgtcagagaagcgatcaaaaggggcctgcggactctcattttggccccaacccgagtggtagcagctgagatggaagaggccctgagagggctccctatccgctaccagacacccgctataagggcagagcacaccggacgtgaaattgtggacctgatgtgtcatgccactttcaccatgcggcttctgtcaccaatcagagttcctaactataatttgatcattatggatgaggcccactttacagaccccgcttccatcgcggcaaggggttacattagtacgcgcgtcgaaatgggcgaggccgctgggatattcatgactgccaccccaccgggatctcgagacccttttccccagagcaacgcaccaatcatggatgaggaaagagagattcccgaacggtcctggaattcaggccacgagtgggtgacagacttcaagggtaagaccgtgtggtttgtcccttctatcaaagccgggaacgatatcgctgcgtgcctaaggaagaatggaaaaaaggtaattcaactgagccgcaaaactttcgacagtgaatatataaagacacgtaccaacgattgggactttgtggttacgactgatatctccgagatgggcgccaatttcaaggcagagagagtgattgacccacggaggtgtatgaaacccgtcatcctcacagatggcgaagagcgcgtgattttagctgggcctatgccggttacccatagctctgccgcacagcgaagaggacgggtgggtaggaacccaaagaatgaaaacgaccagtacatctacatgggcgagcccctggaaaatgatgaggactgcgcccactggaaagaggctaagatgcttctggacaacataaacacccctgaagggatcattccctcaatgtttgagccagaacgcgagaaagtcgatgccatcgacggagaatatagactcaggggcgaggcgcggaagactttcgtggatttgatgcgtcgcggtgacctgcctgtatggctcgcataccgagtggccgctgaggggattaattatgccgatagaaggtggtgttttgacggcgttaaaaacaatcaaatcctggaagagaacgtcgaagtggagatatggacaaaggagggagaacggaagaaacttaagccccgctggctagatgctagaatttactccgacccactggcattgaaagagttcaaggaattcgccgctggcaggaaaagtttaaccctgaatctcatcacagagatggggcggctgcctacttttatgacgcagaaggccaagaacgcacttgataatctggcggtgctccataccgccgaagctggaggtcgagcctataaccacgcattgagcgagctgccggagacactagaaactctgctccttctgaccttattggctacagtcaccggcgggattttcctgtttctcatgtcgggaaaaggcatcggtaagatgactctggggatgtgctgcataatcacggcctctattcttctgtggtacgcacagatccagccccactggattgccgcttccatcatactcgagttctttttgattgttctgttaatcccagaacctgagaaacaaagaaccccccaggacaatcagctaacatatgtggtaatcgcgattctgactgtggtcgccgcaaccatggctaacgaaatgggcttcctcgagaagacaaaaaaggattttggacttggcagcatcaccactcagcaaccagagtcaaatatactggacattgatttgcgccctgccagtgcctggacactgtacgcagtggctacgaccttcatcactcccatgctcaggcattctattgaaaactccagcgttaatgtgtcactgacagccatcgcgaaccaggctaccgtccttatggggctcggaaagggttggccgctgagtaaaatggacataggcgtaccattgctggccatcgggtgttacagccaggtgaatcctattaccttaacagcagccctactgctccttgttgctcactatgcaatcattggacccggcctgcaggccaaggcgactcgggaggctcaaaaacgtgccgcagccggtatcatgaagaacccaacggtggacgggatgaccgtcattgatttggaccccatcccttacgatccgaaatttgaaaagcagctgggccaggtgatgctcctggtcctttgcgtgacacaggttttaatgatgagaactacctgggctctgtgtgaggccctcacattggcaaccggacccatatccactctgtgggaaggcaatccagggaggttctggaacacgacaattgctgtgtctatggccaacatctttcgcggaagctatctagcgggcgccggtctgctcttctccatcatgaagaataccgcaaacactcggcgagggaccggaaatacaggcgagactcttggtgagaaatggaagaacagactgaatgctttgggcaaatcagaatttcaaatttacaagaaatctgggatacaggaggtagacaggaccctggccaaggaaggaatcaaacgcggcgagacagatcatcacgcagtgagtcgggggtcggctaagctcagatggttcgtcgagcgtaacctggttacgcctgaaggaaaggtggtcgacttaggctgcggtagggggggatggagctattactgtggcggtcttaaaaatgtgaaggaggtaaaaggcctgaccaaggggggacccggccatgaagagcctattccaatgtccacttatgggtggaacctcgtgcggctacagtctggagttgatgtgttctttacaccccctgaaaaatgcgacaccctgttgtgtgatatcggcgagtcaagcccaaatcccactgtcgaggccggtcgcacactgcgagtgctcaaccttgtcgaaaattggctgaacaataacacccaattctgcattaaggtgttgaatccgtacatgccttccgttatcgagaagatggaagccctgcagagaaaatacgggggagcgctcgtaaggaacccattaagtcggaactctacgcacgagatgtattgggtgagcaatgcttcaggcaacatagtctccagtgtgaatatgatcagccgcatgctgattaacagatttaccatgaggcacaagaaagcaacatacgaacccgacgttgatcttggctctgggactcgaaatatcggaattgagtccgagacccctaacctggacatcataggtaagcggattgaaaaaatcaagcaggagcatgaaacatcatggcactatgatcaggaccatccatacaagacttgggcctatcacggcagctacgagaccaaacaaacagggtcggcttctagtatggtgaatggagtcgtgcgtctactcaccaagccctgggacgtaatcccgatggtgactcagatggccatgacggatacaacccctttcggccagcagagagtttttaaagaaaaggtcgacactcgcacccaagagcccaaagagggtacaaagaagctgatgaaaattacggcagaatggttgtggaaggagctggggaaaaagaaaaccccaaggatgtgtactcgggaagagttcacaagaaaggtgcgctccaacgccgctctcggagcgatatttaccgatgagaataaatggaagagcgccagggaagcagtggaggactcaggcttctgggaacttgtcgataaggagcgaaacctgcacttagaaggcaaatgcgagacttgtgtttataatatgatggggaagcgggagaaaaagctgggagaatttggtaaagctaagggctccagagccatctggtacatgtggttgggggcaaggttcctcgagtttgaagccctgggattcctaaacgaggaccattggttttctcgcgaaaatagccttagtggcgtggagggtgaggggctgcacaagctcggatacattctgcgtgatgtatccaaaaaggaaggcggcgctatgtatgccgacgatacagcggggtgggacacccggatcacattggaggatctgaaaaacgaagagatggtgactaatcatatggaaggagagcacaagaaactcgcagaggccattttcaagcttacctaccagaacaaggtcgtgagagttcagaggcctacgccccgcggtaccgtgatggacatcataagccgacgggaccagagaggctctgggcaagtcgtgacatatggactgaacactttcaccaatatggaagctcagttaatcaggcagatggagggcgaaggtgtatttaaatcaattcaacagctgacagttaaggaggagatcgccgtgaaaaactggttgattcgcgtcgggagagaacggctcagtaggatggcaatctccggagatgactgcgtggtgaagccactggatgaccgtttcgctagcgccctaactgctcttaatgatatgggcaaagtccgaaaggacattcagcagtgggagccctctcgcggctggaacgattggacccaagttcctttttgctcgcatcacttccacgaactgataatgaaggacgggagagtgctcgtagtgccatgtcggaatcaggatgagctgatcggaagggcccgcatttcacagggtgcaggctggagcttgagagaaacggcgtgcttagggaaatcctacgcccagatgtggagtctgatgtattttcatcggagggacctccgacttgctgccaacgcaatctgttctgctgtcccgagccactgggtgcccacatcccgtaccacttggtcaatccatgccacacacgagtggatgaccactgaggatatgctgaccgtttggaatagagtgtggattcaagaaaacccttggatggaggacaagacaccagtcgaaagttgggaggaaataccctacctaggaaaacgcgaggatcagtggtgcggctctctgatcggtctcacgagccgggcaacctgggccaagaatattcagactgcgatcaaccaggtgaggtccttgattgggaatgaggaatatacagactacatgccttcaatgaaaagattccgccgggaggaagaggaagctggagtactgtggtga

SEQ ID NO: 15029 - RNA, 9876 nt, synthetic construct
  misc_feature 1..9876: note = derived and/or modified CDS sequence (opt3) from DENV-2__KX702403__SS-prME
  source 1..9876: mol_type = other RNA
accgccggcgtgatcgtcatgctgattccaacagctatggcgttccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactgctccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcctgattctgctcacagcagtggccccatccatgaccatgagatgcatcgggatatctaacagggatttcgtcgaaggagtgtcgggtggctcatgggtagacattgttttagagcacgggagctgtgtgactacaatggctaagaataagcccaccctggattttgaacttatcaaaacggaggccaagcagcctgcgaccttgcggaaatattgcattgaagcaaagctgacaaacactaccacagagagtcgctgtccaactcaaggagagccctccctaaatgaagaacaggacaaacgattcatctgcaagcattctatggtcgatagaggctggggtaacgggtgtggactctttggcaagggcgggatcgtgacctgcgccatgttcacatgcaaaaagaatatggaaggaaaaattgtgcagcctgagaacctggaatacaccatagtcatcactccacacagcggtgaggagcatgctgttggcaatgacacggggaagcacggaaaagaaattaagatcacaccgcagtcctcaaccactgaggccgaacttaccggctatggtacagtgaccatggagtgtagtcccaggactgggctggattttaacgaaatggtattgctccaaatggaggacaaagcatggctggtgcaccggcagtggttcttagatctgcctctcccatggcttcccggcgctgacacacagggaagcaattggatacagaaggagacgctggtcacctttaagaaccctcatgccaaaaagcaagacgtggttgtgttgggctctcaggaaggggcgatgcacactgccctaacaggagcaaccgagattcagatgtcctcaggtaatctactcttcacaggccatctgaaatgccgtcttcgcatggataagctgcaattgaaagggatgagctacagtatgtgtactggaaagtttaagatcgtcaaagaaatcgctgagacccagcacggcacgattgtgatcagagtacagtatgagggtgacgggtctccatgcaagattcccttcgaaataaccgatctcgagaaaaggcatgttctgggccggttaatcacagtgaacccgattgtcactgaaaaggactcccctgtgaacatcgaggccgaacccccattcggagatagctacatcattgtcggcgtggagcctgggcagctgaaactaaattggtttaagaagggatcgtctataggtcaaatgttcgagaccacaatgcgaggcgctaaacgcatggccatcctcggggacactgcatgggattttggatccctgggcggtgttttcacctcaattgggaaggcccttcaccaggtgtttggcgctatctacggagcggcattcagtggcgtaagctggacgatgaaaattttgatcggggtcataatcacatggattggaatgaactccagatctaccagcctgtcagtgagtctcgttctggtgggcgtcgtgactctttatctgggtgccatggtacaggctgactccgggtgtatcgtgagctggaagaataaagaattgaagtgcggatctggcatttttatcacagataacgttcacacctggactgagcagtacaagttccaacccgaatcaccaagtaaactcgccagcgcaatacagaaggcccatgaggaaggtatttgtggcatcaggtccgtcacccggctggagaatttaatgtggaaacagattacacccgagctgaaccacatcctatctgaaaatgaggtgaagctcacgataatgaccggggacatcaaaggaattatgcaggctggcaagcgctcgctgagacctcaaccaactgaacttaaatatagctggaagacatgggggaaggccaaaatgttgtccaccgagtcacataaccagacatttctgatcgatggaccggaaactgcagagtgccccaataccaacagggcgtggaatagtctcgaggtggaagactacggcttcggtgtctttacgacaaacatttggctgaagttacgtgagaaacaggacgttttctgtgattctaagctgatgagcgctgccatcaaagacaatcgggcagtgcacgccgatatggggtattggatagaatccgctcttaacgacacctggaagatggagaaggcctcatttattgaggtgaaaagctgccactggcctaagtctcatactttgtggtccaatggagtactcgaaagtgagatgatcatccccaagaacttcgcaggccccgtcagccagcacaactaccgacctggttatcatacccaaacagctggcccatggcacctggggaagctagaaatggatttcgacttttgtgagggaactaccgtggttgtgacagaagattgcgagaaaagaggcccctctctgaggacgaccactgcctccgggaagctcattacagagtggtgctgtcgctcatgcaccctgccgcctcttcggtacagaggagaagacggctgttggtacggtatggagatcaggccattgaaggaaaaagaggaaaatctggtcaacagtttagtgactgcggggcatggacagattgataatttcagcctcggcgttctgggtatggccctttttctggaggagatgttgcgcacacgagtgggcaccaagcacgctatactcctggtagcactatcgttcgtcacgctgatcactgggaacatgtcctttcgggacctcggacgtgtgatggtgatggtcggcgccaccatgacagatgacattgggatgggagttacctatctggctcttttggccgcattcaaagtgagacccacttttgcggccggcctgttactcaggaagctgacatctaaagaacttatgatggctaccatcggtattgccctgctaagccagtcaacactccctgagactatcctggaattgaccgatgcactggctttagggatgatggccctcaagatagtacgcaatatggagaagtaccaactggcagtgacgatcatggccattagttgcgtccccaacgctgtgatccttcagaatgcgtggaaagtttcctgtacaattctggccgcagtgtctgtcagcccattgctcctgacctcctcacagcagaaggctgactggatccctctagccctgactataaaaggacttaaccccaccgccattttcctcacaactctgagccggaccagtaagaaaagatcttggccattgaatgaagctatcatggcagtgggcatggtttccatcctggccagctcgttactcaagaacgacattccgatgacgggccctctggtggcagggggacttctgacagtctgctatgtattgaccggtaggtcagctgatctcgagctggagcgagccgcagacgtgaaatgggaagatcaagccgagatatctggcagttcccccatcctaagcattactatctctgaagacgggagcatgtccattaagaatgaggaggaagaacagacactgaccatccttatacgcactggactcctggttatctcaggcgtgtttccagtcagtattcccatcacagctgcagcctggtacttgtgggaagtgaagaaacagcgggcgggtgtattatgggatgtgcctagcccaccccctgtcgggaaggctgagctggaagacggagcctatagaattaaacagaggggcatcctcggctactctcaaataggggcaggagtttataaggagggtaccttccacacgatgtggcatgtgactcgtggcgccgtgctgatgcaccgcgggaaacggattgagccgtcctgggctgatgtcaagaaggaccttatctcatacggaggcggttggaaactggaaggggagtggaaggaaggagaggaagtgcaggttttggccctagagccaggcaaaaaccccagagcagtacagaccaagcctggcatctttaaaacaaataccgggacaattggagctgtgagtctggatttcagcccaggtacttccggctctcccatcgtcgacaggaaggggaaggtggttggactctacggcaacggtgtggtcacccgatcgggggcctatgtgagcgcgatagcccagacggagaaatcaattgaagataatcctgagatcgaagacgatatttttcggaagaaacgcctgacaatcatggaccttcatccgggagcaggcaagactaaaagatacttacccgctatagtaagggaggccattaagcggggcctgcgaaccctcatcttggctccaacaagagtcgtggcagccgaaatggaggaggccctgcgcgggctccctatcaggtatcaaacccccgctattcgtgcggaacacactggacgggagatcgttgacctgatgtgtcatgcaaccttcacaatgagacttctgtccccagtgagggtccctaactacaacttgattataatggatgaagcccacttcacggaccccgctagtatcgccgcacgcggttatatttctactcgagtggagatgggcgaggccgctgggatctttatgaccgcgacaccaccgggaagcagagatcctttcccccagtccaatgccccaatcatggacgaggaacgggaaattcccgagaggtcatggaactctggccacgaatgggttaccgattttaagggtaaaactgtgtggttcgtccctagcataaaggcagggaatgacatcgctgcctgcctacgcaaaaacggaaagaaagtgattcagctgagtcgtaagacatttgattccgagtacgtaaagaccagagcaaatgactgggatttcgtggttacgactgacatcagcgagatgggcgccaactttaaagctgaacgggtcattgatccaaggcgctgtatgaagcccgtgatcctcacagacggcgaggaacgagtgatattagccgggcctatgccggtcacccattcttcagcggcacaaagacggggaaggatcggtcgcaatcccaagaacgagaatgaccagtatatttacatgggcgaacccctggagaacgatgaggactgcgcccactggaaggaagctaaaatgcttctggataatatcaacacccctgaggggattatcccctccatgttcgaaccagagagagaaaaggtagacgccatagatggagagtacaggctccggggcgaggctcgtaaaacttttgtggacttgatgcgccgaggtgatctgcctgtttggctcgcatataaggtggccgctgaagggattaattacgccgacagaaagtggtgtttcgatggcatcaaaaacaatcagattctggaggaaaacgtcgaggtggagatctggacaaaggaaggagagaggaagaaacttaaaccccggtggctagacgcacgcatatatagtgatccactggcgttgaaagaatttaaggagttcgccgctggcagaaagagcttaaccctgaacctcatcacagaaatggggaggctgcctactttcatgacgcagaaggcccggaatgcacttgacaacctggctgttctccataccgccgaggtgggaggtaaagcatacacacacgccttgtcggagctgccggaaactctagagaccctgctccttctgacattattggctgcggtcaccggcgggatttttctgttcctcatgtctggaaagggcatcggtaaaatgactctggggatgtgctgcattatcacggcctccatacttctgtggtatgcacaaattcagccccactggatcgctgccagcatcattctcgaatttttcttgatcgtgctgttaataccagagcctgaaaagcagcgaacaccacaggataatcaactaacatacgtagtgattgccatcctgactgttgtcgcagctaccatggccaacgagatgggctttctcgagaagaccaagaaagaccttggattcggctcaattaccactcaggaaagtgagtctaatatcctggacatagatttgagaccagcgtccgcttggacactgtatgccgtggcaacgacctttgtgactcctatgctccgccatagcatcgaaaactcaagtgtcaatgttagcctgacagccattgctaaccaggcaaccgtgcttatggggctcggaaaaggttggcccctgtccaaaatggacatcggcgtaccgttgctggccattgggtgttactctcaggtgaatccaatcaccttaacagcggctctactgctccttgtcgcccactacgcaattatcggacctggcctgcaagccaaagctactagggaggcccagaagcgggcagctgccggtataatgaagaaccccacggtggatgggattaccgttatcgacttggaaccaatcccccatgatcctaaattcgagaagcagctgggccaggtgatgctcctgattctttgcgtcacacaagtattaatgatgcgtactacctgggcgctgtgtgaggccctcacattggcaaccggaccgataagcactctgtgggaaggcaatcccgggagattttggaacacgacaatcgctgtgtccatggccaatattttcaggggatcatatctagcaggcgctggtctgctcttttctatcatgaaaaacaccactaatacccgccgggggacaggaaacgttggcgagactcttggtgaaaagtggaaaagtcgactgaatgccttgggcaagtcggagttccagatttacaaaaagagcgggatccaggaggtggacagaaccctggccaaggaaggaataaaaaggggcgagacagatcaccatgcggtctcccgcgggtctgctaagctccggtggtttgtggaaagaaacatggtcacgccagagggaaaagtggttgacctgggctgcggtcgtgggggatggtcatattactgtggcggtttaaagaacgtgagggaagtaaaaggccttaccaaagggggacctggccacgaggagcccatccctatgagcacttatgggtggaatctggtgcggctccaatccggagtcgatgttttcttcacaccacccgaaaagtgcgacaccctactgtgtgatattggcgagagttctcctaacccaactatcgaagcaggtcgcacattgcgagtgctgaatctcgtcgagaactggcttaataacaatacccagttttgcattaaagtgctgaacccctacatgccgagcgtaatcgaaaagatggagacgttgcagagaaaatatgggggagccctggtgaggaatcctctctcacggaactccacccacgagatgtactgggttagtaatgctacaggcaacatagtgagctctgtcaatatgatttcccgcatgttaatcaacagattcactatgaagcataaaaaggccacctacgaaccagacgtggatctgggctcagggacaaggaatatcggaattgagagcgaaactcccaaccttgacataatcggtaagcgaattgagaaaatcaagcaggaacacgagacctcgtggcattatgaccaagatcacccttacaaaacatgggcatatcacggctcttacgagaccaagcagactgggagtgcctccagcatggtcaacggagtggttcggctgctaacgaaaccatgggacgtagtgcccatggtcacacagatggctatgaccgatactaccccgtttggccagcaacgtgtgttcaaggaaaaggttgacacaagaacgcaggagcctaaagaaggtaccaagaaactcatgaagattactgcggagtggctgtggaaagagttggggaaggagaaaacaccccgcatgtgtaccagggaggaatttactcggaaggtgagatcaaatgccgcactgggagctgtcttcacagatgagaacaagtggaaatccgcccgcgaagcagtggaggacggcaggttttgggagctcgtagatcgagaacggaatcttcatctggagggcaagtgcgaaacctgtgtgtataacatgatggggaaaagagagaagaaattaggagagttcggtaaggccaagggctctagggctatctggtacatgtggctgggggcccgctttttggagttcgaggcgctcggatttctgaatgaagaccactggttcagccgtggcaacagtctatccggtgttgagggggaaggacttcatcggctgggctatatactcagagaggtcggcaaaaaggaagggggagcaatgtacgccgatgacacagctggttgggatactaggatcaccctggaggacttgaaaaatgaggaaatggtgacgaaccacatgaagggcgagcataaaaagctggccgaagcaatttttaagctcacctaccagaataaagtggtccgcgttcagcgaccaacacctcgggggactgtgatggacatcattagcagaaaggatcaaaggggatctggccaggtaggtacctatgggcttaacacattcactaatatggaggctcagctgatccgccaaatggagggagaaggcattttcaaatcaatacagcacttaaccgccacggaggaaacagctgtgcagaactggctggccagagtcggccgggagaggttgagtcgtatggcaatctccggggacgattgcgtggttaagcccattgacgatcgatttgcgagcgccctcaccgctctgaatgacatgggaaaagtgcgcaaggatatccagcaatgggaaccatctagaggttggaacgactggactcaggtccccttctgctcgcaccattttcacgagctagtgatgaaggatggccgggtacttgttgtgccttgtaggaatcaggacgagctgatcgggcgcgccagaatttcacagggagcaggctggagcctcaaagaaacagcttgcctgggtaagtcctacgcccaaatgtggaccttgatgtatttccatcggagggatttacgactggcagccaacgcgatatgtagtgctgtcccatctcactgggtgccgactagccgtaccacatggtccatccacgccaaacatgagtggatgacgaccgaagacatgctcgcagtgtggaacagagtctggattcaggagaatccctggatggaagataagactcctgttgagtcatgggaggaagtgccataccttgggaaacgcgaggaccagtggtgcggaagtctgatcggcctaacatctcgggccacctgggctaagaacattcagactgccatcaatcaagtaaggagcctgataggcaacgaagggtatacagactacatgccctccatgaagagatttcgccgggaggaagaggaggcaggagtgctctggtga

SEQ ID NO: 15030 - RNA, 9876 nt, synthetic construct
  misc_feature 1..9876: note = derived and/or modified CDS sequence (opt3) from DENV-2__KX702404__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaaccactgaggccgaactgaccggctatggtacagtaaccatggagtgtagtcccaggactgggcttgatttcaacgaaatggtgctgttgcaaatggaggacaaagcatggctcgtccaccggcagtggtttctggatttacctctgccatggctccccggcgctgacacacagggaagcaattggatccagaaggagacgcttgtgaccttcaagaaccctcatgccaaaaagcaagacgttgtggtcctgggctctcaggaaggggcgatgcacactgccttgacaggagcaaccgagatacagatgtcctcaggtaatctactgtttacaggccatctcaaatgccgtctgcgcatggataagcttcaactgaaagggatgagctacagtatgtgtactggaaagttcaaggtggtaaaagaaattgctgagacccagcacggcacgatcgttatcagagtgcagtatgagggtgacgggtctccatgcaagattcccttcgaaatcaccgatttggagaaaaggcatgtcctcggccggctgattacagtgaacccgatagtcactgaaaaggactcccctgtgaacatcgaggccgaacccccatttggagatagctacattatcgttggcgtggagcctgggcagttaaaactgaattggttcaagaagggatcgtctatcggtcaaatgtttgagaccacaatgcgaggcgctaaacgcatggccattctaggggacactgcatgggatttcggatccctcggcggtgtatttacctcaatagggaaggccctgcaccaggtcttcggcgctatctacggagcggcatttagtggcgtgagctggacgatgaaaattcttatcggggttattatcacatggataggaatgaactccagatctaccagcttgtcagtgagtctggtcctcgtgggcgtagtgactctgtatcttggtgccatggttcaggctgactccgggtgtgtcgtgagctggaagaataaagaactgaagtgcggatctggcatcttcattacagataacgtgcacacctggactgagcagtacaagtttcaacccgaatcaccaagtaaattggccagcgcaatccagaaggcccatgaggaaggtatttgtggcatcaggtccgtcacccggctcgagaatctgatgtggaaacagataacacccgagttaaaccacattctgtctgaaaatgagatcaagctaacgattatgaccggggacatcaaaggaataatgcaggctggcaagcgctcgctcagacctcaaccaactgaactgaaatatagctggaagacatgggggaaggccaaaatgctttccaccgagtcacataaccagacattcttgatcgatggaccggaaactgcagagtgccccaataccaacagggcgtggaatagtctggaggttgaagactacggctttggtgtgttcacgacaaacatttggctcaagctgcgtgagaaacaggacgtgttttgtgattctaagttaatgagcgctgccatcaaagacaatcgggcagtacacgccgatatggggtattggattgaatccgctctgaacgacacctggaagatggagaaggcctcattcatcgaggtcaaaagctgccactggcctaagtctcatactctttggtccaatggagtgttggaaagtgagatgataattccaaaaaacttcgcaggccccgttagccagcacaactaccgacctggttatcatacccaaacagctggcccatggcacctcgggaagctggaaatggattttgacttctgtgagggaactaccgtggtcgtgacagaagattgcggcaatagagggccctctctaaggacgaccactgcctccggaaaactgatcacagagtggtgctgtcgctcatgcaccctcccgcctctgcggtacagaggcgaggacggttgttggtacgggatggaaatcaggccacttaaggagaaggaagagaacttggttaatagtctggtgactgcgggacatggccagattgataactttagcttaggtgtactcggcatggccctgttccttgaagagatgctgcgcacacgagtcgggaccaaacacgctatcttgctcgtggcactgtcgtttgtgacgctaattactggaaatatgtccttccgggacctgggccgtgtcatggttatggtgggggccaccatgacagatgacataggaatgggcgtaacctatctcgctctgcttgccgcatttaaggtgagacccactttcgcggccggtttgctgttaaggaaactcacatctaaggagctgatgatggctaccatcgggattgcccttctgagccagtcaacactacctgaaactatcctcgagctgaccgatgcattggctctgggaatgatggccttaaaaattgtccgcaacatggaaaagtaccaactcgcagtgacgatcatggccataagttgcgttcccaatgctgtgatcctgcagaacgcgtggaaggtctcctgtacaattcttgccgcagtgtctgttagcccactgttgctcacctcctcacagcagaaagctgactggatccctctggccctaactattaagggcctgaatcccaccgccatctttcttacaactctcagccggaccagtaaaaagagatcttggccactgaacgaggctataatggcagtgggcatggtctccattttggccagctcgctgttaaaaaatgacatcccgatgacggggcctctcgtagcgggaggtctgcttacagtgtgctatgttctgaccggcaggtcagctgatttggaactcgagcgagccgcagacgtgaagtgggaggatcaagccgaaatctctgggagttcccccattctgagcataactatctctgaggacggaagcatgtccattaaaaacgaagaggaggaacagacactaaccatcctgattcgcactggccttctcgtcatctcaggtgtgttcccagtaagtatacccatcacagctgcagcctggtacctgtgggaggtgaagaagcagcgggcgggggtcttgtgggatgttcctagcccaccccctgtggaaaaagctgagttagaagacggagcctatagaattaagcagaggggcatcctgggctactctcaaattggggcaggagtgtataaagagggtacctttcacacgatgtggcatgtcactcgtggcgccgtgctcatgcaccgcgggaagcggatcgagccgtcctgggctgatgttaaaaaggacctgatatcatacggaggcggttggaagcttgaaggggagtggaaagaaggagaggaagtacaggtgctggccttggagccaggcaagaatcccagagcagtccagaccaaacctggcattttcaagacaaacaccgggacaatcggagctgtgagtctagattttagcccaggtacttccggctctcccatcgttgacaggaaagggaaggtggtcggactgtacggcaatggtgtggtaacccgatcgggggcctatgtcagcgcgattgcccagacggagaagtcaatcgaagataaccctgagatagaagacgatattttccggaaaaagcgcctcacaatcatggacctgcatccgggagcaggcaaaactaagagataccttcccgctattgtgagggaggccatcaaacggggcttacgaaccctgatactcgctccaacaagagttgtggcagccgaaatggaggaggccttgcgcgggctgcctattaggtatcaaacccccgctatccgtgcggaacacactggacgggagatcgtcgacctcatgtgtcatgcaaccttcacaatgagactgctttccccagtgagggttcctaactacaatctgattatcatggatgaagcccactttacggaccccgctagtattgccgcacgcggttatatatctactcgagtggagatgggcgaggccgctgggatcttcatgaccgcgacaccaccgggaagcagagatccttttccccagtccaacgccccaattatggacgaagagcgggaaatccccgagaggtcatggaattctggccacgaatgggtcaccgatttcaagggtaagactgtgtggtttgtacctagcatcaaagcagggaacgacattgctgcctgcttgcgcaagaatggaaaaaaggtgatacagctaagtcgtaaaacattcgattccgagtacgttaagaccagagcaaacgactgggattttgtcgtgacgactgacatcagcgagatgggcgccaatttcaaggctgaacgggtgattgatccaaggcgctgtatgaaacccgtcatcctgacagacggcgaggaacgagtaattctcgccgggcctatgccggtgacccattcttcagcggcacaaagacggggaaggatcggtcgcaacccaaagaatgagaacgaccagtatatatacatgggcgaacccttagagaatgatgaggactgcgcccactggaaagaagctaagatgctgcttgataacatcaatacccctgaggggattatcccctccatgtttgaaccagagagagaaaaagttgacgccattgatggagagtacaggctgcggggcgaggctcgtaagactttcgtggacctcatgcgccgaggtgatttgcctgtctggctggcatataaagtggccgctgaagggatcaactacgccgacagaaagtggtgttttgatggcataaagaataaccagattctcgaggaaaacgttgaggtggagatctggacaaaagaaggagagaggaagaaactgaagccccggtggcttgacgcacgcatttatagtgatccactagcgctgaaagaattcaaggagttcgccgctggcagaaagagcttgaccttaaatctgatcacagaaatggggaggctccctacttttatgacgcagaaagcccggaacgcactggacaatcttgctgtcctgcataccgccgaggtgggaggtaaggcatacacacacgccctctcggagttgccggaaactctggagaccctactgctccttacactgttagctgcggtaaccggcgggatattcttgtttctgatgtctggaaaaggcatcggtaagatgactctcgggatgtgctgcattatcacggcctccattctgctttggtatgcacaaatccagccccactggatagctgccagcattatcctggaattctttctcatcgtgttgctgattccagagcctgaaaaacagcgaaccccccaggataaccaattaacatacgttgtcatcgccatactaactgtggtggcagctaccatggccaatgagatgggcttcctggagaagacaaagaaagacctcggatttggctcaattaccactcaggaaagtgagtctaacatccttgacattgatctgagaccagcgtccgcttggacattgtatgccgtcgcaacgaccttcgttactcctatgctgcgccatagcatcgaaaattcaagtgtgaacgtaagcctcacagccatagctaatcaggcaaccgtgctgatggggcttggaaagggttggcccctctccaaaatggacatcggcgtcccgctgttggccattgggtgttactctcaggtgaacccaatcaccctgacagcggctttactactgctcgttgcccactacgcaattatcggacctggccttcaagccaaggctactagggaggcccagaaacgggcagctgccggtattatgaagaatcccacggtggatgggatcaccgtcatagacctggaaccaattccctatgatcctaagtttgagaaacagttgggccaggtaatgctgctcatcctgtgcgtgacacaagttcttatgatgcgtactacctgggcgttatgtgaggccctgacactcgcaaccggaccgatcagcactttgtgggaaggcaaccccgggagattctggaatacgacaattgctgtgtccatggccaacatatttaggggatcatacctggcaggcgctggtctactgttctctatcatgaagaataccactaacacccgccgggggacaggaaatgtcggcgagactctcggtgaaaaatggaagagtcgacttaacgccctgggcaaatcggagtttcagatttataagaaaagcgggatccaggaggtggacagaaccttggccaaggaaggaattaagaggggcgagacagatcatcacgcggtctcccgcgggtctgctaaactgcggtggttcgtggaaagaaacatggttacgccagagggaaaggtggtagacctcggctgcggtcgtgggggatggtcatactattgtggcggtctgaaaaatgtgagggaagtcaagggcttaaccaaagggggacctggccatgaggagcccatccctatgagcacttacgggtggaaccttgttcggctgcaatccggagtggatgtcttctttacaccacccgaaaagtgcgacaccctcctatgtgatataggcgagagttctcctaatccaactatcgaagcaggtcgcacactgcgagtgttgaacctggtagagaattggctcaacaataacacccagttctgcattaaggtgcttaatccctatatgccgagcgttatcgaaaaaatggagacgctgcagagaaagtacgggggagccttggtgaggaaccctctgtcacggaattccacccacgagatgtactgggtcagtaacgctacaggcaatattgtgagctctgtcaacatgatctcccgcatgctcataaatagatttactatgaaacacaagaaagccacctatgaaccagacgtggatttaggctcagggacaaggaacattggaatcgagagcgaaatccccaacctggacattgttggtaagcgaatagagaagatcaaacaggaacatgagacttcgtggcactacgaccaagatcatccttataagacctgggcataccacggctcttatgagacaaaacagaccgggagtgcctccagcatggtaaatggagtggtccggcttctgactaagccatgggacgtggttcccatggtgacgcagatggctatgacagataccactccgttcggccagcaacgtgtctttaaagaaaaggtggacaccagaacacaggagcctaaggaaggtacgaaaaagctaatgaaaattaccgcggagtggctctggaaggagctggggaaagaaaagactccccgcatgtgtacaagggaggaattcacccggaaagtaagatcaaacgccgcattgggagctgtgtttactaatgagaacaagtggaagtccgcccgcgaagcagttgaggatggcaggttctgggagctggtcgaccgagaacggaatctccaccttgagggcaaatgcgaaacatgtgtgtacaacatgatggggaagagagagaaaaagctgggagaatttggtaaagccaagggctctagggctatctggtatatgtggttaggggcccgcttcctggagtttgaggcgttgggattcctcaatgaagatcattggtttagccgtggcaacagtctgtccggtgtggagggggaaggactacaccggcttggctacattctgagagaggtcggcaagaaagaagggggagcaatgtacgccgacgataccgctggttgggacacaaggatcactctcgaggatctgaagaatgaggaaatggttaccaaccatatgaaaggcgagcacaagaaattggccgaagcaatattcaagctgacgtatcagaataaggtggtacgcgtgcagcgaccaacccctcgggggacagtcatggacatcattagcagaaaagaccaaaggggatctggccaggtgggtacttacgggctcaacaccttcacaaatatggaggctcagcttatccgccaaatggagggagaaggcatttttaagtcaatccagcatctgactgccaccgaggaaattgctgttcagaactggttagccagagtgggccgggagaggctgagtcgtatggcaatatccggggatgactgcgtcgtgaaacccatcgatgaccgattcgcgagcgccttgacggctctcaatgatatgggaaaggtacgcaaagacattcagcaatgggaaccatctagaggttggaacgattggacacaggttcccttttgctcgcaccacttccatgagctggtgatgaaggacggccgggtcctagtggtgccttgtaggaaccaggatgagcttatcgggcgcgccagaatctcacagggagcaggctggagcctgaaggaaaccgcttgcctcggtaaatcctatgcccaaatgtggactctgatgtactttcaccggagggacttgcgattagcagccaatgcgatttgtagtgctgtcccatctcattgggttccgacaagccgtaccacttggtccatacacgccaagcacgagtggatgaccacagaagatatgctggcagtgtggaacagagtatggatccaggagaatccctggatggaagacaaaacgcctgtggagtcatgggaggaagtcccatatctcgggaagcgcgaggatcagtggtgcggaagtcttattggcctgacctctcgggccacttgggctaaaaacatccagacagccattaatcaagtgaggagcctaatcggcaacgaagggtacaccgactatatgccctccatgaagagattccgccgggaggaagaggaggcaggagttctgtggtga

SEQ ID NO: 15031 - RNA, 9873 nt, synthetic construct
  misc_feature 1..9873: note = derived and/or modified CDS sequence (opt3) from DENV-2__JQ686088__SS-prME
  source 1..9873: mol_type = other RNA
accacaggcatgatcattatgctgatacccactgtgatggccttccacctcacgaccagaaacggggagcctcatatgatcgtcagcaggcaggacaagggaaaatcccttctgtttaagacaaaagatggtactaatatgtgcaccttgatggctatggacttaggcgaactgtgtgaggatacaattacctacaagtgcccattcctaaaacaaaacgaaccggaggacatcgattgttggtgcaattctacttcaacatgggttacctatgggacgtgtactaccacaggagaacaccggcgcgagaagcgaagtgtggcactcgtaccccatgtgggcatgggtctggagactcgtaccgaaacatggatgagctccgagggggcctggaagcacgcgcagagaattgaaacctggatccttaggcatcctggatttacgataatggctgccatcctggcatacactattggcacaacccacttccagcgggtcttgatctttattctcctgactgccgtggctccatctatgacaatgcgctgcatcggcatagcaaacagagacttcgttgagggggtgtcgggaggttcatgggtcgatattgtgctggagcacggcagctgtgtaaccacgatggccaaaaataagcccaccctcgactttgaattaatcaaaacagaggctaagcagcctgccactctgaggaaatattgcattgaagcgaagcttaccaacacaactaccgatagtcggtgtccaacacaaggggagccctccttgaatgaagagcaggacaagcgcttcgtttgcaaacattctatggtggatcgaggatggggcaacggttgtgggctgtttggaaagggcggcatcgtcacctgcgcaatgttcacttgcaaaaagaatatgaaagggaagatcgtgcagcctgagaacctagaatacacgattgtgataacaccacacagcggagaggaacatgccgtcggtaatgacaccggcaaacacgggaaggaggttaagatcactccgcagtcctcaattaccgaagctgagctcacaggatatggcaccgtgactatggagtgtagtcccagaacaggtctggattttaacgaaatggtacttctgcaaatggaggacaaagcctggttggtgcacaggcagtggttcctcgacctgcctttaccatggctgcccggggcagatacgcagggcagcaattggatccagaaggaaaccctcgtcacttttaaaaaccctcatgctaagaaacaagacgtggttgtgcttggatctcaggagggcgccatgcacacagcgctgaccggggccacagaaatacagatgtcctcaggaaatttgctattcactggtcatctgaagtgccggctccgtatggataagctgcaacttaaaggcatgagctacagtatgtgtaccgggaagttcaaagtcgtgaaggagattgcagagacgcagcacggaaccatcgtaatccgcgttcagtatgaaggcgacggttctccatgcaaaattccctttgagatcatggatctggaaaagagacatgtgttggggaggctcattacagtcaacccgatagtgactgagaaggaccggcctgtcaacatcgaggctgaacccccattcggcgattcctacattatcatcggagtggagcctggccagctgaaattaaattggtttaagaaagggagctcgattggacaaatgttcgaaaccacaatgcgaggtgccaagcgcatggctatactgggcgacactgcctgggattttgggtctctaggaggcgttttcacctccatcggtaaagcactccaccaggtgtttggggccatttacggcgctgcgttctcaggagtaagttggacgatgaagatcctgattggcgtcatcataacatggatcgggatgaacagcagatccacctctcttagcgtgtcattggttctggtgggaattgtcactctctatctgggcgtgatggtacaggcagacagtggttgtgtggtttcctggaagaataaagagcttaagtgcgggaacggaatctttgtcacagataatgtgcacacctggactgaacagtacaaattccaacccgagagcccatctaagctggcctcagctattcagaaagcccatgaggaaggcatctgtggtataaggagtgtgacccggttggagaacctcatgtggaagcagattacacccgaactgaatcacatcttaagcgagaacgaagtcaaactgacgattatgaccggcgacatcaaggggataatgcaggttggaaagcgctccctacaacctcagccaactgagctcagatattcttggaaaacatggggcaaggcaaaaatgctgtcgaccgagcttcataatcagacatttttgatcgacgggccggaaactgccgagtgccccaacaccaatagggcttggaacagcctggaagtggaggattacggattcggcgtgtttacgacaaatatttggctcaagctgcgtgaaaaacaggacgtattctgtgattccaagttaatgtcagccgcaatcaaggacaaccgggcggtccacgctgatatgggttattggattgagagtgccctgaatgacacctggaaaatcgagaaggcatctttcatagaagtgaaaagctgccactggcctaagtcccatactctttggtcaaacggggttttggagagcgaaatgattatcccaaaaaacctcgccggacccgtgtctcaacacaataaccgacctggctactatacccagacagctggtccatggcatctgggcaagctagagatggattttgacttctgtaaggggactaccgtcgtggttacagaggattgcggaaatagaggcccctccctgaggacgaccactgccagtgggaaactcatcacagaatggtgctgtcgcagctgcaccctgccgcctcttcggtacagaggagaggacggctgttggtacggtatggaaattaggccattgaaggagaaagaagagaacctggtgaattctttagtaactgcagggcacggacagatcgataacttttccctcggcattctgggtatggctcttttcctggaggaaatgttgcgcacacgagtcggcaccaagcatgccatactcctggtggcggtgtcatttgtcacgctaatcactgggaatatgagtttccgggacctgggacgtgttattgtgatggtaggcgccaccatgacagatgacatcgggatgggagtgacctatctcgctctgcttgcagcctttaaagtcagacccactttcgctgccggcttgctgttaaggaagctcacaagcaaggagctgatgatgaccacaattggtatcgtgcttctgtcgcaatcctctatacctgaaactatcctagagctcaccgacgcactggcgttggggatgatgattctgaaaatggttcgcaacatggaaaagtaccagttagccgtgacgatcatggctattctctgcgtccccaatgccgtgatcctgcagaacgcatggaaagttagctgtacaatacttgctgtggtctcagtaagtccactgttgctcacctcctctcagcaaaaggccgattggattcctatcgcactgactatcaaaggactaaatcccaccgccatttttctgacaactcttagccggacctccaagaaaagatcatggccactcaacgaggctataatggcggtgggcatggttagcatcctggccagttctttgctgaagaatgacattccgatgacgggccctttagtggcagggggactcctgacagtctgctatgtgcttaccggtaggtccgctgatctggagttggaacgagccgccgacgtaaagtgggaggatcaggctgaaatcagcggctcgtcacccattctctctatcactataagtgaggacgggtccatgagcatcaaaaacgaagaggaggaacagacactgaccattctaatccgcactggactgcttgtggtctctggcctcttcccagttagcgtgcccattacagcagccgcgtggtacctgtgggaggtgaagaaacagcgggctggtgtcttgtgggatgtgccttccccaccccctgccgggaaggcagaattagaggacggagcctatagaatcaaacaaaagggcatactgggctactcacagattggggctggagtttataaggagggtacctttcacacgatgtggcacgtaactaggggcgcagtgctcatgcataaagggaagcgtatcgaaccgagttgggccgatgtcaaaaaggacctgatcagctacggaggcggttggaaacttgagggggaatggaaggagggagaagaggtgcaggttctggcgttggagccaggcaagaatccccgcgctgtgcagaccaaacctggcctattcaagacaaacaccgggacaattggagccgtctctctggatttttccccaggtacttcaggcagtcccatcgtggacaaaaaggggaaagtagtcggactctacggcaacggtgtggttacccggagcggggcatatgtgtccgccatagctcaaacggaaaagtctattgaggataatcctgaaatcgaggacgacattttcagaaagaggcgactgacaatcatggatcttcacccgggagccggcaaaactaagcggtacttacccgcaatagtccgcgaagctattaaaagaggcctgaggaccctcatcttggccccaacacgggtggttgcggccgagatggaggaagcactgcgagggctccctgtgagatatcagacccccgctatccgcgccgagcatactggaagggaaattgtcgacctgatgtgtcacgctaccttcacaatgcgtcttctgtcgccaatccgggtgcctaactacaatttgattataatggatgaggcacattttacggaccccgccagcatcgccgctagaggttatatttcaactagggtagaaatgggcgaggcggcagggatcttcatgaccgccacaccaccgggatcccgcgatccttttccccagagtaacgctccaatcatggacgaggaacgagagattcccgaaagatcttggaatagcggccacgagtgggtgaccgatttcaagggtaaaactgtttggtttgtcccttccataaagacagggaacgacatcgccgcatgcctacggaagaatggaaaaagggtgattcaactgtcacgcaagaccttcgattctgagtacatcaaaacgcgtactaacgactgggattttgtggtcacaaccgacattagcgaaatgggcgccaatttcaaggctcagagagtaatcgacccacggaggtgtatgaaacccgtgatactcaccgatggcgaggaacgcgttatcttagcggggcctatgccggtgactcacagttccgccgcacagcgaggaagagtcggtcggaacccaaagaatgagaacgaccagtatatttacatgggcgaacccctggagaatgatgaggactgcgctcattggaaagaagccaagatgcttctggataacatcaatacacctgaggggattatccccagcatgtttgaaccagagagggaaaaggtggacgcaatagatggagagtaccgcctcagaggcgaggccaggaaaaccttcgttgacttgatgcggcgtggtgatctgcctgtgtggctcgcttataaggtcgccgcggaagggattaactacgcagaccgccgatggtgttttgatggcacaagaaacaatcaaatcctggaggaaaacgtggaggtagaaatttggactaaagagggagagaggaagaaacttaagccccggtggctagacgcccgcatctatgctgatccactggccttgaaggaattcaaagagttcgctgcaggcagaaagtctttaacgctgaatctcataaccgaaatggggaggctgcctacatttatgactcagaaagtgcgggacgcccttgacaacctggctgttctccacaccgccgaggcaggaggtaaggcgtacaatcatgccttgaacgagctgccggaaacactagagaccctgctccttctgactttattggctacggtcaccggcgggatcttcctgtttctcatgtcaggacgaggcattggtaaaatgacactggggatgtgctgcatcattactgcctccatccttctgtggtatgcacagatacagccccactggattgctgccagtatcatcctcgaattctttttgattgtgctgttaatcccagagcctgaaaagcaaagaaccccccaggataatcagctaacatacgtggtcatagcaattctgaccgttgtggccgctactatggcgaacgagatgggcttcctcgagaagacaaaaaaggaccttggactgggcagcatcgtaacgcagcaaccagaatcgaatattttggatatcgacctgcgccctgcctctgcatggaccctctatgctgtggccactacatttataacccccatgctgaggcactccatcgagaacagctcagtcaatgtgagtcttaccgccattgcaaaccaggctacagttctcatggggctgggaaaaggttggccgttgtctaagatggatatcggcgtgccactgttagccattgggtgttactcccaggtcaatcctatcactctaacggcggctctgttcctccttgtagcccattacgcaattatcggacccggcctgcaggccaaagctacccgggaagcacaaaagcgtgccgcggctggtataatgaagaacccaacagtggacgggattactgttatcgatttggaccccatcccttatgatccgaaatttgagaagcagctgggccaggtgatgctcctggtcctttgcgtgacccaagtcttaatgatgagaacaacctgggccctgtgtgaagcactcactttggccacgggacccgtgagcacactgtgggagggcaatccagggaggttctggaacaccactattgctgtttcaatggccaatatatttcgcggaagttacctagcaggcgctggtctgctcttcagcatcatgaaaaacaccacatccgcccggcgagggactggaaacattggcgagacccttggtgaaaagtggaaatctagactgaatgcgttgggcaagagcgagtttcagatctataaaaagtccgggattcaggaagtggacaggacactggccaaggagggaatcaaacgcggcgaaacggatcaccatgcagtatcacgggggtctgctaagctcagatggttcgtggagcgtaacctggtcacccctgagggaaaagttgtggacttaggctgcggtagggggggatggagttactattgtggcggtcttaagaatgtccgggaagtgaaaggcctgactaaggggggacccggccacgaggaacctataccaatgtcgacatacgggtggaacctcgtacgcctacagagcggagtggatgttttctttatcccccctgagcgatgcgacaccctgttgtgtgacattggcgagtcctctccatcacccactgtggaagccggtagaacactgagggtcctcaatcttgtggagaactggctgagcaataacacccaattctgcgtcaaggtgttgaatccgtatatgccttccgttatcgaaaaaatggaggcactgcagcggaagcatgggggagctctcgtacgcaacccattaagtagaaattctacgcacgaaatgtactgggtgagcaacgcctcaggcaatattgtctccagtgtgaacatgatcagcaggatgctgataaatcgatttaccatgcggcacaaaaaggccacatacgagcccgatgttgaccttggctctgggactcgtaacattggaatcgagtccgaaacccctaacctggatatcattggtaaaagaatagagaagatcaagcaggaacatgagacatcatggcactatgaccaggatcatccatacaaaacttgggcgtatcacggcagctacgaaaccaagcaaacagggtcggcttctagtatggtgaatggagtcgtgcgcctactcaccaaaccctgggacgtagtgccgatggttactcagatggcaatgacggatacaacccctttcggccagcagagggtctttaaggagaaagtggacactcggacccaagagcccaaggaaggtacaaagaaactgatgagaattacggccgagtggttgtggaaggaactggggaaaaagaaaaccccacgcatgtgtactagggaggaattcacaaagaaagtgcgatccaacgctgccctcggagcaatctttaccgatgagaataagtggaagagcgcccgggaggctgtcggcgacggcagattctgggaacttgttgataaagagaggaacctgcacttagaagggaagtgcgagacttgtgtgtataatatgatgggaaaacgcgagaagaaactgggtgaatttggcaaggcgaaggggtcacgtgccatttggtacatgtggttgggagcacggttcctcgagtttgaagctctgggcttcctaaacgaggaccattggttttccagagaaaattctcttagcggtgtagagggggagggactgcacaaactcggctatatcctgagggaagtgagtaagaaagagggcggggccatgtacgcagacgatacagccggatgggacacccgcataacaatcgaagatttgaagaacgaggaaatgattactaatcatatggagggtgagcacaaaaagctggctgaagccatcttccgactcacctaccagaacaaggtcgtgcgggttcagagacctacgcccaggggcaccgtgatggacattatctcccgcagagatcaacgggggagcggacaggtcggcacatatggtcttaatactttcaccaacatggaggcgcagctgattaggcagatggaaggggagggagtgtttaaatctatacaacatttaacagcagccgaagagatcgctgtacagaattggctggttcgtgtgggccgagagcgcttgtcaagaatggccattagtggcgacgattgcgtcgtgaagccactcgacgatcggttcgcaagggctctgactgccctaaacgacatggggaaagtgcgcaaggatatccagcagtgggaaccctccagaggatggaatgactggacccaagtccctttttgcagccaccacttccatgagcttatcatgaaagatggtcggattctggttgtgccatgtaggaaccaggacgaactcataggccgagctcgtatctctcagggggccggatggtcgctgagagagacggcatgcttgggcaagtcatacgcgcagatgtggagcttaatgtattttcaccgccgggacctgaggctcgccgctaacgccatttgttccgcagtaccgagtcattgggtgcccacatctagaaccacttggagcatccacgcttcccacgagtggatgacaaccgaagatatgcttactgtctggaatcgcgtgtggattcaagagaacccttggatggaagacaagaccccagttgagtcatgggaagagatcccctacctgggtaaacgggaggatcagtggtgcgggagtctaataggactgacatctagggccacgtgggcaaagaatatccagaccgccattaaccaggtgcgaagcctcatcggcaatgaagagtatactgactacatgccttccatgaaaagattccggagggaagaggaagaggcgggcgtcttgtggtga

SEQ ID NO: 15032 - RNA, 9876 nt, synthetic construct
  misc_feature 1..9876: note = derived and/or modified CDS sequence (opt3) from DENV-2__KF479233__SS-prME
  source 1..9876: mol_type = other RNA
accgcaggcgtgatcattatgctgatacccacggctatggcattccacctcactacgagaaacggggaacctcatatgatcgtcagcaggcaggaaaagggaaaatcccttctgtttaagaccgaagacggtgttaatatgtgcacattgatggcaatggatttaggcgaactgtgtgaggacactattacctacaactgcccattactccggcaaaatgaaccggaggatatcgactgttggtgcaactctacatcaacctgggtgacttatgggacatgtaccgcgacgggagagcaccgccgagaaaaacgtagtgttgctctggtgccccatgtcggcatgggtcttgagactagaaccgaaacatggatgagctccgagggggcctggaagcacgcacagaggattgagacttggatcctgcggcatcctggattcaccataatggccgctatcttggcatacacaattggcaccacgtattttcagcgcgtgctcatcttcattctgctgactgccgttgctccatctatgacaatgagatgcatcggcatatcgaatagggattttgtggaaggggtctcaggaggtagctgggtggacattgtactcgagcacggcagttgtgttaccactatggccaaaaacaagcccacattagatttcgaactgatcaagaccgaggcgaaacagcctgcaacgcttcggaagtactgcattgaagccaaattgaccaatacaactaccgcttcccgctgtccaacacaaggggagccctctctgaacgaggaacaggacaagcgatttgtgtgcaaacacagcatggtcgatagaggatggggcaatggttgtgggctattcggaaagggcggcatcgtgacttgcgccatgtttacctgcaagaaaaacatggaggggaagatcgtgcagcctgaaaatctcgagtatacaattgtcgttaccccacattccggagaagagaacgcagtgggtaatgacactggcaaacacgggaaggagataaaagtaacgccgcagtcaagtatcacagaagctgagctgaccggatacggcactgtgaccatggaatgtagccccaggacaggtcttgatttcaacgagatggtcctgttgcaaatggaaaataaggcctggctcgtgcatcggcagtggtttctggacttacctctgccatggctccccggggcggatacccagggctctaactggattcagaaagagactcttgttacattcaagaaccctcacgccaagaaacaagacgtggtcgtgctgggatcccaggagggcgcaatgcacacggctttgaccggggccactgaaatccagatgtcaagcggaaatctactgtttacaggtcatctcaagtgccgtctgcgcatggacaaacttcaactgaagggcatgagttattctatgtgtaccgggaaattcaaggtagttaaggagatagctgaaacacagcacggaactattgtggtcagagtgcagtacgagggcgatggttccccatgcaaaatccccttcgagatcatggacttggaaaagaggcatgtcctcgggcggctgattaccgtgaacccgatcgttacggagaaagatagccctgtgaatattgaagccgagcccccatttggcgactcgtacataatcattggagtagaacctggccagttaaagctgtcttggttcaaaaaggggtcctcaatcggacaaatgtttgagaccacaatgcgaggtgcaaagcgcatggccatcctaggcgatactgcttgggacttcgggagtctcggaggcgtctttaccagcattggtaaagcgctgcaccaggtgttcggggcaatatatggcgccgctttttccggagtttcttggacaatgaagatccttattggcgtggtcatcacttggattgggatgaacagcagatcaaccagtttgtccgtgagcctggtactcgtgggagttgtcacgctgtaccttggcgtgatggtgcaggccgattctggttgtgtcgtttcatggaaaaataaggagctgaaatgcgggagtggaatcttcataacagacaacgtgcatacctggactgaacagtataagtttcaacccgagagcccatccaagttggcatctgccatccagaaagctcacgaagagggcatttgtggtatcaggtcggtgacacggctcgaaaatctgatgtggaagcagattacccccgagttaaaccacatcctgagcgagaatgaagtaaaactaactataatgaccggcgatattaaggggatcatgcaggccggaaaacgctccctcagacctcaaccaacagagctgaagtactcatggaaaacgtggggcaaggcaaagatgcttagtaccgaaccgcagaaccagactttcttgattgacgggcccgagacagcggaatgccctaataccaacagggcttggaactctctggaggtcgaggattatggatttggcgtgttcacaactaacatctggctcaaactgaaggaacgtcaggacgtattttgtgacagcaaattaatgtccgccgcaataaaggataatcgggccgtgcatgctgacatgggttactggatcgagtcagccctgaacgatacctggaaaattgaaaaggccagcttcatcgaggtcaagtcttgccactggccaaaatcccatacgctttggagtaacggggtgttggagagcgaaatgattatccccaagaatttcgctggacctgtttctcaacacaactatcgaccaggctaccacacacagaccgccggtccctggcatctcggcaaactggagatggactttgatttctgtgaagggactaccgtggtagtcacagaggactgcggaaatagaggcccgtccctaaggactaccacagcgtcagggaagctgataacggaatggtgctgtcgcagttgcaccctccctccactgcggtacaaaggagaggatggctgttggtatggtatggagattagaccccttaaggaaaaggaggaaaacttggtgaatagcctggtgactgccgggcacggacagatcgacaacttttcgttaggcgtcctcggtatggctctgttccttgaggaaatgctgaggacacgcgttggcaccaaacatgcagtgttgctcgtagccgtgtcctttatgactctgatcacagggaatatgtctttccgagatctaggacgggtcatggtgatggttggcgctgccatgaccgacgatattgggatgggagtgacgtacctggcactcctggcggcctttaaggtccgtcctactttcgctgccggccttttgctgagaaaattaaccagcaaggagctcatgatgacaaccatcggtattgtgctgctttcacaaagtactatacccgagacaatcctggaactaaccgacgcactcgctctggggatgatgattttgaaaatcgttaggaacatggagaagtatcagctggccgtgacaattatggcaatcttatgcgtcccaaatgccgtaatactccagaacgcttggaaggtgtcctgtactatcctggcggttgtgtctgtcagccctcttctgttgacctcctcacagcaaaaagccgattggattcccctcgcactgacgatcaagggactaaatccaacagctatttttctgaccactcttagccgcaccaacaaaaagcggagttggccgctcaatgaagccatcatggccgtgggcatggtatctatactggcttccagcttgctgaaaaacgacattcctatgacaggccccttagtggcagggggactcctgactgtctgctacgttcttaccggtagatcggccgacctggagttggaaagggcggctgatgtgcgatgggaggaccaggccgagatctcaggctctagtccaatcctctccattacgataagcgaagatgggtctatgagcatcaagaatgaggaagaggagcagacactgaccattctaatccgcactggactgcttgtgatttccggcctcttccccgtctcaatccctataacagcagccgcttggtatctgtgggaagtgaaaaagcagcgggccggtgttttgtgggacgtaccaagtccccctccggtggggaaggccgagttagaagatggagcgtacagaatcaaacaaaagggcattctgggctatagccagatcggggctggagtctacaaagagggtacctttcacactatgtggcatgtgacaaggggcgccgttctcatgcacaaggggaaacgtattgaaccatcttgggcagacgtgcgcaaggatctgatctcctacggaggcggttggaaacttgagggggagtggaaagaaggagaggaagtccaggtgctggccttggagcccggcaagaaccctcgggctgtacagaccaaaccaggcctattcaagacgaacactgggaccataggagccgtctcactggactttagtcccggtacaagcggctcccctattgtggataaaaaggggaaggttgtgggactctatggcaatggtgtcgtgaccagatctgggacatacgtttcggcaatcgctcaaactgagaaaagcatcgaggacaacccggagattgaagatgacatcttcaggaagaaacgactgaccataatggatcttcaccccggagccggcaagacgaaacggtatttaccagcgattgtgcgcgaggccatcaagagaggcctgaggacactcattttggcacctactcgggtcgtggctgccgaaatggaggaagctctgcgagggctccccatcagataccagaccccagcaatacgcgccgagcatacaggaagggagattgtagacctgatgtgtcacgccaccttcactatgcgtcttctgtcacctgtgcgggttcccaattataacttgatcatcatggacgaagctcattttaccgatccagcgtccattgcagccagaggttacatcagtacaagggtcgagatgggcgaagctgccgggattttcatgacggcaactccgcctggatctcgcgacccctttccacagagcaatgcccccataatggatgaggagcgagaaatccctgagagatcctggaactcaggccacgaatgggtgaccgacttcaagggtaaaacagtgtggtttgtcccatctattaaggctgggaatgatatcgcggcctgcctacggaaaaacggaaagaaagtaatccaactgagcaggaagaccttcgacagtgagtatattaagactcgcacaaatgattgggactttgtggttaccacggatatatccgaaatgggcgcaaacttcaaagctgagcgtgtgatcgaccccagacggtgtatgaagcctgtcattctcactgatggcgaggaaagggtgatcttagccgggccgatgccagttacacatagctctgcagcccagcgccgaggaagaattggtcggaatcccaaaaacgagaatgaccagtacatctacatgggcgaacctctggagaacgacgaagattgcgctcactggaaggaggccaaaatgcttctggacaatataaacacccccgaggggatcattccatcaatgtttgaacctgagagggaaaaggtggatgcgatcgacggagagtatcgcctcagaggcgaagcaaggaaaaccttcgtcgagttgatgcggcgtggtgatctgcccgtgtggctcgcctaccgcgtagctgccgaggggattaactatgctgaccgaagatggtgttttgatggcatcaagaataaccagatactggaagagaatgtggaagttgagatttggactaaggagggagagaagaagaaacttaagccaaggtggctagacgcacggatctactccgatcctctggccttgaaagagttcaaggagttcgctgccggccgcaagagtttaacaatgaacctgattaccgagatggggagactcccgacatttatgactcaaaaagcaaggaatgcgctggacaaccttgccgtcctgcacacggctgaagccggaggtcgggcatataatcatgctctcagcgagttgcccgagaccctggaaacactactgctccttactctgttagccaccgtgacaggcgggatcttcttgtttctgatgtcgggaaagggcataggtaaaatgaccctcgggatgtgctgcatcattactgcatctatcctgctttggtacgcccagattcagccacactggatcgctgcgtccataattctggagttctttctcatcgtgttgctgatccctgaacccgagaagcagcgaacgccacaagataaccagttaacctatgtcgttattgccatcctaacagtggtagcagctactatggccaatgaaatgggcttcctggagaaaaccaagaaggactttggactcggcagcatagtgacacagcagcctgagtcaaacattcttgatatcgacctgagacccgccagtgcatggaccttgtacgctgtcgccactacattcattacgccgatgctgcgccattctatcgaaaattccagcgtgaacgtttcactcaccgcgatagctaatcaagccactgtgctgatggggcttggaaaaggttggccactcagtaagatggacatcggcgtccctctgttggcaattgggtgttacagccaggtaaaccccatcacactgaccgccgctttactactgctcgtggcacactatgccattatcggaccaggccttcaggcgaaagctaccagggaggcccagaagcgggcagccgctggtattatgaaaaatcccacagttgatgggatcactgtgatagacctggatcctattccgtacgaccccaagtttgaaaagcaattgggccaggtcatgctgctcgtgctgtgcgtcacacaggtgcttatgatgcgtaccacatgggccttatgtgaggcactgactctcgctaccggaccaatctccacattgtgggaaggcaaccctgggagattctggaataccactatcgccgtttctatggcgaacatttttaggggaagctatctggccggcgcaggtctactgttctccataatgaaaaacacggctaatacacgccgggggaccggaaacactggcgagaccctcggtgagaagtggaaaaatcgacttaactcactgggcaagtctgaatttcaaatctacaaaagaagtgggattcaggaggtggataggacattggccaaggaaggaatcaaacgcggcgagactgaccaccatgcagtatcgcgggggagcgctaagctgagatggttcgtggagcgtaatctcgtcacccccgaaggaaaggttatggatctgggctgcggtaggggagggtggtcctattactgtggcggtctaaagaatgtgcgggaggtcaagggccttacaaaagggggacctggccacgaagaaccaattcccatgtctacgtatgggtggaatctggtgcgcctccagtcaggagtagacgtgttctttacccctccagaaaagtgcgatactctactgtgtgacatcggcgagagctcccccaacccgacagttgaggccggtcgaaccttgagagtgctgaatctcgtcgaaaactggcttaataacaatactcagttctgcataaaagtgctgaacccttacatgccaagtgtcatcgagaagatggaaacattgcaaaggaagtacgggggagccctggtgcggaatcccctctctcgcaacagcacccatgagatgtattgggtttcaaacgcgtccggcaatattgtaagtagcgtgaacatgatctctagaatgttaattaataggtttacgatgcgacacaaaaaggctacctacgaacctgatgtcgacctgggctccgggacacggaacatcggaatagagtcagagattccaaatcttgatatcatcggtaaacgtattgaaaagataaaacaggagcatgaaactagctggcactatgaccaggaccacccctacaagacctgggcatatcatggctcgtacgagacaaagcagactgggtctgccagttccatggtgaacggagttgtgagactgctaaccaaaccgtgggatgtcatccctatggtgacacaaatggctatgaccgacactacgcccttcggccagcagcgcgtatttaaggaaaaagtggatacaaggacccaggagccaaaggagggtactaaaaagctcatgaagattaccgccgaatggctgtggaaagagttggggaagaaaaagacacctcggatgtgtacgagagaagagttcacccgcaaagttaggagcaatgcagccctgggagctatctttactgacgagaacaagtggaaatcagcgcgagaagccgtcgaggattcccggttctgggaactcgtggacaaggagagaaatcttcacctggaaggcaagtgcgagacatgtgtgtataacatgatgggcaaaagggagaagaaaattggggaatttggaaaggcaaaaggttctcgcgctatctggtacatgtggttaggcgcccgtttcctggagtttgaagcattggggttcctcaatgaggatcattggtttagccgggaaaacagtctgtccggagtcgagggcgagggtctacacaaacttgggtacatactgagagaagttagcaagaaagagggaggcgccatgtatgctgacgataccgccggctgggacactaggatcacactcgaagatctgaagaatgaggaaatggtgaccaaccacatggagggggagcataaaaagttggcggaagcaattttcaaactgacataccaaaataaggtagtgcgcgtccagcgacccactccacggggaaccgtgatggacatcatttctagaagggaccagcgcggttcaggccaagttgggacgtatggactcaacaccttcacaaacatgggcgcccagcttatcagacagatggagggtgaaggggtgtttaagagtattcagcacctgactaccacagaggaggtcgctgtgcaagattggttagcccgggtaggaagggaacgtctgtcccgaatggcaataagcggcgacgattgcgttgtgaaacccttggacgatcgcttcgcttctgccctcactgctctgaatgacatgggcaaggtcagaaaagatatccagcagtgggagccttcgcgggggtggaacgactggacccaggtgccattttgctcacatcacttccatgaactaattatgaaggatggaagggtgcttgtcgttccgtgtcgcaatcaagacgagctgatcggtagagcccggatcagccagggcgcagggtggtccctcagggaaacggcgtgcctgggaaaaagttacgcccagatgtggtctttgatgtattttcaccgacgtgatttaagactggctgccaacgcaatttgtagcgctgtgccctcccactgggtacctacatcacgcaccacttggagtatacatgcccggcacgagtggatgacaaccgaggacatgctcactgtgtggaatagggtctggatccaggaaaacccatggatggaggataagacccccgtggaatcttgggaggaaattccttaccttggcaagagagaggaccaatggtgcggtagcctgatcgggctaacatcccgcgcaacgtgggccaaaaatattcagaccgcgatcaaccaggttcggtcactgataggaagcgaggaatatactgactacatgccatctatgaagaggttccgaagagaggaagaggaagctggcgtgctctggtga

SEQ ID NO: 15033 - RNA, 9876 nt, synthetic construct
  misc_feature 1..9876: note = derived and/or modified CDS sequence (opt3) from DENV-2__KX372564__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtggccccatctatgacaatgagatgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaacaccctgcgacgctgcggaagtactgcattgaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaagatcgtccagcctgaaaacctagagtatacaattgttataaccccacactccggagaagagaatgccgtgggtaacgatactggcaaacatgggaaggagatcaaagtaacgccgcagtcaagtattacagaagcagagctcaccggatacggcactgtgaccatggaatgtagccccaggacaggtctggacttcaatgagatggtccttctgcagatggaaaacaaggcttggttggtgcaccggcaatggtttctcgatctgcctttaccatggctgcccggggccgacacccagggctctaactggatccagaaagagactctcgttacattcaagaatcctcacgcgaagaaacaggatgtggtcgtgcttggatcccaagagggcgccatgcatacggcactgaccggggctactgaaatacagatgtcaagcggaaacttgctatttacaggtcacctgaagtgccgtctccgcatggacaaactgcagcttaagggcatgagttattctatgtgtaccgggaaattcaaggtagttaaggagattgccgaaacacaacatggaactatcgtgatcagagtccagtacgagggcgacggttccccatgcaaaattcccttcgagatcatggatctggaaaagaggcacgtgttggggcggctcattaccgtcaatccgatagtgacggagaaagacagccctgttaacatcgaagctgagcccccatttggcgattcgtacattatcatcggagtggaacctggccagctgaagttatcttggttcaaaaaggggtcctcaattggacagatgtttgagaccacaatgcgaggtgccaagcgcatggcaatactgggcgacactgcctgggatttcgggagtctaggaggcgtatttaccagcatcggtaaagctctccatcaagtcttcggggcgatttatggcgcagccttttccggagtgtcttggacaatgaagatcctgattggcgttgtgatcacttggatagggatgaatagcagatcaaccagtctttccgtcagcttggtgctggtaggagtggttacgctctacctgggcgtcatggtgcaggctgactctggttgtgtggtctcatggaaaaacaaggagcttaaatgcgggagtggaatcttcattacagataatgttcacacctggactgaacagtataagtttcagcccgagagcccatccaagctggcctctgcaatccaaaaagcccacgaagagggcatttgtggtatcaggtcggtgacacggttggaaaacctcatgtggaagcagataacccccgagctgaatcatattttaactgagaacgaagtgaaactgaccatcatgacaggcgacattaaggggatcatgcaggctggaaaacgcagcctaagacctcagccaacggagctcaagtactcctggaaagcctggggcaaggcaaaggtactgtcaaccgaacttcacaatcatactttcttgatagatgggccggagacagcggaatgccccaacaccaatagggcttggaacagtctggaggtcgaggactatggatttggcgtgttcacaactaatatctggctcaaactgaaggaacgtcaagatgtttcttgtgacagcaaattaatgtccgccgcaattaaggacaaccgggccgtgcacgctgatatgggttactggatcgagtcagccctgaacgacacctggaaaattgaaaaggcaagctttatcgaggtcaagtcttgccactggcctaaatcccatacgctttggagtaatggggtgttggagagcgaaatgataattccaaagaacttcgctggacccgtttctcagcacaattatcgacctggctaccatacacagaccgccggtccatggcacctcggcagactggagatggatttcgacttttgtgaagggactaccgtggtagtcacagaggattgcggaaacaggggcccctccctacgcactaccacagcgtcagggaaactgatcacggaatggtgctgtcggagttgcaccctcccgcctctgagatacaggggagaggacggctgttggtatggtatggagatccgcccacttaaggaaaaagaggaaaatttggtgaacagcctggtgactgccgggcatggacagattgataatttctcgttaggcgtcctcggtatggctctgtttcttgaggaaatgctgcgaacacgggttggcaccaagcacgcaatcttgctcgtggccgtatccttcgtgactctgattacagggaacatgtcttttcgtgacctaggaagagtcatggtgatggttggcgctaccatgacggatgacatagggatgggagtgacttacctggccctcctggcagcgttcaaggtcaggcccacctttgccgctggccttttgctgcgcaaattaacaagcaaggagctcatgatgaccactatcggtattgtgctgctttcacaaagtacaatccctgagaccattctggaactaacagatgccctcgcactggggatgatggttttgaaaatcgtgcggaatatggagaagtatcagctggctgtcactataatggccatcttatgcgtacccaacgcagtgattctccagaatgcctggaaagtttcctgtaccgctctggcggtggtctctgtgagcccacttctgttgacgtcctcacaacagaagacagactggatccctctcgccctgaccattaagggactaaaccccactgcaatcttcctgaccacacttagcagaactagtaaaaagaggtcttggccactcaatgaagctataatggccgtaggcatggtgtccattctggccagctcgtttttgaaaaacgatatcccgatgaccggccctctggtcgctgggggattactcacggtttgctacgtgctgacaggtcgatcagcagaccttgagctggaacgcgccgcggacatccggtgggaggagcaggctgaaatttctggcagttcccccatattgagcatcaccatttctgaggatgggagcatgtccatcaagaatgaagaggaggaacagactctcacaattctgatcagaaccggactactggtgatatcaggccttttcccagtcagtatccccattactgccgcagcctggtatctctgggaggtgaaaaagcaaagggctggtgttctgtgggacgtacctagcccaccccctgtggggcgtgcagaattggaggatggagcctaccgcatcaaacagaagggcattttaggctattctcagatcggggcgggagtctacaaggaaggtacatttcacaccatgtggcatgtgacgcggggcgctgttctgatgcacaaagggaagagaatagagccgtcctgggccgacgtgaaaaaggatctcatttcatacggaggcggttggaaactggagggggaatggaaggagggagaagaggtccaggtgcttgcactggaaccaggcaagaaccccagggccgtacaaactaaacctggcttgttcaagaccaacacagggaccatcggagctgtcagtctagactttagcccaggtacatccggctctcccatcgtggataaaaaggggaaagttgtgggactgtatggcaatggtgtcgtgactcgatcggggacctacgttagcgccattgcacagacggagaagtcaatcgaggacaaccctgaaatagaggatgacattttccggaagaaacgcctcacaatcatggatctgcatccgggagctggcaagactaaaagatatcttcccgccattgtgagggaagcgatcaagcggggcttacgaaccctgatactcgccccaacaagagtcgtggcagctgagatggaagaggccttgcgcgggctgcctattaggtaccagacccccgctatccgtgcagagcacactggacgggaaatcgtagacctcatgtgtcatgccaccttcacaatgagactgctttccccaattagggtgcctaattataacctgatcattatggatgaggcccactttacggaccccgctagtatagcggcacgcggttacatctctactcgagttgaaatgggcgaggccgctgggattttcatgaccgccacaccaccgggaagcagagacccttttccccagtccaatgcaccaatcatggatgaggaacgggagatccccgaaaggtcatggaactctggccacgagtgggtcaccgacttcaaaggtaagactgtgtggtttgtgcctagcattaaggccgggaatgatatagctgcgtgcttgcgcaaaaacggaaagaaagtcatccaactaagtcgtaagacattcgactccgaatatattaaaaccagaacgaatgattgggactttgtagtgactacagatatcagcgagatgggcgccaacttcaaggcagagcgggttattgacccaaggcgctgtatgaagcccgtgatcctgaccgatggcgaagagcgagtcatactcgctgggcctatgccggtgacccattcttcagccgcacagagacggggaagggttggtcgcaatccaaaaaacgaaaatgaccagtacatctacatgggcgagcccttagaaaacgatgaggactgcgcccactggaaggaggctaaaatgctgcttgacaatattaacactcctgaagggatcattccctccatgtttgagccagaaagagagaaggtggatgccatcgacggagaatataggctgcggggcgaggcgcgtaaaacattcgtcgatctcatgcgccgaggtgacttgcctgtgtggctggcatacagagtagccgctgaggggataaactatgccgataggcggtggtgttttgacggcgtgaagaataaccaaattctcgaagagaatgttgaagtcgagatctggaccaaagagggagaacgcaagaagctgaaacccagatggcttgatgctaggatttacagtgacccactagcactgaaggagttcaaagaattcgccgctggccggaagagcttgacattaaacctgatcactgagatggggcgactccctacgtttatgacccagaaagccagaaatgcactggataaccttgcggtgctgcatacagccgaagctggaggtcgcgcctataatcacgcactctcggagttgccggagactctggaaaccctactgctccttacactgttagctaccgtgactggcgggatattcttgtttctgatgtctggaaagggcatcggtaagatgacgctcgggatgtgctgcattgtcaccgcctccatcctgctttggtacgcacagattcagccccactggatcgccgctagcataattctggagttctttctcatcgttttgctgatcccagaacctgagaaacaaaggacaccccaggacaaccagttaacttatgtggtaattgcgatcctaaccgtggtcgccgcaacaatggctaatgaaatgggcttcctggagaagaccaaaaaggattttggactcggctcaataactacacagcaaccagagagtaacattcttgacatcgatctgcggcctgcctctgcctggacgttgtacgcagtggctaccactttcattacacccatgctgcgtcattccatcgaaaatagctcagttaacgtgagtctcaccgccatagcgaatcaggctaccgtcctgatggggcttggaaaaggttggccgctcagcaagatggacatcggcgtaccactgttggccattgggtgttactcccaggtgaaccctatcacactgactgcagccttactactgctcgttgctcactatgcaattatcggacccggccttcaggccaaggcgacgagagaggctcaaaaaagggccgcagccggtattatgaagaatccaaccgtggacgggatcacagtcatagatctggaccccattccttacgatccgaaatttgaaaagcagttgggccaggtgatgctgctcgtcctgtgcgtgactcaggttcttatgatgcgcaccacatgggctttatgtgaggccctgaccctcgcaactggacccatctctacgttgtgggaaggcaacccagggcggttctggaatacaaccatcgctgtgagcatggccaacatttttcgaggatcctatctggcgggcgccggtctactgttctcaataatgaaaaacactgcaaataccagaagggggacaggaaacactggcgagaccctcggtgagaagtggaagaatcgccttaacgctctgggcaaatctgaatttcaaatctacaagaaaagtgggattcaggaggtagaccggacattggccaaggaaggaatcaaaagaggcgagacggatcatcacgcagtgtcgcgtgggagcgctaagctgaggtggttcgtcgagcggaatctcgttacccctgaaggaaaagtggtcgacctgggctgcggtcgcgggggatggtcctattactgtggcggtttaaagaacgtgaaggaggtaaaaggccttactaaggggggacccggccatgaagagcctattccaatgtctacatatgggtggaatctggtgcgactccagtcaggagttgatgtgttctttaccccccctgaaaaatgcgacactctactgtgtgatatcggcgagagctccccaaaccccacagtcgaggccggtagaaccttgagggtgctgaatctcgtcgaaaactggcttaataacaatacgcaattctgcataaaggtgctgaacccgtacatgcctagtgttatcgagaaaatggaagccttgcagcggcgctacgggggagcgctggtaagaaatccactctctaggaacagcacccacgagatgtattgggtgtcaaacgcttccggcaatattgtcagtagcgtgaacatgatctctcgaatgttaattaatcggtttacaatgcgtcacaagaaggcaacttacgaacccgacgttgatctgggctccgggaccagaaacatcggaatagagtcagaggtgcctaatcttgacattatcggtaaacgcatcgaaaagattaaacaggagcatgaaacaagctggcactatgatcaggaccatccatacaagacttgggcctatcacggctcgtacgagaccaaacaaacagggtctgctagttccatggtcaacggagtggtaaggctgctaaccaagccctgggacgtgataccgatggttactcagatggccatgacggatacaacccctttcggccagcagcgggtctttaaggaaaaagtggacactagaacccaagagcccaaggagggtacaaaaaagctcatgaaaatcacggcagaatggctgtggaaggagttggggaagaaaaagaccccacgcatgtgtactagggaagagttcacacgaaaagtgcggagcaatgccgctctgggagcgatttttaccgatgagaacaagtggaaatcagccagagaagcagtcgaggactccggcttctgggaactcgttgataaggagaggaatcttcacctggaaggcaaatgcgagacttgtgtgtataacatgatggggaagcgcgagaagaaattaggagaatttggtaaggctaaaggctctcgtgccatctggtacatgtggctgggggcacggttcttggagtttgaagccctcggattcctgaatgaggaccattggtttagcagagaaaacagtctatccggcgtagagggtgaggggcttcacaagctgggatacattctcagggatgtgagcaaaaaggaaggcggcgctatgtatgccgacgatacagcggggtgggacacccgcatcacactggaggatttgaagaatgaagagatggtcactaaccatatggaaggagagcacaaaaagctggcagaggccatattccgactcacctaccagaataaagtggttcgggtgcagagacctacgcccaggggtaccgtcatggacatcatttctcgcagagaccagcggggctcagggcaagtggtaacatatggacttaacactttcaccaacatggaagctcagctgatcaggcagatggagggcgaaggtgtttttaagagtattcaacatttaacagccactgaggagatcgcagtgaaaaattggctggtccgtgtggggcgagaacgcttgtccagaatggctattagcggagatgactgcgtggtcaagccattcgatgaccggtttgccaacgctctcaccgccctgaatgatatgggcaaggttaggaaagacatacagcagtgggagccctctcgcggctggaacgattggacgcaggtgcctttctgctcgcaccactttcatgaactaatcatgaaggacgggagagtacttgtggtcccatgtcggaatcaagatgagctgattggaagggcacgaatctcacagggtgcgggctggagcctccgtgaaacagcctgcctggggaaatcctacgctcagatgtggagtttgatgtatttccacagacgcgacttacggctggccgcaaacgctatctgttctgccgtgccgagccattgggttcccacctccaggactacatggtcaattcacgcaacccacgagtggatgactaccgaggatatgctcacagtgtggaatagagtctggatacaggaaaacccttggatggaggacaagacgccagtggaaagttgggaggaaatcccctaccttggaaaacgcgaggatcaatggtgcggctctctgattggtctaaccagccgggccacttgggcgaagaatatccagacagctattaaccaggtaaggtccctgatcgggaatgaggaatataccgactacatgccttcaatgaagcgatttagacgggaggaagaggaagccggagttctctggtga

SEQ ID NO: 15034 - RNA, 9873 nt, synthetic construct
  misc_feature 1..9873: note = derived and/or modified CDS sequence (opt3) from DENV-2__KX274130__SS-prME
  source 1..9873: mol_type = other RNA
agcgccgctaccctgctccttctggtgcccacaatcatggcattccacttgactacgagaaacggcgagcctcatatgattgtcgccaggcacgaaaaggggaaatccttaatatttaagaccgagaatggagttaacatgtgcacactgatggcgatggacctaggtgaactctgtgaggaaactgtgacctacaaatgcccatatctgaagcagtctgagccggaggatatcgactgttggtgcaatacaacctcaacttgggtaacatacggcacctgtagtagctccggggaacatcggcgcgagaaacgatctgtggctcttgccccccacgtcggaatgggcctggaaacgcgtactgagacctggatgtcgtcagagggtgcatggaagcatgcccaaagaattgaaaactggatcttgaggcaccctgggtatacagtgatggctgcagccattgctatggccatcggaactaataacttccagcgggcgctcatatttgttctgctgaccgcagtggccccaagcatgacaatgcgctgcgtcggcatcgctaatagagatttcgtggagggcgtaagtgggggatcctgggttgacattgtgctcgaacacggttcttgtgtcaccacgatggccaagaacaaacccactttagattttgagctgacaaagaccgaagcaaaacttcctgctactttgaggaagtactgcatcgaggccaaactgacaaataccacgaccgagagccggtgtccaacacagggcgaaccctccctacctgaggaacaggacaagcgcttcatttgccgacattcactcgtggatagagggtggggaaacggctgtggtctgtttgggaagggaggcatcgtgacttgcgcgatgttcacctgcaaaaagtatatggagggcaaaatagtccaaccagaaaatcttgagtacacagttgccgtgactccgcacagtggggaggaacatagcgtaggaaacgacaccggtaagcacggccaggatgtgaaaattacaccccagtcttccatcaccgagactgcactggaagggtatggatcaattagcatggagtgtagtcctaggacgggcttggactttaatgaaatggtcctcctgcagatggaggataaggcttggttagtgcaccggcaatggttcctggacctcccacttccctggctgcctggttctgatacacaggggtccaactgggttcagaaagagaccttggtgacttttaagaatccacatgccaagaaacaggacgtcgtggtactaggcagccaagaaggagctatgcactcggccctgaccggcgcaacagagatccagatgacctctgggaacctcctgttcactggacatcttaagtgccgtctgcgcatggacaaattggaactcaagggtatgtcctactcaatgtgtacaggcaaatttaaggttgtgaaggagatcgccgagacgcagcacgggaccattgtcataagagtgcaatacgaaggagagggcagtccctgcaaaatcccgttcgaaattatggatctggagaagaaacatgtcttaggtaggctgatcactgtgaaccctataattacagaaaaggacaaacccaccaatatcgaggctgagccacctttcggggatagctatatcctaattggcgttgaacccggacagctcaagatgaactggtttaagaaaggctcctctatcgggcagatgttcgagacaactatgcggggagcgaagcgaatggcaattctgggtgacaccgcctgggattttggcagccttgggggagtgttcaattcaataggcaaagctttgcaccaggtatttggtgccgtctacaacgcagccttcagtggggtgtcctggacgatgaagatcctgattggcgttatcatcacctggattggaatgaatagccgctctacatcaatgagtataactctcgtgatggtcggcctggtgaccctttatctgggggtagtggttcaagctgacagcggatgtgtcgtgtcctggaaaacaaaggaattgaagtgcggctctggtatctttgtgactgataacgtccacgtttggaccgagcagtacaaattccagccagaatcgcccgccaagctcgcagcggctattaaaaaggcccatgaggagggggtgtgtggaatcagaagcgtgacgaggctggaaaatattatgtggaaacagatcacacctgagttaaaccacatactgaccgaaaatgacgtaaaggtcactatcatgacaggcgatattaaaggtatcctacaacagggccggcgcgcactcagaccacagccgaccgagctgaagtattcctggaagtcatgggggaaaagtaagattgtgtctagcgaaactcataaccagacctttcttatcgacggacccgagacaacggagtgccctgataccaatagggcctggaactccttggaagttgaggactacggcttcgggctgttttcaactaatatatggctccgtctgcgggaaaaacaagacacattatgtgatagcaagctgatgtctgctgccgtgaaagacgagcgagcaattcacgctgatatgggatattggatcgagtccaagcttaacggcagttggaagattgaaaaagccagcttcttggaggtcaagtcttgcacctggccaagatcccacacactctggtcaaatggtgtgctggaaagtgagatgatcatacccaaaaacctagggggacctgttagccagcataactacaggccaggctactatactcagaccacgggtccctggcacctgggcaagctcgaaatggactttgattactgtgaggggacaaccgtgatcgtaactgaggaatgcaataaccgcggaccgtcgctgcggaccacaactgcgtccggcaaacttattaccgagtggtgctgtagatcttgcacaatgcctccattgaggttcaagggggaagacggatgttggtatggcatggagatccgccccctgaaggaaaaagaggagaatttagtcaacagcctcgtgacggccggtcatgggcagattgataatttctcactgggaatccttggcatagctctgtttttggaagaggtgatgaagagtcgaattggtatcaaacacaccatcggcatgactattatcacattcctcctgctagtcaccgggaacgtttcctaccgggacctgggacgtgtgattctcatggtaggctctactatggcagatgaaatggggatgggagtgacatatctggcccttttggctacctttagaataaggcctacgttcgccctggcattaatgatccgcaagctcactagcaaagagctgcttatggcgaccattggcatcgtcctgattgcccaatgcgacgtgcccggtacaatcctagaaataaccgatgcttgtgccctcgggctgatgttgctgaagatgactcgggagttagagagataccagctcgcagttacactgctttccctgacctgcatcccaaatgctacaattatgtggggagcctggaaggtgacttgtaccatcttgacgctcgtctcaatggcacctctgtttctaacaaccagcaggcagaaaactgactgggtgcccgttgccctgagtatttatggccttaacccaaccgctatctacttcacaactctcgcgaaggccaaaaagatacgatcttggccgctgaatgaagcagtgatggctgtcggcatggtatccattttggccagctcgctgttacgcaacgatatccctatggccgggcccctcgtggctggaggtctgcttaccctgtgctacgttttgacgggccggtcagcagacctcgagctggaaaaatctgccgacatcaagtggaatgatgacgcggagattagtgggtccagcccaataatcaacgtggctgtctctgaggatggaagcatgtccattaaagacgaagaggaagagaatacactaaccatcctgattagaactggccttctcgccatctcaggtatgtatcccatggcaatacctgccacagctgcagtgtggtacttttgggaagccaggaagcaacgtgcgggggtactgtgggatgtgccaagtccccctccgaccggaaaggctgagttggaggaaggcgcctatcgcatcaaacagcggggcattttcgggtacagccagatcggagcaggtgtctataaggagggcacttttcatacaatgtggcacgttaccagagggtctgtgttaatgtgtaaaggaaagaggctggaaccatcctgggccgacgtgaaaaaggatctcatttcatacggcggtgggtggcgactggacggagagtggacggaaggcgaggaggtccaggtgcttgctctggaacccggcaagaaccctcgggccgttcaaactaaaccagggatgttcaagaccgatacaggacgcatcggtgcagtaagtttggactttgctcccggcaccagcgggtcccctataattgataaaaagggaaaagtgatcggcctatatggtaatggggtcgtgatgaagtctggagcctacgtttcgagcatcgcgcagacagagaagagagaagacgagattccggaaatcgaggatgacatattcaggaaacggcgactgactattatggacctccaccccggcgccggcaagaccaaaagatacctgccagcaatcgtgcgcgaggctattaagagggggcttcgtacgttaatcctggcccctacacgggtcgtggctgcagaaatggaggaagccctcagaggattgcccataaggtatcagactccagccattcgcgctgagcataccggtcgagagatcgtagatctgatgtgccacgcgacatttaccatgagactcctgtcacctgtccgggtgcccaactacaaccttatcattatggacgaagcacatttcactgatccagcctccatcgctgccaggggctatattgcaacccgcgttgagatgggggaagccgctggaatattcatgacagcgacgccgcctggcagtaaagacccctttccacagtctaatgcccccatcatggatgaggaacgtgagattcctgagagaagctggaactccggtcacgaatggatcactgacttcgaggggaagaccgtgtggtttgtcccatcaatccgggcaggaaatgatattgctacatgtctgaggaagaacggcaaaaaggtgatacaattgtctcgcaaaaccttcgacactgaatacatcaagacacgaaataacgattgggactttgttgtgaccacggatattagcgagatgggcgccaatttcaaagcagaaagagtcatcgacccccggaggtgcatgaagcctgtgattctaactgacggggaggagcgcgtaatcctggccggaccgatgccagtgacacccagttccgctgcccagagaaggggtcggataggccgtaaccctaagaatgaaaacgatcagtatatctacatgggggagcccctcgaaaatgacgaggattgcgcgcattggaaagaagcaaagatgttactggacaacattaataccccagagggaatcattcctgccatgtttggccccgagcgcgaaaaaaccgatgctatcgacggtgagtatcgacttagaggggaaagcaggaagactttcgttgagctgatgcggcgcggcgatctcccagtctggttggcctacaaagtggcttctgagggatactcatatgcagacagaaggtggtgttttgaaggcgtgaagaacaatcagatactggaggaaaacctcgaggtcgaaatttggacaaaagagggggagcggaagaagctgcgacctaaatggcttgatgccagaacctactccgacccgcaagctctaaaggatttcaaagaatttgccgcaggacgcaagagtacaactctgaacttgatcgcggagttaggtaggctgcccacgtatatgacccagaaaacacgggacgccctcgataatctggctgtacttcacactgccgaagagggcgggcgtgcataccagcacgctattagcgaactgccagagaccctcgagacattgctgctactgtgcctccttgccaccgtgtcgggaggcgttttcctgttcttaatgtctggtaaggggatcggcaagatgtccatgggattgggctgtataatcactgcaagcgggctgctctggtatgcccaaattcagcctcattggatcgctgcgtcaattatcctggaatttttccttatagtgctgctcattcccgagccagaaaaacagagaacgcctcaggacaaccaattgacctacgtcgtgatcgccatcctgacattagttgcagctactatggccaatgagatgggatatctagaaaagaccaaaaaggacctgggttttggcaacccctacgtggccagtcacgaggcagctattctcgatatcgaccttcatccggcctctgcgtggacactgtacgctgtcgccaccactttgataacaccaatgctgaggcactccattgagaatagctcaacgaacgtgagtctcaccgcaatcgccaatcaggctactgtactgatggggcttggaaaaggctggcctctcagccgcatggatctgggtgtgcccttgctggcattagggtgctattcccaggttaacccactaacactgaccgcctctctccttctgttgattggccactacgcgatcataggacccggcctgcaggctaaggccacccgggaagcacaaaagcgaacagccgctgggatcatgaaaaatcctactgtcgacggaattacggtgatcgatattgagccgatcccctatgacccaaagttcgaaaaacagctcggccaggtgatgctgcttgtcttatgtgttgcccaggtgctgatgatgagaaccacatgggcaatgtgcgaggctctcactattgccaccggtcctatcagcacattgtgggaggggaaccccggaaagttttggaataccactatagcggtatccatggccaacattttcaggggctcatacctggcaggtgctggcctactgttttctatcatgaaaaatacggtgacagggcgccggggaaccggcgtcgccggggaaactctcggagagaagtggaagatcaaacttaacggcctgggtagaaccgatttccaaacatataagcgtagtgggattatagaagtggacaggactttggcaaaagagggaatcaagcggggcgaaaccaatcatcacgctgtttcgcgcggtagcgccaaactgcgatggtttgtggagagaaacctcgtcaagcctgagggcaaagtaattgatctggggtgtggaaggggcgggtggtcctactattgcggaggcttaaagaatgtgacagaagttaagggtcttacgaaagggggaccaggccatgaggaacccatccctatgtctacctacggctggaacctggtgcggctccagtcaggggtcgacgtgttctttactccacccgagaagtgtgatacactactgtgcgacattggagaaagctccccgaaccctaccatcgaggccggtcgcactttgagagtcctgaatatggtggagaactggctcggcaataaccagttctgtataaaagttcttaatccatacatgcccagtgtgatcgaaaagatggagaacctgcagaggaaatttgggggaacattggtacgaaatcctctgtctcggaacagcacccacgaaatgtattgggtgtcaaatgcgtccggcaacattgtcagtagcgttaatatgatctctcgtatgctcattaacagattcacgatgaagcataagaaaccaacctacgagcaagatgtggacttaggttccgggacacgcaatgtcggaatcgaaactgagaagcccaacctggagataattggcaaaaggatcgaaaagatcaaagacgagcacaagcagacctggcactatgatcttgaccatccgtacaagacatgggcttatcacggctcatacgaaactaaacagaccgggagcgcatcgtctatgattaatggagtggtaaagctgctaacaaaaccttgggatgtgatacccatggttacccaaatggccatgactgacacgacaccattcggtcagcagcgggtgtttaaggagaaagtcgataccagaactcctgagcccaaggaaggcaccaagaaactcatgaagctgacagctaaatggttgtgggccgagctggggcgccataaggtgccaaggatgtgcacgcgagacgaattcaccaacaaagtccggagtaacgcagccatgggagctgtgtttactgaggaaaatagatggtccagcgcgaaggaggccgttgaggatgaagcattctgggacctcgtagatagggagcgcaaacttcacctgcagggcaagtgcgaaacatgtgtgtataacatgatgggtaagcgtgagaaaaagttaggggaatttggacgggctaaaggctcaagagccatctggtacatgtggctgggcgcaaggttcttggagtttgaggccctcgggttcctgaatgaagaccactggttttcccgcgagaactctctaagcggagtcgaaggtgagggccttcataagctggggtacattctccgagaaatcggagctaaagatggcggtatgatgtatgccgacgacaccgcggggtgggatactcgggtgacagaggaggacctgaagaatgaagagatgattagtgaacaaatgaagggagagcacagaaccttggcagaggccatcttcaaactgacataccagaacaaggttgtgagggtccagcgccccactcctaaaggcaccgtgatggatataatctccagacgggaccagaggggcagcgggcaagtaggaacgtatggtctcaatacctttacaaacatggaagctcagcttattcgtcagatggagggcgaagggctgttccgagatatctctaagttaactattcaggaggaaaccgccatcctgacatggttgaaagagaagggacgcgacagactctcacggatggcaattagtggcgatgactgcgtggttaagccagtcgatgacaggtttgctcatgccctgactgctctaaatgatatgggtaaagtgcgcaaggacatacaacagtgggaggcctccaaagggtggaacgattggacccaggtgccgttctgtagccaccatttccacgaaatcattatgaaggacggaagaaaacttgtcgttccctgccggaatcaagacgagctgatcggcagggcacgaatctctcagggcgcggggtgggccctcaaggaaacggcttgtctgggaaaggcctacgcacagatgtggtcgttgatgtattttcaccgtagagatttacgcctggctgccaacgcaatttgctcagccgtgcctagccattgggtaccaacatcccggaccacttggagtatacacgcgcatcaccagtggatgacaaccgaggacatgctcgatgtgtggaatagggtctggatccttgaaaacccctggatggacgataaaacttgtgtgaagtcttgggaggaggttccttacctgggtaaaagagaagaccaatggtgcggcagcctaattgggctgacctcccgcgctacatgggccaagaatatcaaagtggcaattgagcaggtccggtcactcatcggaaaggaagagtatacggattacatgccaagtatgaagaggttcaaacaggaacagtctaccgagggcgccttgtggtga

SEQ ID NO: 15035 - RNA, 9876 nt, synthetic construct
  misc_feature 1..9876: note = derived and/or modified CDS sequence (opt3) from DENV-2__GU289914__SS-prME
  source 1..9876: mol_type = other RNA
agcgcaggaatgatcattatgctgatacccaccgtgatggctttccacctcacaactagaaacggggagcctcatatgatcgtctccaggcaggaaaagggaaaatctcttctgtttaagacggaggacggtgttaatatgtgcaccttgatggcaatggatttaggcgaactgtgtgaggacacaattacttacaactgcccattactccggcaaaatgaaccggaggatatcgactgttggtgcaactcaaccagtacatgggtgacctatgggacttgtacaaccacgggagagcaccgccgagaaaaacgtagcgtagccctggtgccccatgtcggcatgggtcttgagactagaaccgaaacatggatgtcctctgagggggcgtggaagcacgctcagaggattgagacttggatcctgcggcatcctggattcaccataatggccgcaatcttggcctacacaattggcaccacgcactttcagcgcgctctcatcttcattctgctgactgcagtggccccatcgatgacaatgagatgcatcggcatatcaaatagggattttgttgaaggggtgagcggaggtagttgggtcgacattgtgctcgagcacggctcctgtgtaaccactatggctaaaaacaagcccacattagatttcgaactgatcaagaccgaggccaaacagcctgcgacgcttcggaagtattgcattgaagcaaaattgaccaatacaactaccgagtctcgctgtccaacacaaggggagcccagcctgaacgaggaacaagacaagcgatttgtttgcaaacattccatggtggatagaggatggggcaatggttgtgggctattcggaaagggcggcatcgtcacttgcgccatgtttacctgcaagaaaaacatggaagggaaggtggtgcagcctgagaatctcgaatacacaatcgtcgttaccccacactcaggagaggagcatgctgtgggtaacgacactggcaaacacgggaaggaaattaaagtaacgccgcagagtagcataacagaggccgaactgaccggatatggcactgtgaccatggagtgttctcccaggacaggtcttgatttcaatgaaatggtcctgttgcaaatggagaacaaggcatggctcgtgcaccggcagtggtttctggacttacctctgccatggctccccggggctgatacccagggctccaattggatccagaaagagactcttgttacattcaagaaccctcatgccaagaaacaagacgtggtcgtgctgggatcacaggaaggcgcgatgcacacggccttgaccggggcaactgagattcagatgagcagtggaaacctactgtttacaggtcatctcaagtgccgtctgcgcatggacaaacttcaactgaagggcatgtcttactccatgtgtaccgggaaattcaaggtagttaaggaaatcgctgagacacagcacggaactatagtgattagagtccagtatgagggcgatggtagcccatgcaaaatccccttcgaaatcatggacttggagaagaggcatgtgctcgggcggctgattaccgtcaatccgatcgtgacggaaaaagattcgcctgttaacattgaggccgaacccccatttggcgactcttacataatcattggagtggatcctggccagttaaagctgaattggttcaaaaaggggtcctcaatcggacaaatgtttgagaccacaatgcgaggtgctaagcgcatggccatcctaggcgacactgcatgggatttcgggagtctcggaggcgtatttaccagcattggtaaagccctgcaccaggtcttcggggctatatacggcgcggcattttccggagtgtcttggacaatgaagatccttattggcgttatcattacttggatcgggatgaacagcagatcaaccagtttgtccgtgagcctggtcctcgtgggaatagtaacgctgtatcttggcgtgatggttcaggccgactctggttgtgtcgtgtcatggaaaaataaggagctgaaatgcgggagtggaatcttcattacagataacgtgcacacctggactgaacagtacaagtttcaacccgagagcccatccaagttggcttctgccatccagaaagcacaggaagagggcatttgtggtatcaggtcggtcacacggctcgaaaatctgatgtggaagcagataacccccgagttaaaccatattctggccgagaatgaagttaaactaactatcatgaccggcgacattaaggggatcatgcaagctggaaaacgcagcctcagacctcagccaacagagctgaagtattcctggaaaacgtggggcaaggccaagatgctttcaaccgaaagtcacaaccagactttcttgatagatgggccggagacagcagaatgccccaataccaacagggcgtggaactctctggaggtggaggactacggatttggcgtgttcacaactaacatctggctcaaactgaaggaaaaacaggacgctttttgtgatagcaagttaatgtccgccgcaattaaagacaatcgtgccgtacatgctgatatgggttattggatcgagtcagccctgaacgacacctggaagattgaaaaggccagcttcatcgaggtcaaaaactgccactggcctaagtctcacacgctttggtccaatggggtgttggagagtgaaatgataattcccaagaatctcgctggacccgttagccaacataattaccggcctggctatcacacacagatcgccggtccatggcatctgggcaagctagagatggatttcgacttttgtgatgggaccactgtggtcgtgaccgaagactgcggaaaccgaggcccctctctgagaacaactaccgcgtccgggaaactcatcacagagtggtgctgtaggtcatgcacgctgccgcctcttcgctaccggggagaagatggctgttggtacggtatggagattagaccattgaaggagaaggaagagaatctggttaacagtttagtgaccgccgggcacggacaggtagacaatttcagcctcggcgtcctgggtatggctctttttctggaagagatgttgaggactcgcgtgggcacaaaacatgcaatcctcctggtggccgtctcgttcgttaccctaattactgggaacatgtcctttcgagatctgggacgggtggtagtgatggtcggcgctacaatgaccgacgatatagggatgggagtgacgtatctcgccctgcttgcagcgttcaaggttcgtcccacttttgccgctggcttgctgttaagaaaactcacctctaaggaactgatgatgacaaccatcggtattgtgcttctgagccaatcaactatccctgagacaattctagagctcaccgacgccctggcattggggatgatggtcctgaaaatggtgaggaatatggaaaagtaccagttagctgttacaatcatggccatactctgcgtgcccaacgcagtcatcctgcagaatgcctggaaggtaagttgtactattcttgctgtggtttccgtgtctccactgttgctcaccagctcccagcagaaaacggactggatccctctggcgctaacaattaagggactgaaccccaccgccatcttccttactaccctctcacgcacaagcaaaaagcggagttggccactgaatgaggcaataatggctgtcggcatggtgtctattttggcctccagcctgctcaaaaacgatatcccgatgactggccctctagtagccgggggactgcttaccgtgtgctatgtcctgacgggtagatcggctgacttggaactcgagagggcagccgatgttaagtgggaagaccaggcggagatctcaggctctagtcccattctgtccataacaatcagcgaggatgggtctatgagcattaaaaatgaagaggaggaacagaccctaactatcctgattcgaacaggacttctcgtgatctccggcctgtttccagtgtcaatacccatcaccgctgccgcatggtacttgtgggaggtcaagaagcagcgcgccggtgtgttatgggacgttcctagtccaccccctatggggaaagctgaactggaggatggagcatatcggattaagcaaaaaggcatcctcggctacagccagattggggccggagtatataaggaaggtactttccacacaatgtggcacgtgaccagaggcgcggtcctgatgcataaagggaagaggatcgagccgtcttgggctgacgtgaagaaagatcttatatcctacggaggcggttggaagctggaaggggagtggaaagagggagaagaggttcaggtgttggccctagaaccaggcaagaacccccgtgcagtccagacgaaacctggcctgtttcgcactaacgccgggaccattggagctgtgtcactcgacttcagtccaggtacaagcggctcccccatcatcgataagaaggggaaagtagtcggactgtacggcaatggtgtggttacccggtctggggcctatgtgtcggcaattgctcaaacagaaaagagcatcgaagacaaccctgagatagaggatgacatttttagaaaaaggcgacttactatcatggacttacacccgggagccggcaagaccaaacggtacctgcccgcgattgtccgcgaagccatcaagagaggcctcaggacgttgatactggcaccaacacgggtggttgctgccgagatggaagaggctctccgagggctgcctattagatatcagactcccgcaatccgcgccgaacataccggaagggagatcgtggatcttatgtgtcacgccacattcaccatgcgtctgttgtcaccagtccgggtgcctaattacaacctaattatcatggacgaggctcatttcactgatcccgcgtccattgcagccagaggttatataagtaccagggtagaaatgggcgaggctgccgggatctttatgacagcaacgccaccgggatctcgcgaccctttcccccagagcaatgccccaattatcgatgaggaacgagagatccccgaaagatcctggaactcaggccacgagtgggtgactgactttaagggtaaaaccgtttggttcgtcccttctattaaggctgggaatgatatagcggcctgcctgcggaaaaacggaaagaaagtgatccaactcagcaggaagacatttgacagtgaatacgtgaagacccgcactaatgattgggacttcgtcgtaacaaccgatatttccgagatgggcgcaaactttaaagctgaacgtgtgatcgacccaagacggtgtatgaagcccgttattttaacggacggcgaggagagggtgatcctggccgggcctatgccggtcactcacagctctgcagcccagcgccgaggaagaataggtcggaatcccaaaaacgaaaatgatcagtatatctacatgggcgagccccttgaaaacgacgaggattgcgctcattggaaggaagccaaaatgctgctcgacaatattaacacacctgaggggatcattccctcaatgttcgagccagaaagggagaaggtggatgcgatcgacggagaataccgcttgagaggcgaggcaaggaaaacctttgttgatctgatgcggcgtggtgacctccctgtgtggctggcctataaggtcgctgccgaagggataaactacgctgatcgccgatggtgtttcgacggcattaagaataaccagatccttgaggagaatgtggaagtagagatttggaccaaagaaggagagagaaagaaactaaagcccaggtggctggatgcacggatctattccgacccattggccttaaaagagtttaaggagttcgctgccggccgcaagagtctgactctcaacctgataacagagatggggagacttcctaccttcatgacacaaaaagcaagggatgcgctggacaatctcgccgtgttgcacactgctgaagccggaggtcgggcatacaaccatgctctgagcgagctaccggaaacgctggagaccctccttctgttaacattgctggccactgttaccggcgggatctttctcttcctgatgtcgggacgaggcattggtaagatgacacttgggatgtgctgcatcattaccgcatctatcctgctctggtatgcccagatacagccccactggattgctgcgtccatcatcttggagtttttcctgattgtcttactaatcccagaacctgagaaacagagaactccccaagacaatcagctgacgtacgtggtgatagccattctcaccgtcgttgcagctacaatggccaacgaaatgggctttcttgagaagactaaaaaggatctgggattgggcagcatcgccacccagcagccagaatcaaatattctggacatcgatctccgccctgcaagtgcttggacactgtatgccgtggcgaccactttcgtaacacccatgcttaggcactctatagagaactccagcgtgaatgtctcactcacggctatcgccaaccaagcaaccgtgctgatggggttgggaaagggttggccgctgagtaaaatggacattggcgttccattactagccatcgggtgttacagccaggtgaatcctattactctgacagctgcactccttctgttggtcgcccattacgcgatcattggacccggcctgcaggctaaggccacccgggaggcacagaaacgtgccgctgccggtatcatgaagaacccaaccgtagatgggataacagtgattgacctcgatcccatcccttatgacccgaaatttgaaaagcaactgggccaggttatgcttttagtgctgtgcgtcactcaggtgctcatgatgagaacgacctgggcattgtgtgaggctctgacactagccactggacccatctccaccctgtgggaaggcaatccagggaggttctggaacacaaccattgcggtctctatggccaatatatttcgcggaagctacctcgcaggcgctggtcttctgttctccatcatgaagaacactacgaacacacggcgagggaccggaaatattggcgagactttgggtgaaaaatggaagtcaagactgaacgccctcggcaaatctgagtttcaaatctataagaaaagtgggattcaggaggtggataggaccctggcaaaggaaggaatcaaacgcggcgagacagaccaccatgctgtttcgcgggggagcgccaagttaagatggttcgtggaacgtaatatggtaactcctgagggaaaggtggtcgatcttggctgcggtaggggagggtggtcctactattgtggcggtctgaaaaacgttcgggaggtgaagggcctcaccaaagggggacccggccacgaggaacctataccaatgtctacatacgggtggaatctagtccgcctgcagtcaggagtggacgtatttttcatcccacctgaaaagtgcgatacgttgctgtgtgacattggcgagagctccccaaaccccaccgtggaagccggtcgaactctcagagttcttaatctggtggagaactggttgaataacaatacacagttctgcatcaaagtcctgaacccgtatatgcctagtgtgattgagaagatggaaaccctccaaaggaagtacgggggagcgttagtccggaatccactgtctcgcaacagcactcatgagatgtactgggtgtcaaatgcttccggcaacatcgttagtagcgtaaacatgatatctagaatgcttattaataggtttacaatgcgacacaaaaaggcaacctatgaacccgacgtggatctgggctccgggacgcggaacatcggaatcgagtcagaaattcctaatctagacataatcggtaaacgtattgagaagatcaaacaggagcacgaaaccagctggcattacgatcaggaccacccatataagacatgggcctaccatggctcgtatgagactaagcagaccgggtctgctagttccatggtcaacggagtggttagactcctgacaaaaccctgggatgtggtcccgatggtgactcaaatggccatgaccgacacaacccctttcggccagcagcgcgtatttaaggaaaaagtggatactaggacgcaggagcccaaggaaggtaccaaaaagttgatgaagattacagcagagtggctgtggaaagagctcgggaagaaaaagactccacggatgtgtaccagagaagagttcacacgcaaagttaggagcaatgccgctcttggagcgatctttacggacgaaaacaagtggaaatcagcccgagaggcagtcgaggattcccggttctgggaactggtggacaaggagagaaatttacacctggaaggcaagtgcgagacctgtgtgtacaacatgatgggcaaaagggaaaagaaattgggggagtttggaaaggctaaaggttctcgcgccatatggtatatgtggctcggcgcacgtttcctggagtttgaagccctagggttccttaatgaggatcactggtttagccgggaaaacagtctgtccggagtcgagggcgaaggtctccataagctggggtacatcttgagagacgttagcaagaaagagggaggcgctatgtacgccgacgatactgcgggctgggacacaaggattaccctggaggatctcaagaatgaagagatggtgactaaccacatggaaggggagcataagaaacttgcagaagccatcttcaaactgacatatcaaaataaagtagtgcgcgtccagcgacctaccccacggggaacagtgatggacattatctctagaagggatcagcgcggttcaggccaagttgggacttacggattaaacacctttacgaatatggaggctcagctgattagacagatggagggcgaaggtgtgttcaagaacatacagcacttgaccgtcacagaggaaatcgccgtgcaaaactggctcgcacgggtagggagggagcgtctgagtcgaatggctatttccggagacgattgcgttgtgaaaccactagacgatcgcttcgccagcgctcttactgccctgaatgacatgggcaagatcagaaaagatatccagcagtgggagccctctcggggctggaacgactggacccaggtccctttttgctcgcatcacttccacgaactcattatgaaggatgggagggtgctggtggtcccatgtcgcaatcaagacgagttgataggcagagcacggatctcacagggtgcgggctggagcttaagggaaacagcctgcctggggaaatcctatgctcagatgtggagtctcatgtactttcatcgacgtgaccttagactggccgcaaacgctatttgttctgccgttccgagccactgggtgcccacttcccgcaccacgtggtcaatccatgcaaagcacgagtggatgacaaccgaagatatgctaactgtatggaatcgggtgtggattcaggagaacccttggatggaggacaagacaccagtcgaaagttgggaggaaatcccctatctgggaaaaagggaggatcaatggtgcggctctctcataggtttgaccagcagagccacttgggcgaagaatatccaggctgccattaaccaggtgcgctccctgatcgggaatgaagagtacaccgactatatgccttcaatgaaacggttcaggcgagaggaagaggaagcaggagttctttggtga

SEQ ID NO: 15036 - RNA, 9876 nt, synthetic construct
  misc_feature 1..9876: note = derived and/or modified CDS sequence (opt3) from DENV-2__AY858036__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtggccccatctatgacaatgagatgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaacaccctgcgacgctgcggaagtactgcattgaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaagatcgtccagcctgaaaacctagagtatacaattgttataaccccacactccggagaagagaatgccgtgggtaacgatactggcaaacatgggaaggagatcaaagtaacgccgcagtcaagtattacagaagcagagctcaccggatacggcactgtgaccatggaatgtagccccaggacaggtctggacttcaatgagatggtccttctgcagatggaaaacaaggcttggttggtgcaccggcaatggtttctcgatctgcctttaccatggctgcccggggccgacacccagggctctaactggatccagaaagagactctcgttacattcaagaatcctcacgcgaagaaacaggatgtggtcgtgcttggatcccaagagggcgccatgcatacggcactgaccggggctactgaaatacagatgtcaagcggaaacttgctatttacaggtcacctgaagtgccgtctccgcatggacaaactgcagcttaagggcatgagttattctatgtgtaccgggaaattcaaggtagttaaggagattgccgaaacacaacatggaactatcgtgatcagagtccagtacgagggcgacggttccccatgcaaaattcccttcgagatcatggatctggaaaagaggcacgtgttggggcggctcattaccgtcaatccgatagtgacggagaaagacagccctgttaacatcgaagctgagcccccatttggcgattcgtacattatcatcggagtggaacctggccagctgaagttatcttggttcaaaaaggggtcctcaattggacagatgtttgagaccacaatgcgaggtgccaagcgcatggcaatactgggcgacactgcctgggatttcgggagtctaggaggcgtatttaccagcatcggtaaagctctccatcaagtcttcggggcgatttatggcgcagccttttccggagtgtcttggacaatgaagatcctgattggcgttgtgatcacttggatagggatgaatagcagatcaaccagtctttccgtcagcttggtgctggtaggagtggttacgctctacctgggcgtcatggtgcaggctgactctggttgtgtggtctcatggaaaaacaaggagcttaaatgcgggagtggaatcttcgttacagataatgtgcacacctggactgaacagtataagtttcagcccgagagcccatccaagctggcctctgcaattcaaaaagcccacgaagagggcatctgtggtattaggtcggtgacacggttggaaaacctcatgtggaagcagatcacccccgagctgaatcatatattaagcgagaacgaagtaaaactgactattatgaccggcgacatcaaggggattatgcaggctggaaaacgctccctaagacctcagccaacagagctcaagtactcatggaaaacgtggggcaaggccaagatgctgagtaccgaacttcacaatcatactttcttgatcgatgggccggagacagcagaatgccccaacaccaatagggcgtggaactctctggaggtcgaggactatggatttggcgtgttcacaactaatatatggctcaaactgaaggaacgtcaagatgttttttgtgacagcaaattaatgtccgctgccatcaaggacaaccgggcagtgcacgccgatatgggttactggattgagtcagctctgaacgacacctggaaaatcgaaaaggccagcttcattgaggtcaagtcttgccactggcctaaatcccatacgctttggagtaatggggtgttggagagcgaaatgatcataccaaagaacttcgcaggacccgtttctcagcacaattatcgacctggctaccatacacagaccgctggtccatggcacctcggcagactggagatggattttgacttctgtgaagggactaccgtggtagtcacagaggattgcggaaacaggggcccctccctacgcactaccacagcctcagggaaactgattacggaatggtgctgtcggagttgcaccctcccgcctctgagatacaggggagaggacggctgttggtatggtatggagatccgcccacttaaggaaaaagaggaaaatttggtgaacagcctggtgactgcggggcatggacagatcgataatttttcgttaggcgtcctcggtatggccctgttccttgaggaaatgctgcgaacacgggttggcaccaagcacgctattttgctcgtggcagtatcctttgtgactctgatcacagggaacatgtctttccgtgacctaggaagagtcatggtgatggttggcgccaccatgacggatgacattgggatgggagtgacttacctggctctcctggccgcatttaaggtcaggcccaccttcgcggccggccttttgctgcgcaaattaacaagcaaggagctcatgatgaccactataggtatcgtgctgctttcacaaagtacaattcctgagaccatcctggaactaacagatgctctcgccctggggatgatggttttgaaaattgtgcggaatatggagaagtatcagctggcagtcactatcatggctatattatgcgtacccaacgccgtgatcctccagaatgcatggaaagtttcctgtaccacgctggccgtggtctctgtgagcccacttctgttgacatcctcacaacagaaggctgactggattcctctcgcgctgaccatcaagggactaaaccccactgccatttttctgaccacacttgcaagaactagcaaaaagaggagttggccactcaatgaagctatcatggccgtaggcatggtgtctatactggcctccagcttgctgaaaaacgatattccgatgaccggccctttagtcgctgggggactcctgacggtttgctacgtgcttacaggtcgatcggcagacctggagttggaacgcgccgcggacgtgcggtgggaggagcaggctgaaatctcaggctctagtcccatcctctccattaccataagcgaggatgggtctatgagcatcaagaatgaagaggaggaacagactctgacaattctaatcagaaccggactgcttgtcatttccggcctcttcccagtgtcaatccccataactgccgcagcctggtatctgtgggaggttaaaaagcaaagggctggtgtattgtgggacgtgcctagtccaccccctgtcgggaaagcagaattagaggatggagcctaccgtatcaagcagaagggcattctgggctatagccagatcggggcgggagtgtacaaagaaggtacatttcacaccatgtggcatgttacgcgcggcgctgtgctcatgcacaaggggaaacggattgagccgtcttgggccgacgtcaagaaagatctgatctcctacggaggcggttggaagcttgagggggaatggaaggagggagaagaggtgcaggtactggcattggaaccaggcaaaaaccccagagccgtccaaactaagcctggcctattcaaaaccaacacagggaccataggagctgtgtcactggactttagtccaggtacaagcggctcccccattgttgataagaaagggaaggtggtcggactctatggcaatggtgtggttactaggtctgggacctacgtgtcggccatcgcacagacggagaagagcatcgaggacaaccctgaaattgaggatgacatcttccgaaaaaagcggctgacaataatggatcttcatccgggagctggcaaaactaagcgctatttacccgccattgtcagagaagcgatcaaaaggggcctgcggaccctcattttggccccaacacgagtggtagcagctgagatggaagaggccctgagagggctccctatccgctaccagacccccgctataagggcagagcacactggacgtgaaattgtggacctgatgtgtcatgccaccttcacaatgcggcttctgtcaccaatcagagttcctaattataacttgatcattatggatgaggcccactttacggaccccgcttccatcgcggcaaggggttacattagtactcgcgtcgaaatgggcgaggccgctgggatattcatgaccgccacaccaccgggatctcgagacccttttccccagagcaatgcaccaatcatggatgaggaaagagagattcccgaacggtcctggaactcaggccacgagtgggtgaccgacttcaagggtaagactgtgtggtttgtcccttctatcaaagccgggaatgatatcgctgcgtgcctaaggaagaacggaaaaaaggtaattcaactgagccgcaaaacattcgacagtgaatatataaagacccgtacgaatgattgggactttgtggttactacagatatctccgagatgggcgccaacttcaaggcagagagagtgattgacccacggaggtgtatgaaacccgtcatcctcaccgatggcgaagagcgcgtgattttagctgggcctatgccggttacccatagctctgccgcacagcgaagaggacgggtgggtaggaatccaaagaacgaaaatgaccagtacatctacatgggcgagcccctggaaaacgatgaggactgcgcccactggaaagaggctaagatgcttctggacaatataaacactcctgaagggatcattccctcaatgtttgagccagaacgcgagaaagtcgatgccatcgacggagaatatagactcaggggcgaggcgcggaagacattcgtggatttgatgcgtcgcggtgacctgcctgtatggctcgcataccgagtggccgctgaggggattaactatgccgatagaaggtggtgttttgacggcgttaaaaataaccaaatcctggaagagaatgtcgaagtggagatatggaccaaggagggagaacggaagaaacttaagccccgctggctagatgctagaatttactccgacccactggcattgaaagagttcaaggaattcgccgctggcaggaaaagtttaacactgaacctcatcactgagatggggcggctgcctacgtttatgacccagaaggcccgaaatgcacttgataacctggcggtgctccatacagccgaaactggaggtagagcttataatcacgccttgagcgagctgccggagaccctagaaacactgctccttctgaccttattggcaactgtcacgggcgggattttcctgtttctcatgtcgggaaagggcatcggtaaaatgaccctggggatgtgctgcataatcacagcttctattcttctgtggtacgcccagatccagccccactggattgcagcctccatcatactcgagttctttttgattgttctgttaatcccagaacctgagaagcaacgcactccccaggacaaccagctaacctatgtggtaatcgctattctgacagtggtcgcggccaccatggcaaatgaaatgggcttcctcgagaaaactaagaaagattttggacttggcagcatcacaacgcagcaaccagagtcaaacatactggacattgatttgaggcctgctagtgcctggaccctgtacgccgtggcaactacattcatcacccccatgctccggcattctattgaaaattccagcgttaacgtgtcactgaccgctatcgccaatcaggcgacagtccttatggggctcggaaagggttggccgctgagtaagatggacataggcgtaccattgctggctatcgggtgttacagccaggtgaaccctattactttaacggccgcactactgctccttgttgcccactatgctatcattggacccggcctgcaggcaaaagccacccgtgaggcgcaaaagagagctgccgcaggtatcatgaaaaatccaacagtggacgggattactgtcatcgatttggaccccataccttacgatccgaagtttgaaaaacagctgggccaggtgatgctcctggtcctttgcgtgacccaggttttaatgatgaggacaacctgggccctgtgtgaggctctcactttggccacgggacccatttccacactgtgggaaggcaacccagggcgcttctggaataccactatcgcagtgtctatggctaacatctttcggggaagctatctagccggcgcgggtctgctcttctccattatgaagaacaccgccaatacacgaagagggactggaaacaccggcgagacacttggtgagaagtggaaaaataggctgaacgcattgggcaagtcagaatttcaaatatacaaaaagtctgggatccaggaggtagaccgcacgctggctaaagaaggaattaagcggggcgagaccgatcatcacgccgtgagtagagggtcggcaaaactccgttggttcgtcgagaggaatctggttactcctgaaggaaaggtggtcgacttaggctgcggtcgggggggatggagctattactgtggcggtcttaagaacgtgaaagaggtaaagggcctgacaaaagggggacccggccatgaagagcctatcccaatgtccacctatgggtggaatctcgtgcgcctacagtctggagttgatgtgttctttactccccctgaaaagtgcgacacactgttgtgtgatattggcgagtcaagcccaaaccccaccgtcgaggctggtcgaacgctgagagtgctcaatcttgtcgaaaactggctgaataacaatacccaattctgcatcaaagtgttgaacccgtacatgccttccgttatagagaagatggaagccctgcagaggaagtacgggggagccctcgtacggaatccattaagtcgcaactctacacacgagatgtattgggtgagcaacgcgtcaggcaatatcgtctccagtgtgaacatgattagcagaatgctgatcaataggtttactatgcgacacaaaaaggctacctacgaacccgacgttgatcttggctctgggacacggaacattggaatcgagtccgagactcctaatctggacataattggtaaacgtatcgaaaagatcaaacaggagcatgaaacctcatggcactatgatcaggaccatccatacaagacatgggcatatcacggcagctacgagaccaagcaaactgggtcggcctctagtatggtgaacggagtcgtgagactactcacgaaaccctgggacgtaattccgatggtgacacagatggctatgaccgatactacccctttcggccagcagcgcgtttttaaggaaaaagtcgacacaaggacgcaagagcccaaggagggtaccaaaaagctgatgaagataactgccgaatggttgtggaaagagctggggaagaaaaagacaccacggatgtgtaccagagaagagttcactcgcaaagtgaggtccaatgcagccctcggagctatctttacagatgagaacaagtggaaaagcgcgcgagaagccgtggaggactcagaattctgggagcttgtcgataaggaacggaatctgcacttagagggcaagtgcgagacctgtgtttataacatgatgggcaaaagagaaaagaaactgggggagtttggaaaggcaaaaggttccagggctatttggtacatgtggttgggcgcccgcttcctcgaatttgaggcactggggttcctaaatgaagaccattggttttctcgtgagaacagccttagtggagtggagggcgaaggtctgcacaagctcgggtacatcctgcgggatgtatccaagaaagagggaggcgccatgtatgctgacgatacagccggctgggacactagaattaccttggaagatctgaagaatgaggaaatggtgacgaaccatatggagggggagcacaaaaagctcgcggaagcaatcttcaggcttacctaccagaataaagtcgtgcgcgttcagcgacctacaccccggggaactgtgatggacataatcagcagaagggaccagcgcggttctggccaagtcgtgacctatgggctgaacacattcactaacatggaggcccagttaattagacagatggaaggagagggcgtatttaagtcaatccaacatctgaccgttacggaggaaattgctgtgaagaattggttggtccgggtgggtagggagcgtctcagtcgaatggccatctccggggatgactgcgtggtcaaaccactggatgaccgcttcgcaagcgctctaacagcccttaacgatatgggaaaggttagaaaagacattcagcagtgggaaccctctcggggctggaatgattggacccaggtgcctttttgctcgcaccacttccatgagctgataatgaaggacggcagggtactcgtggtcccatgtcgcaaccaagatgaactgatcgggagagctcggatttcacagggagccggttggagcttgagggagactgcatgcttaggcaaatcctacgcgcagatgtggagtctgatgtattttcaccgacgtgacctcagacttgccgctaatgccatctgttctgcagtgccgagccattgggttcccacatcccgcaccacttggtcaatccacgctacccacgagtggatgacaacggaagatatgctgaccgtgtggaaccgggtctggattcaggagaatccttggatggaagacaagactccagtggagagttgggaagagataccctacctagggaagagggaggatcaatggtgcggatctctgatcggcctcacaagcagagccacctgggcaaaaaacattcagactgccatcaatcaggtacgctccttgattggtaacgaagagtatacagactacatgccttcaatgaagcggttcaggcgagaagaggaagaggcgggggttctgtggtga

SEQ ID NO: 15037 - RNA, 9876 nt, synthetic construct
  misc_feature 1..9876: note = derived and/or modified CDS sequence (opt3) from DENV-2__HQ332184__SS-prME
  source 1..9876: mol_type = other RNA
accgcaggcgtgatcattatgctgataccaacagctatggcattccacctcactacgcggaacggggagcctcatatgatcgtcggtaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagttgcgctggtgccccatgtcggtatggggcttgagacccgtacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtcctcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttatctgcaagcattctatggtggatagaggctggggtaacgggtgtggactattcggcaagggcgggattgtaacctgcgccatgtttacatgcaaaaagaatatggaaggaaaagtggtgcagcctgagaacctcgaatacaccatagtcatcactccacacagcggtgaggagcatgctgttggcaatgacacggggaagcacggaaaagaaattaagatcacaccgcagtcctcaataaccgaggccgaactgactggctatggtaccgtgacaatggagtgtagtcccaggaccgggcttgatttcaacgaaatggtactgttgcaaatggaggacaaagcatggctcgtgcaccggcagtggtttctggatttacctctgccatggctccccggcgctgacactcagggaagcaattggattcagaaggagacacttgtcacgttcaagaaccctcatgccaaaaagcaagacgtggttgtgctgggctctcaggaaggggcgatgcacaccgccttgactggagcaacagagatccagatgtcctcaggtaatctactgtttaccggccatctcaaatgccgtctgcgcatggataaacttcaactgaaagggatgagctacagtatgtgtacaggaaagttcaagatcgtcaaagaaattgctgagactcagcacggcaccatcgtgattagaatacagtatgagggtgacgggtctccatgcaagatccccttcgaaattacggatttggagaaaaggcatgtactcggccggctgatcaccgttaacccgatcgtgattgaaaaggactcccctgtcaacatagaggccgaacccccatttggagatagctacatcattatcggcgtggagcctgggcagttaaaactgaattggttcaagaagggatcgtctattggtcaaatgtttgagacaactatgcgaggcgctaaacgcatggccatcctaggggacaccggatgggatttcggctccctcggtggggtctttacatcaataggcaaggcactgcaccaggtgttcggagccatctacggcgctgcgtttagtggggttagctggactatgaaaattcttatcggagtggtaattacctggatcggcatgaactccagatctacgagcttgtcagtcagtctggtgctcgttggtgtggtcacactgtatcttggggcaatggtgcaggccgactccggatgtgtagtgagctggaagaataaagaactgaagtgcggctctggtatattcattaccgataacgttcacacttggacagagcagtacaagtttcaacccgaatcaccaagtaaattggctagcgccatccagaaggcacatgaggaaggcatttgtgggatcaggtccgtcacccggctcgagaatctgatgtggaaacagataactcccgagttaaaccacatcctgtctgaaaatgaggtgaagctaaccattatgacaggagacacgaaaggcatcatgcaggccgggaagcgctcgctcagacctcaaccaaccgaactgaaatatagctggaagacttggggaaaggctaaaatgctttccacagagtcacataaccagaccttcttgattgatggcccggaaacagccgagtgccccaatactaacagggcatggaatagtctggaggtggaagactacggttttggggtcttcaccacgaacatctggctcaagctgcgtgagaaacaggacgtattttgtgattctaagttaatgagcgcggctataaaagacaatcgggccgtgcacgcagatatgggatattggattgaatccgccctgaacgacacatggaagatggagaaggcttcattcatcgaggtgaaaagctgccactggcctaagtctcataccctttggtccaatggcgtattggaaagtgagatgatcattcccaagaatttcgccggtcccgtcagccagcacaactaccgacctggctatcatactcaaaccgcagggccatggcacctcggaaagctggaaatggattttgacttctgtgagggcacaactgtggttgtgaccgaagattgcgggaatagaggaccctctctaaggacaacgaccgcttccggcaaactgatcactgagtggtgctgtcgctcatgcacactcccgcctctgcggtacagaggtgaggacgggtgttggtacggaatggaaattaggccacttaaggagaaggaagagaacttggtcaatagtctggtgaccgccggccatggtcagatagataactttagcttaggcgttctcgggatggcgctgttccttgaagagatgctgcgcactcgagtgggaacaaaacacgccaccttgctcgtagctgcatcgtttgtcacgctgatcactggcaatatgtccttccgggacctagggcgtgtgatggtgatggtcggagccaccatgacagatgacattggcatgggtgttacctatctggctctcctggccgcatttaaggtgagacccactttcgcggccgggcttttgctgaggaaattaacatctaaggagctcatgatggctaccatcggaattacactgcttagccagtcaactatccctgaaaccatactggagctaacggatgccctcgcactgggcatgatggtattgaaaatcgtgcgcaacatggaaaagtaccaactggctgtcacaattatggccatcagttgcgtgcccaatgcagttattttacggaacgcctggaaggtgtcctgtaccatcctcgctgcggtctctgtgagcccactgcttctgacttcctcacagcagaaagccgactggatacctttggcactcaccattaagggcctgaatcccacagctatctttctaactaccctgagcagaacgagtaaaaagaggtcttggccacttaacgaggccatcatggccgttgggatggtgtccattctcgctagctcgctgttgaaaaatgacataccgatgacaggacctctggtcgccggtggattactcaccgtatgctatgtgctgactgggcgatcagcagatcttgaactggagcgcgcggctgacgttaagtgggaggatcaggccgaaatctctggaagttcccccattttgagcatcacaatttctgaggacggcagcatgtccatcaaaaacgaagaggaggaacaaaccctcactatactgatccggacaggtctactggtgatttcaggggtcttcccagtgagtatccccattaccgcagccgcttggtacctttgggaggtaaagaagcagagagcaggagtgctctgggatgtccctagcccaccccctgttggcaaagccgaactggaggacggcgcgtataggatcaagcagcgtgggatattgggatactctcagattggtgctggcgtgtataaagaagggacgtttcacactatgtggcatgtgacccgcggagccgtcttaatgcaccggggcaagagaatcgagccgtcctgggcagatgtgaaaaaggacctgatctcatacggtgggggatggaagctcgagggcgaatggaaagagggcgaagaggttcaagtactggcccttgaaccagggaagaatcccagggctgtgcagacaaaacctggaattttcaagaccaacacaggtactatcggcgccgtcagtctggattttagcccagggacctccggatctcccatagtggaccgaaaaggcaaggttgtgggtttgtacgggaatggagtcgtgacgcggtcgggcgcatatgtaagcgctattgcccagacagagaagtcaatcgaggataaccctgaaattgaggacgatatcttccgcaaaaagagactaactataatggacctgcatccgggcgcggggaaaaccaagaggtacctccccgccattgtccgggaagcaatcaaacgaggactgagaacacttatcttagctccaacccgcgtggttgccgctgagatggaagaggcactgaggggtctccctattcgttatcagactcccgccatcaaggccgagcacaccggccgggaaattgtggacttgatgtgtcatgctacattcacgatgagactgctctccccagtcagggtgcctaactacaatctgataatcatggatgaggcgcactttactgaccccgcaagtattgccgctcgcgggtatatctctacccgagttgaaatgggagaggccgcaggcatcttcatgacagccaccccaccgggtagcagagatccttttccccaatccaacgctccaattatggacgaggaacgggagatacccgaaaggtcatggaactctgggcacgagtgggtgactgatttcaagggaaaaacagtctggtttgtgcctagcatcaaggcgggcaacgacattgccgcatgccttcgcaaaaatggcaagaaagtaatccagctgagtcgtaagaccttcgattccgaatacgtgaagacgagagctaacgactgggattttgttgtcactacagacattagcgagatgggggccaatttcaaagcagagcgggtgatcgatccaaggcgctgtatgaagcccgtgatattgaccgacggagaagaacgagtcatcctagccggtcctatgccggtaacccattcttcagctgcccagagacggggcaggattgggcgcaaccccaaaaatgaaaacgaccaatatatctacatgggagagcccctggaaaatgatgaggactgcgcgcactggaaggaggcaaaaatgctcttagataacattaatactcctgaaggcatcataccctccatgtttgagccagaaagagagaaggtggacgccattgatggtgaatacaggctgagaggggaagctcgtaaaacattcgttgaccttatgcgccgaggcgatctgcctgtgtggctcgcctataaggtcgctgcagagggaatcaactacgccgacagaaagtggtgttttgatggcattaaaaataaccagatcttggaagagaacgtggaagttgagatatggaccaaggagggggaaaggaaaaagctgaaaccccggtggctcgacgctcgcatctatagtgatccactggcccttaaggagttcaaggagttcgcagcgggaagaaaaagcctaacactgaatttgattactgagatgggtaggttacctacgtttatgacccagaaggcccggaacgctctggacaatctcgccgtgctgcatacagcagaagctggcgggcgagcctacaaccacgcactttcggagctgccggagactctcgaaaccttgctgctactgacactccttgccaccgtcactggaggcatcttcctgtttttaatgtctggtaaagggattggcaagatgacgttgggaatgtgctgcatcataaccgcttccgtgctgctctggtatgcgcagattcaaccccactggatcgccgcaagcatcattctggagttctttcttatcgtactgctcataccagaacctgagaaacagagaacaccccaggataatcagttgacttacgtggttattgctatcctgaccgtcgtggccgccacaatggcaaacgaaatgggcttcttagagaagaccaagaaagacctagggctgggatcaattactacacaagagagtgaatctaatatcctcgacatagatcttcgcccagcttccgcctggacgctgtatgcggtggctaccacttttgtcacacctatgttgaggcatagcatcgagaactcaagtgttaatgtgagcctgaccgccattgcaaaccaggccaccgtactcatgggtctgggcaaggggtggcccctttccaaaatggacatcggagtgccgctcctggctattggctgttactctcaggtcaatccaatcacattgactgcagccctgttactactggtggcgcactacgctattatcggtcctgggctccaggccaaggcaacgcgggaagcccaaaaacgtgctgccgcaggcataatgaagaaccccaccgttgatggaattacagtgatcgaccttgagccaatcccctatgatcctaagttcgaaaaacagctgggccaggtcatgttgctgattctctgcgtaactcaggtgctgatgatgagaaccacatgggctctttgtgaggccttaaccctggcgactgggccgataagcacgctctgggagggaaatcccggcaggttttggaacacaaccatcgccgtttccatggcaaatattttccgcggttcatacttggctggggccggactgctattttctatcatgaagaacactaccaatacacggcgaggcactggtaacattggcgaaaccctgggggagaaatggaagagtagactcaacgcacttggaaaatcggagttccaaatctataagaaaagcggcatacaggaggtggacaggacactggctaaggaggggatcaagcgcggagaaacggatcatcacgccgtctcccggggctctgccaaattgagatggtttgtggagcgtaatatggtcaccccagaaggtaaggtggttgacctggggtgcggaaggggcggttggtcatactattgtggcgggctcaaaaacgtgcgggaggtaaagggactgactaaaggcgggcctggacatgaggaaccaattcctatgagcacatacggctggaatttagtgcgccttcagtccggtgtcgatgttttcttcaccccacccgagaagtgcgacactctgctctgtgatatcggggaaagttctcctaacccaacaattgaggcgggacgaaccctaagagtgctgaatttggtcgaaaactggctgaataacaatacgcaattttgcatcaaggtgctcaacccctatatgccgagcgtaatagagaaaatggaaacccttcagaggaagtacggcggcgctctggtgcggaatcctttgtcacgcaactccacacacgagatgtactgggttagtaatgcaactgggaacattgtgagctctgtcaatatgatctccagaatgctgatcaacaggttcaccatgaaacacaagaaagccacatatgagccagacgtggatctcggatcaggtactcgaaacattggcatagaaagcgagatccccaatttagacattatcgggaagcggattgaaaagatcaaacaggagcatgaaacctcgtggcactacgaccaggatcatccttataagacatgggcttaccacggatcttatgagaccaaacaaactggcagtgcctccagcatggtcaacggtgtggttcgtctgcttacgaagccatgggacgtagtgcccatggtcacacagatggcaatgaccgatactaccccgtttgggcagcagagagtgttcaaagagaaggttgacacacgcacgcaagaacctaaggagggaaccaaaaagctgatgaggataactgccgaatggctatggaaagagctcggcaagaaaaagacaccccggatgtgtaccagagaggaatttactcgcaaagtgaggtcaaatgctgcgctgggcgccatcttcacagatgagaacaagtggaagtccgcacgagaagctgtcgaggacgggcggttttgggaattggtggataaagagagaaatctgcacctcgagggaaagtgcgaaacctgtgtatacaacatgatgggtaaaagggagaagaaacttggcgagttcgggaaggccaagggatctcgcgcaatttggtatatgtggctgggcgccagatttttagagttcgaagctctgggatttttgaatgaggaccattggttcagccgggggaacagtctctccggagtggagggcgaaggcctgcacagactagggtacatccttagggatgttggcaaaaaggagggtggcgccatgtacgcggacgatacagcagggtgggacactcgcattaccctggaagacctcaaaaatgaggaaatggtcacgaaccatatgaagggagagcacaaaaagctggccgaggctatctttaagttgacctatcagaataaagtggtgcgagtccagcggccaacacctagaggcactgttatggatattataagcaggcgcgaccagagaggttctgggcaagtgggaacctacggcctgaacacattcactaatatggaagcccagctcatccggcagatggagggcgaagggattttcaagtcaatccaacatcttaccgcaacggaggagatcgctgtacagaactggctggccagggtgggacgtgaacgattaagtcgcatggctatttccggtgatgactgcgtcgtgaaacccatagatgacagatttgccagcgcactgacagcgttgaatgatatgggcaaggttcggaaagacatccagcagtgggagccatctagggggtggaacgattggacccaagtgcccttctgctcgcaccactttcatgaactcgtcatgaaggacggacgcgtgctggtagttccttgtagaaaccaggatgagctaattggccgggccaggatctcacagggtgctgggtggagccttaaggaaactgcctgcctgggaaaatcctatgcacagatgtggacactcatgtacttccaccgacgtgacctgagattggctgccaatgcaatttgtagtgccgtgccatctcattgggtcccgaccagccgcactacctggtccatccacgcgaagcacgagtggatgacaacggaggatatgttagctgtgtggaaccgggtgtggatacaagaaaatccctggatggaggacaaaacccctgtcgaatcatgggaggaagttccatatctgggcaagagggaggaccagtggtgcggcagtctcatcgggcttacttctagagccacatgggccaaaaacattcagaccgccatcaatcaggtgcgcagcctgattggaaacgaggaatacactgattatatgccctccatgaagcggtttaggcgagaggaagaggaagctggtgtactatggtga

SEQ ID NO: 15038 - RNA, 9876 nt, synthetic construct
  misc_feature 1..9876: note = derived and/or modified CDS sequence (opt3) from DENV-2__HQ332185__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgcagcctgagaacctcgaatacaccatagtcatcactccacacagcggtgaggagcatgctgttggcaatgacacggggaagcacggaaaagaaattaagatcacaccgcagtcctcaataaccgaggccgaactgactggctatggtaccgtgacaatggagtgtagtcccaggaccgggcttgatttcaacgaaatggtactgttgcaaatggaggacaaagcatggctcgtgcaccggcagtggtttctggatttacctctgccatggctccccggcgctgacactcagggaagcaattggattcagaaggagacacttgtcacgttcaagaaccctcatgccaaaaagcaagacgtggttgtgctgggctctcaggaaggggcgatgcacaccgccttgactggagcaacagagatccagatgtcctcaggtaatctactgtttaccggccatctcaaatgccgtctgcgcatggataagcttcaactgaaagggatgagctacagtatgtgtacaggaaagttcaagatcgtcaaagaaattgctgagactcagcacggcaccatcgtgattagaatacagtatgagggtgacgggtctccatgcaagatccccttcgaaattacggatttggagaaaaggcatgtactcggccggctgatcaccgttaacccgatcgtgattgaaaaggactcccctgtcaacatagaggccgaacccccatttggagatagctacatcattatcggcgtggagcctgggcagttaaaactgaattggttcaagaagggatcgtctattggtcaaatgtttgagacaactatgcgaggcgctaaacgcatggccatcctaggggacaccgcatgggatttcggatccctcggcggtgtctttacatcaatagggaaggccctgcaccaggtgttcggcgctatctacggagcggcatttagtggcgttagctggactatgaaaattcttatcggggtggtaattacctggatcggaatgaactccagatctacgagcttgtcagtcagtctggtgctcgttggcgtggtcacactgtatcttggtgccatggtgcaggctgactccgggtgtgtagtgagctggaagataaaagaactgaagtgcggatctggcattttcatcaccgataatgttcacacttggacagagcagtacaagtttcaacccgaatcaccaagtaaattggccagcgcaattcagaaggcccatgaggaaggtatctgtggcataaggtccgtcacccggctcgagaacctgatgtggaaacagatcactcccgagttaaatcacattctgtctgaaaacgaggtgaagctaaccatcatgacaggggacacgaaaggaattatgcaggctggcaagcgctcgctcagacctcaaccaaccgaactgaaatatagctggaagacttgggggaaggccaaaatgctttccacagagtcacataatcagaccttcttgatcgatggaccggaaacagcagagtgccccaacactaatagggcgtggaacagtctggaggtggaagactacggctttggtgtcttcaccacgaatatatggctcaagctgcgtgagaaacaggacgttttttgtgattctaagttaatgagcgctgccattaaaaacaatcgggcagtgcacgccgacatggggtattggatcgaatccgctctgaacgatacatggaagatggagaaggcctcattcatcgaggtgaaaagctgccactggcctaagtctcataccctttggtccaatggagtattggaaagtgagatgattatcccaaaaaacttcgcaggccccgtcagccagcacaactaccgacctggttatcatactcaaaccgctggcccatggcacctcgggaagctggaaatggactttgatttctgtgagggaacaactgtggttgtgaccgaagactgcggcaatagagggccctctctaaggacaacgaccgcctccggaaaactgattactgagtggtgctgtcgctcatgcacactcccgcctctgcggtacagaggcgaggatggttgttggtacgggatggaaataaggccacttaaggagaaggaagagaacttggtcaatagtctggtgaccgcgggacatggccagatcgacaactttagcttaggtgttctcggcatggccctgttccttgaagagatgctgcgcactcgagtggggacaaaacacgctattttgctcgtagcagtctcgtttgtgaccctgatcacgggaaatatgtccttccgggatctaggccgtgtgatggtcatggttggggccactatgaccgacgatattggaatgggcgtgacatatctggctctcctggccgcatttaaggtaagacccaccttcgcggccggtcttttgctgaggaaattaacttctaaggagctcatgatggctacaatcgggataaccctgcttagccagtcaacaatccctgaaactattctggagctaaccgacgccctcgcactgggaatgatggtgttgaaaatcgtccgcaacatggaaaagtaccaactggctgtgacgattatggccatcagttgcgttcccaatgcagtgatattacggaacgcctggaaggtctcctgtacaattctcgctgcggtgtctgttagcccactgcttctgacctcctcacagcagaaagccgattggatccctttggcactcactatcaagggcctgaatcccaccgctatttttctaacaactctgagcagaaccagtaaaaagaggtcttggccacttaacgaggccataatggccgtgggcatggtctccatcctcgctagctcgctgttgaaaaatgacattccgatgacggggcctctggtagcaggaggtttactcacagtgtgctatgttctgaccggccgatcagccgaccttgaactggagcgcgcggctgatgtgaagtgggaggaccaggccgaaatctctgggagttcccccattttgagcatcactatatctgaggatggaagcatgtccatcaaaaacgaagaggaggaacaaacactcaccattctgatccggactggcctactggtcatttcaggtgtgttcccagtaagtatccccataacagcagccgcttggtacctttgggaggtgaagaagcagagagcaggggtcctctgggacgttcctagcccaccccctgtgggaaaagccgaactggaggatggcgcgtataggattaagcagcgtggcatcttggggtactctcagatcggagctggtgtgtataaagaaggcacctttcacacgatgtggcatgtcactcgcggggccgtgttaatgcaccggggaaagagaattgagccgtcctgggcagacgttaaaaaggatctgatctcatacggcggtgggtggaagctcgagggagaatggaaagagggcgaagaggtacaagtgctggcccttgaaccaggcaagaatcccagggctgtccagaccaaacctgggatattcaagacaaacaccggaacaattggtgccgtgagtctggactttagcccaggcacttccgggtctcccatcgttgatcgaaaaggaaaggtggtcggcttgtacggtaatggggtggtaacccggtcgggagcatatgtcagcgctattgcccagacggagaagtcaatcgaggacaaccctgaaatagaggatgacattttccgcaaaaagagactaacaatcatggatctgcatccgggcgcgggcaaaactaagaggtacctccccgccatcgtgcgggaagcaattaaacgagggctgagaacccttatcttagctccaacacgcgttgtggccgctgagatggaagaggcactgaggggactccctattcgttatcagacccccgccataaaggccgagcacactggtcgggaaatcgtcgacttgatgtgtcatgctaccttcacaatgagactgctctccccagtgagggttcctaactacaatctgattatcatggacgaggcgcactttacggatcccgcaagtatcgccgctcgcggctatatttctactcgagtggaaatgggggaggccgcaggaatattcatgaccgccacaccaccgggcagcagagacccttttccccaatccaacgctccaatcatggatgaggaacgggagattcccgaaaggtcatggaattctggtcacgagtgggtcaccgacttcaaggggaaaactgtgtggtttgtacctagcatcaaggcgggaaacgatattgccgcatgccttcgcaaaaatggcaagaaagtgatccagctgagtcgtaagacattcgactccgaatacgttaagaccagagctaacgattgggactttgtcgtgacgactgatataagcgagatgggcgccaatttcaaagcagagcgggtgatcgacccaaggcgctgtatgaagcccgtcattttgacagatggggaagagcgagtaatcctagccggacctatgccggtgacccattcttcagctgcccagagacggggtaggattggccgcaacccaaaaaatgaaaacgaccaatatatctacatgggggagcccctggaaaatgacgaggattgcgcgcactggaaggaggcaaaaatgctcttagacaacataaatacccctgaaggaattatcccctccatgtttgagccagaaagagagaaggttgatgccattgacggcgaatacaggctgcggggtgaggctcgtaaaactttcgtggatcttatgcgccgaggggacctgcctgtctggctcgcctataaggtggctgcagagggcatcaactacgccgatagaaagtggtgttttgacggaataaaaaataaccagatcttggaagagaacgttgaagtggagatttggacaaaggagggcgaaaggaaaaagctgaaaccccggtggctcgatgctcgcatctatagtgacccactggcccttaaggagttcaaggaattcgcagcggggagaaaaagcctaaccctgaatttgattacagagatgggaaggttacctacttttatgacgcagaaggcccggaacgctctggataatctcgccgtcctgcataccgcagaagctggtggccgagcctacaaccacgcactttcggagctgccggagacactcgaaactttgctgctactgaccctccttgccacagtgaccgggggaatcttcctgtttttaatgtctggcaaaggtatagggaagatgactttgggcatgtgctgcattatcacggcttccgtactgctctggtatgcgcagatccaaccccactggattgccgcaagcatcatactggagttctttcttattgtgctgctcatcccagaacctgagaaacagagaaccccccaggacaatcagttgacatacgttgtcattgctatcctgactgtggtggccgccaccatggcaaacgaaatgggattcttagagaagacaaagaaagatctaggcctggggtcaataaccactcaagagagtgaatctaatatcctcgacattgaccttcgcccagcttccgcctggacactgtatgcggtcgctacgacctttgttactcctatgttgaggcatagcatcgagaactcaagtgtgaatgtaagcctgacagccattgcaaaccaggccaccgtgctcatgggactgggtaagggctggcccctttccaaaatggatatcggggtcccgctcctggctattggatgttactctcaggtgaatccaatcaccttgacagcagccctgttactactggttgcgcactacgctataattggccctggtctccaggccaaggcaactcgggaagcccaaaaacgtgctgccgcagggatcatgaagaaccccacggtggacggcatcaccgtcattgatcttgagccaataccctatgaccctaagttcgaaaaacagctgggacaggtaatgttgctgatcctctgcgtgacacaggttctgatgatgagaactacctgggctctttgtgaggccttaacactggcgaccggcccgattagcactctctgggaggggaatcccggaaggttttggaacacgacaatcgccgtgtccatggcaaatattttccgcggctcatacttggctggtgccgggctgctattttctatcatgaagaacaccactaatacccggcgaggaacaggcaacataggtgaaactctgggcgagaaatggaagagtagactcaacgcacttgggaaatcggaattccaaatctataagaaaagcggaattcaggaggtcgataggaccctggctaaggagggcatcaagcgcggggaaacagaccatcacgccgtgtcccggggatctgccaaattgagatggtttgtcgagcgtaatatggtgacgccagaaggcaaggttgtggatctgggttgcgggaggggaggctggtcatactattgtggtggcctcaaaaacgtacgggaggtgaaggggctgaccaaaggaggccctgggcatgaagagcccattcctatgagcacttacggatggaatttagtccgccttcagtccggcgttgacgtgttcttcacaccacccgagaagtgcgataccctgctctgtgacatcggtgaaagttctcctaacccaactatagaggcggggcgaacactaagagtcctgaatttggtggaaaactggctgaataacaatacccaattttgcattaaggtactcaacccctatatgccgagcgtgatcgagaaaatggaaacgcttcagaggaagtacggaggcgctctggttcggaatcctttgtcacgcaactccacccacgagatgtactgggtgagtaatgcaacaggcaacatcgtcagctctgtgaatatgatttccagaatgctgataaacaggttcactatgaaacacaagaaagccacctatgagccagatgtcgacctcgggtcaggaacacgaaacatcggtattgaaagcgagatccccaatttagatattatcggcaagcggatagaaaagatcaaacaggagcatgaaacttcgtggcactacgaccaggaccatccttataagacctgggcttaccacgggtcttatgagacaaaacaaaccggaagtgcctccagcatggtgaacggcgttgtacgtctgcttactaagccatgggatgtggtccccatggtgacgcagatggcaatgacagacaccactccgtttggtcagcagagagttttcaaagagaaggtggatacccgcacacaagaacctaaggaggggacgaaaaagctgatgaggattaccgccgaatggctatggaaagagctcggaaagaaaaagactccccggatgtgtacaagagaggaatttacccgcaaagtcaggtcaaatgctgcgctgggcgccatcttcactgacgagaacaagtggaagtccgcacgagaagctgtggaggatggccggttttgggaattggtagacaaagagagaaatctgcacctcgaggggaagtgcgaaacatgtgtgtacaacatgatgggaaaaagggagaagaaacttggtgaattcggcaaggccaaggggtctcgcgcaatttggtatatgtggctgggagcccgttttttagagttcgaagctctgggctttttgaatgaggatcattggttcagccggggtaacagtctctccggggttgagggagaaggcctgcacagactaggctacatccttagggacgtcgggaaaaaggagggaggtgccatgtacgcggatgacaccgcaggctgggatacacgcattactctggaagacctcaaaaatgaggaaatggtgaccaaccatatgaagggggagcacaaaaagctggccgaggctatatttaagttgacgtatcagaataaagtggtccgagttcagcggccaacccctagaggaacagtgatggacatcattagcaggcgcgatcagagaggctctggtcaagtagggacttacggactgaacaccttcacaaatatggaagcccagctcatccggcagatggagggcgaaggcatcttcaagtcaattcaacatcttactgcaaccgaggagatagctgtgcagaactggctggccagggtcgggcgtgaacgattaagtcgcatggctatctccggagacgattgcgtggttaaacccattgacgatagatttgccagcgcactgacggcgttgaatgacatgggtaaggtgcggaaagatatccagcagtgggagccatctaggggctggaacgactggacacaagtccccttctgctcgcaccactttcatgaactcgtgatgaaggatgggcgcgtactggttgtgccttgtagaaaccaggacgagctaattggacgggccaggatctcacagggcgctggttggagccttaaggaaaccgcctgcctggggaaatcctatgcacagatgtggactctcatgtacttccaccgacgtgatctgagattggctgccaatgcaatatgtagtgccgtcccatctcattgggtgccgacaagccgcaccacttggtccatccacgcgaagcacgagtggatgaccacagaggacatgttagctgtgtggaaccgggtctggattcaagaaaatccctggatggaggataaaacgcctgttgaatcatgggaggaagtgccatatctgggaaagagggaggaccagtggtgcggcagtctcatcggccttacctctagagccacttgggcaaaaaacattcagacagccatcaatcaggtacgcagcctgatagggaacgaggaatacaccgactatatgccctccatgaagcggtttaggcgagaggaagaggaagctggagtgctatggtga

SEQ ID NO: 15039 - RNA, 9876 nt, synthetic construct
  misc_feature 1..9876: note = derived and/or modified CDS sequence (opt3) from DENV-2__HQ332186__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataagcttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgatcgaaaaggactcccctgtcaacatcgaggccgaacccccatttggagatagctacattataatcggcgtggagcctgggcagttaaaactgaattggttcaagaagggatcgtctattggtcaaatgtttgagacaactatgcgaggcgctaaacgcatggccatcctaggggacaccgcatgggatttcggatccctcggcggtgtttttacatcaattgggaaggccctgcaccaggtgttcggcgctatctacggagcggcatttagtggcgtaagctggactatgaaaatacttatcggggtcgtgattacctggatcggaatgaactccagatctacgagcttgtcagttagtctggtgctcgtcggcgtggtaacactgtatcttggtgccatggtgcaggctgactccgggtgtgttgtcagctggaagaataaagaactgaagtgcggatctggcattttcatcaccgataacgtgcacacttggacagagcagtacaagtttcaacccgaatcaccaagtaaattggccagcgcaatacagaaggcccatgaggaaggtatttgtggcatcaggtccgtgacccggctcgagaatctgatgtggaaacagattactcccgagttaaaccacatcctgtctgaaaatgaggtcaagctaaccataatgacaggggacacgaaaggaatcatgcaggctggcaagcgctcgctcagacctcaaccaaccgaactgaaatatagctggaagacttgggggaaggccaaaatgctttccacagagtcacataaccagaccttcttgattgatggaccggaaacagcagagtgccccaatactaacagggcgtggaatagtctggaggttgaagactacggctttggtgtgttcaccacgaacatctggctcaagctgcgtgagaaacaggacgtgttttgtgattctaagttaatgagcgctgccattaaagacaatcgggcagtacacgccgatatggggtattggatcgaatccgctctgaacgacacatggaagatggagaaggcctcattcatagaggtcaaaagctgccactggcctaagtctcataccttctggtccaatggagtgcttgaaagtgagatgattatcccaaaaaactttgcaggccccgttagccagcacaactaccgacctggttatcatactcaaatcgctggcccatggcacttggggaagctcgaaatggatttcgacttttgtgagggaaccacagtggtcgtgactgaagattgcggcaatagagggccctctctgaggaccacaacggcctccggaaaactaattaccgagtggtgctgtcgctcatgcactctgccgcctctccggtacagaggcgaggacggttgttggtacgggatggaaatcaggccactgaaggagaaggaagagaaccttgttaatagtttggtgacagcgggacatggccagattgataacttcagcctgggtgtattaggcatggccctctttctggaagagatgcttcgcacccgagtcgggactaaacacgctatactgttggtggcagtgtcgttcgtcacactcatcaccggaaatatgtcctttcgggacctgggccgtgttatggtgatggtaggggccacgatgactgatgacattggaatgggcgtgacctatctagctctgctcgccgcattcaaggtcagacccacatttgcggccggtctgcttttgaggaaactgacctctaaggagttaatgatggctactatcgggattacactcctgagccagtcaaccatccctgaaacaatacttgagctgactgatgccctagcactcggaatgatggtgctgaaaatcgttcgcaacatggaaaagtaccaattggctgtgaccattatggccatcagttgcgtccccaatgcagtgattctgcggaacgcctggaaggtttcctgtacgatcttagctgcggtgtctgtcagcccactcctgcttacatcctcacagcagaaagccgactggatacctctggcattgaccattaagggcctcaatcccactgctatcttcctgaccacactaagcagaactagtaaaaagaggtcttggccactgaacgaggccatcatggccgtaggcatggtgtccattcttgctagctcgctcctgaaaaatgacataccgatgaccgggcctttggttgcaggaggtctgttaacggtgtgctatgtcctcacaggccgatcagccgatctggaacttgagcgcgcggctgacgtgaagtgggaggatcaggccgaaatctctgggagttcccccattctgagcatcaccatttctgaggacggaagcatgtccatcaaaaacgaagaggaggaacaaactttgacaatactcatccggaccggcctgctagtaatttcaggtgtgtttccagtcagtatccccattactgcagccgcttggtacctgtgggaggttaagaagcagagagcaggggtgctttgggatgtgcctagcccaccccctgtcggaaaagccgaactcgaggacggcgcgtataggatcaagcagcgtggcatactggggtactctcagattggagctggtgtgtataaagaaggcacattccacaccatgtggcatgttacgcgcggggccgtattgatgcaccggggaaagagaatcgagccgtcctgggcagatgtgaaaaaggacttaatctcatacggcggtgggtggaagctggagggagaatggaaagagggcgaagaggtccaagtgctcgccctggaaccaggcaagaatcccagggctgttcagactaaacctgggatttttaagaccaacacaggaaccatcggtgccgtgagtcttgatttcagcccaggcacatccgggtctcccatagtcgaccgaaaaggaaaggtggtaggcctgtacggtaatggggtcgtgactcggtcgggagcatatgttagcgctattgcccagaccgagaagtcaatcgaggataaccctgaaattgaggacgatatcttccgcaaaaagagattgacgataatggacctacatccgggcgcgggcaaaacaaagaggtacctgcccgccattgtgcgggaagcaatcaaacgagggctcagaactctgatccttgctccaacccgcgtcgtggccgctgagatggaagaggcattaaggggactgcctattcgttatcagacacccgccatcaaggccgagcacaccggtcgggaaattgttgacctcatgtgtcatgctacttttaccatgagattgctgtccccagtgagggtccctaactacaatctcataatcatggatgaggcgcacttcacagaccccgcaagtattgccgctcgcggctatatctctacgcgagtggaaatgggggaggccgcaggaatctttatgactgccaccccaccgggcagcagagatcctttcccccaatccaacgctccaattatggacgaggaacgggagatacccgaaaggtcatggaattctggtcacgagtgggtaacagattttaaggggaaaaccgtgtggttcgttcctagcatcaaggcgggaaacgacattgccgcatgcctgcgcaaaaatggcaagaaagtcatccagcttagtcgtaagacttttgattccgaatacgtgaagacaagagctaacgactgggatttcgtggtcaccacggacattagcgagatgggcgccaattttaaagcagagcgggtaatcgatccaaggcgctgtatgaagcccgtgatactgactgacggggaagagcgagttatcttggccggacctatgccggtgacacattcttcagctgcccagagacggggtaggattggccgcaacccaaaaaatgaaaacgaccaatatatctacatgggggagcccctagaaaatgatgaggactgcgcgcactggaaggaggcaaaaatgctgctcgataacattaatacccctgaaggaatcataccctccatgttcgagccagaaagagagaaggtcgacgccattgatggcgaatacaggttacggggtgaggctcgtaaaacctttgtggacctgatgcgccgaggggatcttcctgtttggctggcctataaggtggctgcagagggcatcaactacgccgacagaaagtggtgtttcgatggaattaaaaataaccagatcctcgaagagaacgtcgaagtggagatatggactaaggagggcgaaaggaaaaagttgaaaccccggtggctggacgctcgcatctatagtgatccactcgccctgaaggagttcaaggaatttgcagcggggagaaaaagccttacactaaatctgattaccgagatgggaaggttgcctacattcatgactcagaaggcccggaacgctttagacaatctggccgtactccatacggcagaagctggtggccgagcctacaaccacgcactgtcggagcttccggagaccctggaaacactcttgctgctaactctgctcgccaccgtgacagggggaatctttcttttcctgatgtctggcaaaggtattgggaagatgaccttaggcatgtgctgcatcataactgcttccgttttgctgtggtatgcgcagattcaaccccactggatcgccgcaagcatcattctcgagtttttcctgatcgtccttctgataccagaacctgagaaacagagaacgccccaggataatcagctcacctacgtggtgattgctatcttgacagtcgttgccgccactatggcaaacgaaatgggatttctggagaagaccaagaaagacttaggcctagggtcaattacaacccaagagccagaaagtaatatcctggacatagatctccgccctgcttctgcctggactctttatgcggtggctacaacgttcgtaacccccatgctgaggcattccatcgagaacagctcagtgaatgtcagtttgactgccattgcaaaccaggccacagtgctgatgggactcggtaagggctggccgctgagcaaaatggacatcggggttccacttctcgctattggatgttactcccaggtgaatcctatcaccctgaccgcagccttgctgttactagtcgcgcactacgctattatcggccccggtctgcaggccaaggcaacacgggaagcccaaaaacgtgctgccgcagggataatgaagaacccaactgtagatggcattacggtgatcgacctcgagcccatcccttatgatccgaagtttgaaaaacagcttggacaggttatgctgttgattctgtgcgtgacccaggtcctcatgatgagaacaacttgggctctgtgtgaggcccttaccttagcgacaggccccatatctaccctgtgggaggggaatccaggaaggttctggaacactacgatcgccgtgagcatggcaaatatttttcgcggctcctacctcgctggtgccgggttgctgttctcaatcatgaagaacacaaccaatactcggcgaggaaccggcaacattggtgaaacactaggcgagaaatggaagtctagactgaacgcactcgggaaaagtgaatttcaaatctataagaaatcgggaatacaggaggtcgacaggactcttgctaaggagggcatcaagcgcggggaaaccgatcatcacgccgtgagccggggatccgccaaactgagatggttcgttgagcgtaatatggtgacacctgaaggcaaggtagtggacttgggttgcgggaggggaggctggtcttactattgtggtggcctgaaaaacgtccgggaggttaaggggctcacgaaaggaggccccgggcatgaagagcctattccaatgtcaacctacggatggaatctggtgcgcttacagagcggcgtcgatgtgttctttactccccctgagaagtgcgacacacttctgtgtgatatcggtgaatccagtccaaaccccaccattgaggcggggcgaactctcagagtactaaatctggtggaaaactggttgaataacaatacacaattctgcatcaaggttctgaacccgtatatgccttctgtgatagagaaaatggaaaccctccagaggaagtacggaggcgctcttgtccggaatccactgagccgcaactcaacgcacgagatgtactgggtgtccaatgcaaccggcaacattgtcagtagcgtgaatatgatctctagaatgttgatcaacaggtttacaatgaaacacaagaaagccacttatgagcccgacgttgatctggggtccggaacccgaaacattggtatagaatcagagatccctaatctcgacattatcggcaagcggattgaaaagatcaaacaggagcatgaaacaagctggcactacgaccaggatcatacttataagacctgggcttaccacgggtcgtatgagacaaaacaaaccggatctgccagttccatggtaaacggcgtggtccgtttactgactaagccatgggacgtggttcccatggtgacgcagatggcaatgacagataccactccgttcggtcagcagagagtctttaaagagaaggtggacacccgcacacaagaacctaaggaggggacgaaaaagcttatgaggataaccgccgaatggctgtggaaagagctaggaaagaaaaagactccccggatgtgtacaagagaggaattcacccgcaaagtaaggagcaatgctgcgctcggcgccatctttactgatgagaacaagtggaagtcagcacgagaagctgtggaggacggccggttctgggaactggttgatagagagaggaatttgcacctggaggggaaatgcgaaacatgtgtctacaacatgatgggaaagcgcgagaaaaagctcggtgaatttggcaaagccaaggggtcccgtgcaatttggtatatgtggcttggagcccggttcctggagtttgaagctttaggcttcctgaatgaggaccattggttttctagaggtaacagcttgagtggggtggagggagaaggcctccacaggctgggctacatcctacgcgatgtggggaagaaagagggaggtgccatgtacgcggacgataccgcaggctgggacacacgaattactcttgaagacctgaagaatgaggaaatggtcaccaaccatatgaaaggggagcacaagaaactcgccgaggctatcttcaagctgacgtatcagaataaggttgtgcgggtacagagaccaacccctaggggaacagtgatggatattatatcccgcagagaccagcggggcagcggtcaagtcgggacttacggattgaacaccttcacaaatatggaagcccagctgatcaggcagatggagggcgaaggcatttttaaatctatccaacatctcactgtgaccgaggagatcgcagttcagaactggcttgctcgtgtggggcgagaacgcctgtcaagaatggccattagtggagatgactgcgtcgtgaagcccatagatgaccggttcgcttccgccttaacggcactgaatgatatgggtaaagtaaggaaggacatccagcagtgggagccaagccgcggctggaacgattggacacaagttcccttttgctctcaccacttccatgaattggtgatgaaagacgggagagtcctcgtggtgccttgtcggaaccaggatgagctgattggaagggcgcgaatctcgcagggcgccggttggtcactaaaggaaaccgcttgccttgggaagagctatgcccagatgtggactctgatgtactttcaccgtagagacctccgcctggcagctaatgccatttgttccgcagtcccaagtcattgggttccgacatctcggaccacttggagcatccacgccaaacacgagtggatgaccacagaggatatgttggcggtgtggaacagggtatggatacaagaaaatccctggatggaggacaagacgcctgtggaatcctgggaggaagtcccatatttaggaaaaagagaggaccagtggtgcggctcactgatcggcctcaccagtcgcgctacttgggccaagaacattcagacagcaatcaatcaggtgcggtctcttattgggaacgaggaatacaccgattatatgcccagcatgaaaaggttccgaagagaggaagaggaagccggagttctgtggtga

SEQ ID NO: 15040 - RNA, 9876 nt, synthetic construct
  misc_feature 1..9876: note = derived and/or modified CDS sequence (opt3) from DENV-2__HQ332187__SS-prME
  source 1..9876: mol_type = other RNA
accgcaggcgtgataattatgctgatacccacagctatggcattccacctcactacgcgtaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagttgcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtcctcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttatctgcaagcattctatggtggatagaggctggggtaacgggtgtggactattcggcaagggcgggattgtaacctgcgccatgtttacatgcaaaaagaatatggaaggaaaagtggtgcagcctgagaacctcgaatacaccatagtcatcactccacacagcggtgaggagcatgctgttggcaatgacacggggaagcacggaaaagaaattaagatcacaccgcagtcctcaataaccgaggccgaactgactggctatggtaccgtgacaatggagtgtagtcccaggaccgggcttgatttcaacgaaatggtactgttgcaaatggaggacaaagcatggctcgtgcaccggcagtggtttctggatttacctctgccatggctccccggcgctgacactcagggaagcaattggattcagaaggagacacttgtcacgttcaagaaccctcatgccaaaaagcaagacgtggttgtgctgggctctcaggaaggggcgatgcacaccgccttgactggagcaacagagatccagatgtcctcaggtaatctactgtttaccggccatctcaaatgccgtctgcgcatggataaacttcaactgaaagggatgagctacagtatgtgtacaggaaagttcaagatcgtcaaagaaattgctgagactcagcacggcaccatcgtgattagaatacagtatgagggtgacgggtctccatgcaagatccccttcgaaattacggatttggagaaaaggcatgtactcggccggctgatcaccgttaacccgatcgtgattgaaaaggactcccctgtcaacatagaggccgaacccccatttggagatagctacatcattatcggcgtggagcctgggcagttaaaactgaattggttcaagaagggatcgtctattggtcaaatgtttgagacaactatgcgaggcgctaaacgcatggccatcctaggggacaccgcatgggatttcggatccctcggcggtgtctttacatcaatagggaaggccctgcaccaggtgttcggcgctatctacggagcggcatttagtggcgttagctggactatgaaaattcttatcggggtggtaattacctggatcggaatgaactccagatctacgagcttgtcagtcagtctggtgctcgttggcgtggtcacactgtatcttggtgccatggtgcaggctgactccgggtgtgtagtgagctggaagaataaagaactgaagtgcggatctggcatattcattaccgataacgttcacacttggacagagcagtacaagtttcaacccgaatcaccaagtaaattggccagcgcaatccagaaggcccatgaggaaggtatttgtggcatcaggtccgtcacccggctcgagaatctgatgtggaaacagataactcccgagttaaaccacatcctgtctgaaaatgaggtgaagctaaccattatgacaggggacacgaaaggaatcatgcaggctggcaagcgctcgctcagacctcaaccaaccgaactgaaatatagctggaagacttgggggaaggccaaaatgctttccacagagtcacataaccagaccttcttgattgatggaccggaaacagcagagtgccccaatactaacagggcgtggaatagtctggaggtggaagactacggctttggtgtcttcaccacgaacatctggctcaagctgcgtgagaaacaggacgtattttgtgattctaagttaatgagcgctgccataaaagacaatcgggcagtgcacgccgatatggggtattggattgaatccgctctgaacgacacatggaagatggagaaggcctcattcatcgaggtgaaaagctgccactggcctaagtctcataccctttggtccaatggagtattggaaagtgagatgatcattcccaagaatttcgcaggccccgtcagccagcacaactaccgacctggttatcatactcaaaccgctggcccatggcacctcgggaagctggaaatggattttgacttctgtgagggaacaactgtggttgtgaccgaagattgcggcaatagagggccctctctaaggacaacgaccgcctccggaaaactgatcactgagtggtgctgtcgctcatgcacactcccgcctctgcggtacagaggcgaggacggttgttggtacgggatggaaattaggccacttaaggagaaggaagagaacttggtcaatagtctggtgaccgcgggacatggccagatagataactttagcttaggtgttctcggcatggccctgttccttgaagagatgctgcgcactcgagtggggacaaaacacgctatcttgctcgtagcagtctcgtttgtgaccctgattacgggaaatatgtccttccgggacctaggccgtgtgatggtcatggttggggccactatgaccgatgacatcggaatgggcgtgacatatctggctctcctggccgcatttaaggtaagacccaccttcgcggccggtcttttgctgaggaaattaacttctaaggagctcatgatggctacaattgggatcaccctgcttagccagtcaacaatacctgaaactatcctggagctaaccgatgccctcgcactgggaatgatgattttgaaaatcgtgcgcaacatggaaaagtaccaactggctgtcacgattatggccatcagttgcgtgcccaatgcagttatattacggaacgcctggaaggtgtcctgtacaattctcgctgcggtctctgtgagcccactgcttctgacctcctcacagcagaaagccgactggatccctttggcactcactatcaagggcctgaatcccaccgctatttttctaacaactctgagcagaaccagtaaaaagaggtcttggccacttaacgaggccataatggccgttggcatggtgtccatcctcgctagctcgctgttgaaaaatgacattccgatgacggggcctctggtcgcaggaggtttactcacagtatgctatgtgctgaccggccgatcagccgatcttgaactggagcgcgcggctgacgttaagtgggaggatcaggccgaaatctctgggagttcccccattttgagcatcactatatctgaggacggaagcatgtccatcaaaaacgaagaggaggaacaaacactcaccattctgatccggactggcctactggtgatttcaggtgtcttcccagtgagtatccccataacagcagccgcttggtacctttgggaggtaaagaagcagagagcaggggtgctctgggatgtccctagcccaccccctgttggaaaagccgaactggaggacggcgcgtataggattaagcagcgtggcatcttggggtactctcagatcggagctggtgtgtataaagaaggcacctttcacacgatgtggcatgtgactcgcggggccgtcttaatgcaccggggaaagagaattgagccgtcctgggcagatgtgaaaaaggacctgatctcatacggcggtgggtggaagctcgagggagaatggaaagagggcgaagaggttcaagtactggcccttgaaccaggcaagaatcccagggctgtgcagaccaaacctgggatattcaagacaaacaccggaacaattggtgccgtcagtctggattttagcccaggcacttccgggtctcccatcgtggaccgaaaaggaaaggttgtgggcttgtacggtaatggggtcgtgacccggtcgggagcatatgtaagcgctattgcccagacggagaagtcaatcgaggataaccctgaaatagaggacgatattttccgcaaaaagagactaacaatcatggacctgcatccgggcgcgggcaaaactaagaggtacctccccgtcatcgtgcgggaagccattaaacgagggctgagaacccttatcttagcaccaacacgcgttgtggctgccgagatggaagaggctctgaggggactccctattcgttatcagacccccgcaataaaggccgagcacactggtcgggaaatcgtcgacttgatgtgtcatgccaccttcacaatgagactgctctccccagtgagggttcctaactacaatctgattatcatggatgaggctcactttacggaccccgcgagtatcgcagcccgcggctatatttctactcgagtggaaatgggggaggctgccggaatattcatgaccgcaacaccaccgggcagcagagatccttttccccaatccaacgccccaatcatggacgaggaacgggagattcccgaaaggtcatggaactctggtcacgagtgggtcaccgatttcaaggggaaaactgtgtggtttgtacctagcatcaaggctggaaacgacattgcggcctgccttcgcaaaaatggcaagaaagtgatccagctgagtcgtaagacattcgattccgaatacgttaagaccagagcaaacgactgggattttgtcgtgacgactgacataagcgagatgggcgctaatttcaaagccgagcgggtgatcgatccaaggcgctgtatgaagcccgtcattttgacagacggggaagaacgagtaatcctagcaggacctatgccggtgacccattcttcagccgctcagagacggggtaggattggccgcaaccccaaaaatgaaaacgaccaatatatctacatgggggagcccctggaaaatgatgaggactgcgcccactggaaggaggcgaaaatgctcttagataacataaatacccctgaaggaattatcccctccatgtttgagccagaaagagagaaggttgacgcaattgatggcgaatacaggctgcggggtgaggcccgtaaaactttcgtggaccttatgcgccgaggggatctgcctgtctggctcgcttataaggtggccgctgagggcatcaactacgcagacagaaagtggtgttttgatggaatcaaaaataaccagatcttggaagagaacgttgaagtggagatttggacaaaggagggcgaaaggaaaaagctgaaaccccggtggctcgacgcccgcatctatagtgatccactggctcttaaggagttcaaggagttcgccgcagggagaaaaagcctaaccctgaatttgattacagagatgggaaggttacctacttttatgacgcagaaggcgcggaacgccctggacaatctcgctgtcctgcataccgccgaagctggtggacgagcatacaaccacgccctttcggagctgccggagacactcgaaactttgctgctactgaccctccttgcaacagtgaccgggggaatcttcctgtttttaatgtctggcaaaggtatagggaagatgactttgggcatgtgctgcattatcacggcctccgtactgctctggtatgctcagatccaaccccactggattgcggccagcatcatactggagttctttcttattgtgctgctcatcccagaacctgagaaacagagaaccccacaggataatcagttgacatacgttgtcattgcaatcctgactgtggtggctgccaccatggccaacgaaatgggattcttagagaagacaaagaaagacctaggcctggggtcaataaccactcaagagagtgaatctaatatcctcgacattgatcttcgcccagcatccgcttggacactgtatgccgtcgcgacgacctttgttactcctatgttgaggcatagcatcgagaactcaagtgtgaatgtaagcctgacagctattgccaaccaggcaaccgtgctcatgggactgggtaagggctggcccctttccaaaatggacatcggggtcccgctcctggccattggatgttactctcaggtgaatccaatcaccttgacagctgcactgttactactggttgcccactacgcgataattggccctggtctccaggctaaggccactcgggaagcacaaaaacgtgccgctgccgggatcatgaagaaccccacggtggatggcatcaccgtcattgaccttgagccaataccctatgatcctaagttcgaaaaacagctgggacaggtaatgttgctgatcctctgcgtgacacaggttctgatgatgagaactacctgggcactttgtgaggctttaacactggccaccggcccgattagcactctctgggaggggaatcccggaaggttttggaacacgacaatcgcggtgtccatggccaatattttccgcggctcatacttggccggtgctgggctgctattttctatcatgaagaacaccactaatacccggcgaggaacaggcaacataggtgaaactctgggcgagaaatggaagagtagactcaacgcccttgggaaatcggagttccaaatctataagaaaagcggtattcaggaggtcgacaggaccctggcaaaggagggcatcaagcgcggggaaacagatcatcacgctgtgtcccggggatctgccaaattgagatggtttgtcgagcgtaatatggtgacgccagaaggcaaggttgtggacctgggttgcgggaggggaggctggtcatactattgtggtggcctcaaaaacgtacgggaggtgaaggggctgaccaaaggaggccctgggcatgaagaaccaattcctatgagcacttacggatggaatttagtccgccttcagtccggcgttgatgtgttcttcacaccacccgagaagtgcgacaccctgctctgtgatatcggtgaaagttctcctaacccaactatagaggccgggcgaacactaagagtcctgaatttggtggaaaactggctgaataacaatacccaattttgcattaaggtactcaacccctatatgccgagcgtgatcgagaaaatggaaacgcttcagaggaagtacggaggcgcgctggttcggaatcctttgtcacgcaactccacccacgagatgtactgggtgagtaatgctacaggcaacatcgtcagctctgtgaatatgatttccagaatgctgataaacaggttcactatgaaacacaagaaagcaacctatgagccagacgtcgatctcgggtcaggaacacgaaacatcggtattgaaagcgagatccccaatttagacattatcggcaagcggatagaaaagatcaaacaggagcatgaaacttcgtggcactacgaccaggatcatccttataagacctgggcctaccacgggtcttatgagacaaaacaaaccggaagtgcttccagcatggtgaacggcgttgtacgtctgcttactaagccatgggacgtggtccccatggtgacgcagatggccatgacagataccactccgtttggtcagcagagagttttcaaagagaaggtggacacccgcacacaagaacctaaggaggggacgaaaaagctgatgaggattaccgcagaatggctatggaaagagctcggaaagaaaaagactccccggatgtgtacaagagaggaatttacccgcaaagtcaggtcaaatgccgctctgggcgcgatcttcactgatgagaacaagtggaagtccgcccgagaagcagtggaggacggccggtttggggaattggtagataaagagagaaatctgcacctcgagggaaagtgcgaaacatgtgtgtacaacatgatgggtaaaagggagaagaaacttggcgagttcgggaaggctaagggatctcgcgccatttggtatatgtggctgggcgcaagatttttagagttcgaagccctgggatttttgaatgaggaccattggttcagccgggggaacagtctctccggagttgagggcgaaggcctgcacagactagggtacatccttagggatgtcggcaaaaaggagggtggcgctatgtacgccgacgataccgcggggtgggacacacgcattactctggaagacctcaaaaatgaggaaatggtgaccaaccatatgaagggagagcacaaaaagctggcagaggccatatttaagttgacgtatcagaataaagtggtccgagttcagcggccaacccctagaggcacagtgatggatatcattagcaggcgcgaccagagaggttctgggcaagtaggaacttacggcctgaacaccttcacaaatatggaagctcagctcatccggcagatggagggcgaagggatcttcaagtcaattcaacatcttactgccaccgaggagatagcagtgcagaactggctggctagggtcggacgtgaacgattaagtcgcatggccatctccggtgatgactgcgtggttaaacccattgatgacagatttgctagcgccctgacggcattgaatgatatgggcaaggtgcggaaagacatccagcagtgggagccatctagggggtggaacgattggacacaagtccccttctgctcgcaccactttcatgaactcgtgatgaaggacggacgcgtactggttgtgccttgtagaaaccaggatgagctaattggccgggcgaggatctcacagggtgccgggtggagccttaaggaaaccgcttgcctgggaaaatcctatgcccagatgtggactctcatgtacttccaccgacgtgacctgagattggcagctaatgccatatgtagtgcagtcccatctcattgggtgccgacaagccgcaccacttggtccatccacgccaagcacgagtggatgaccacagaggatatgttagcggtgtggaaccgggtctggattcaagaaaatccctggatggaggacaaaacgcctgttgaatcatgggaggaagtgccatatctgggcaagagggaggaccagtggtgcggcagtctcatcgggcttacctctagagctacttgggccaaaaacattcagacagcaatcaatcaggtacgcagcctgataggaaacgaggaatacaccgattatatgccctccatgaagcggtttaggcgagaggaagaggaagccggtgtgctatggtga

SEQ ID NO: 15041 - RNA, 9876 nt, synthetic construct
  misc_feature 1..9876: note = derived and/or modified CDS sequence (opt3) from DENV-2__HQ332188__SS-prME
  source 1..9876: mol_type = other RNA
accgccggcgtgatcgtcatgctgattccaacagctatggcattccacctcactacgagaaacggggagcctcatatgatagttgggaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgatcgaaaaggactcccctgtcaacatcgaggccgaacccccatttggagatagctacattataatcggcgtggagcctgggcagttaaaactgaattggttcaagaagggatcgtctattggtcaaatgtttgagacaactatgcgaggcgctaaacgcatggccatcctaggggacaccgcatgggatttcggatccctcggcggtgtttttacatcaattgggaaggccctgcaccaggtgttcggcgctatctacggagcggcatttagtggcgtaagctggactatgaaaatacttatcggggtcgtgattacctggatcggaatgaactccagatctacgagcttgtcagttagtctggtgctcgtcggcgtggtaacactgtatcttggtgccatggtgcaggctgactccgggtgtgttgtcagctggaagaataaagaactgaagtgcggatctggcattttcatcaccgataacgtgcacacttggacagagcagtacaagtttcaacccgaatcaccaagtaaattggccagcgcaatacagaaggcccatgaggaaggtatttgtggcatcaggtccgtgacccggctcgagaatctgatgtggaaacagattactcccgagttaaaccacatcctgtctgaaaatgaggtcaagctaaccataatgacaggggacacgaaaggagttatgcaggctggcaagcgctcgctcagacctcaaccaaccgaactgaaatatagctggaagacttgggggaaggccaaaatgctttccacagagtcacataaccagaccttcttgatcgatggaccggaaacaactgagtgccccaataccaacagggcatggaatagtctggaggtggaagactacggctttggtgtgttcacgacaaacatttggctcaagctgcgtgagaaacaggacgtattttgtgattctaagttaatgagcgcggctatcaaagacaatcgggccgtccacgcagatatggggtattggattgaatccgccctgaacgacacctggaagatggagaaggcttcattcatcgaggtgaaaagctgccactggcctaagtctcatactctttggtccaatggagttttggaaagtgagatgataattcccaagaatttcgccggccccgtgagccagcacaactaccgacctggttatcatacccaaatcgcaggcccatggcacctcgggaagctggaaatggattttgacttctgtgagggaacaactgtcgtggttaccgaagattgcggcaatagagggccctctctaaggacaacgaccgcttccggaaaactgatcactgagtggtgctgtcgctcatgcacactcccgcctctgcggtacagaggcgaggacggttgttggtacgggatggaaattaggccacttaaggagaaggaagagaacttggtgaatagtctggtaaccgccggacatggccagatcgataactttagcttaggtgtcctcggcatggcgctgttccttgaagagatgctgcgcactcgagtggggacaaaacacgccattttgctcgtggctgtctcgtttgttaccctgataacgggaaatatgtccttccgggacctaggccgtgtgatggtaatggtgggggcaactatgaccgatgacatcggaatgggcgccacatatctggctctcctggccgcatttaaggtcagacccaccttcgcggccggtcttttgctgaggaaattaacttctaaggagctcatgatggctacaattgggatcaccctgcttagccagtcaacaattcctgaaactatcctggagctaaccgatgccctcgcactgggaatgatggtgttgaaaatagttcgcaacatggaaaagtaccaactggctgtgacgatcatggccattagttgcgtccccaatgcagtgatcttacggaacgcctggaaggtttcctgtacaattctcgctgcggtgtctgtcagcccactgcttctgacctcctcacagcagaaagccgactggatccctttggcactcactataaagggcctgaatcccaccgctatttttctaacaactctgagcagaaccagtaaaaagaggtcttggccacttaacgaggccatcatggccgtaggcatggtgtccatcctcgctagctcgctgttgaaaaatgacattccgatgacggggcctctggttgcaggaggtttactcacagtgtgctatgtcctgaccggccgatcagccgatcttgaactggagcgcgcggctgacgtgaagtgggaggatcaggccgaaatatctgggagttcccccatcttgagcattactatctctgaggacggaagcatgtccattaaaaacgaagaggaggaacaaacactcaccatcctgatacggactggcctactggtaatctcaggtgtgttcccagtcagtattcccatcacagcagccgcttggtacctttgggaggttaagaagcagagagcaggggtgctctgggatgtgcctagcccaccccctgtcggaaaagccgaactggaggacggcgcgtataggattaagcagcgtggcatcttggggtactctcagataggagctggtgtgtataaagaaggcacctttcacacgatgtggcatgttactcgcggggccgtattaatgcaccggggaaagagaattgagccgtcctgggcagatgtgaaaaaggacctgatctcatacggcggtgggtggaagctcgagggagaatggaaagagggcgaagagatccaagtcctggcccttgaaccaggcaagaatcccagggctgtgcagaccaaacctgggattttcaagacaaacaccggaacaatcggtgccgttagtctggattttagcccaggcacttccgggtctcccatagtggaccgaaaaggaaaggtcgtgggcttgtacggtaatggggtagtcacccggtcgggagcatatgtgagcgctattgcccagacggagaagtcaatcgaggataaccctgaaattgaggacgatatcttccgcaaaaagagactaacaataatggacctgcatccgggcgcgggcaaaactaagaggtacctccccgccattgttcgggaagcaatcaaacgagggctgagaacccttatcttagctccaacacgcgtggtcgccgctgagatggaagaggcactgaggggactccctattcgttatcagacccccgccatcaaggccgagcacactggtcgggaaattgtggacttgatgtgtcatgctaccttcacaatgagactgctctccccagttagggtgcctaactacaatctgataatcatggatgaggcgcactttacggaccccgcaagtattgccgctcgcggctatatctctactcgagtcgaaatgggggaggccgcaggaatcttcatgaccgccacaccaccgggcagcagagatccttttccccaatccaacgctccaattatggacgaggaacgggagatacccgaaaggtcatggaactctggtcacgagtgggtgaccgatttcaaggggaaaactgtatggtttgtgcctagcatcaaggcgggaaacgacattgccgcatgccttcgcaaaaatggcaagaaagttatccagctgagtcgtaagacattcgattccgaatacgtcaagaccagagctaacgactgggattttgtggtgacgactgacattagcgagatgggcgccaatttcaaagcagagcgggtcatcgatccaaggcgctgtatgaagcccgtaatattgacagacggggaagaacgagtgatcctagccggacctatgccggttacccattcttcagctgcccagagacggggtaggattggccgcaaccccaagaatgaaaacgaccaatatatctacatgggggagcccctggaaaatgatgaggactgcgcgcactggaaggaggcaaaaatgctcttagataacattaatacccctgaaggaatcataccctccatgtttgagccagaaagagagaaggtggacgccattgatggcgaatacaggctgcggggtgaggctcgtaaaactttcgtcgaccttatgcgccgaggggatctgcctgtgtggctcgcctataaggttgctgcagagggcatcaactacgccgacagaaagtggtgttttgatggaattaaaaataaccagatcttggaagagaacgtggaagtcgagatatggacaaaggagggcgaaaggaaaaagctgaaaccccggtggctcgacgctcgcatctatagtgatccactggcccttaaggagttcaaggagttcgcagcggggagaaaaagcctaaccctgaatttgattacagagatgggaaggttacctacttttatgacgcagaaggcccggaacgctctggacaatctcgccgtgctgcataccgcagaagctggtggccgagcctacaaccacgcactttcggagctgccggagacactcgaaactttgctgctactgaccctccttgccacagtaaccgggggaatcttcctgtttttaatgtctggcaaaggtattgggaagatgactttgggcatgtgctgcatcataacggcttccgtgctgctctggtatgcgcagattcaaccccactggatcgccgcaagcatcattctggagttctttcttatcgttctgctcataccagaacctgagaaacagagaaccccacaggataatcagttgacatacgtcgtgattgctatcctgactgtggtcgccgccaccatggcaaacgaaatgggattcttagagaagacaaagaaagacctaggcctggggtcaattaccactcaagagccagaaagtaatatcctcgacatagatcttcgccctgcttctgcctggacactgtatgcggttgctacgacctttgtgactcccatgttgaggcattccatcgagaacagctcagtaaatgtgagtctgacagccattgcaaaccaggccaccgtcctcatgggactgggtaagggctggccgcttagcaaaatggacatcggggtgccactcctggctattggatgttactcccaggttaatcctatcaccttgacagcagccctgttactactggtggcgcactacgctattatcggccccggtctccaggccaaggcaactcgggaagcccaaaaacgtgctgccgcagggataatgaagaacccaacggtcgatggcattaccgtaatcgaccttgagcccatcccttatgatccgaagttcgaaaaacagctgggacaggtgatgttgctgattctctgcgttacacaggtgctgatgatgagaactacctgggctctttgtgaggccttaacactggcgaccggccccatatctactctctgggaggggaatccaggaaggttttggaacacgacaatcgccgtcagcatggcaaatattttccgcggctcctacttggctggtgccgggctgctattttcaatcatgaagaacaccactaatacccggcgaggaacaggcaacattggtgaaactctgggcgagaaatggaagtctagactcaacgcacttgggaaaagtgagttccaaatctataagaaatcgggaatacaggaggtggacaggaccctggctaaggagggcatcaagcgcggggaaacagatcatcacgccgtcagccggggatccgccaaattgagatggtttgtggagcgtaatatggttacgcctgaaggcaaggtggtagacctgggttgcgggaggggaggctggtcttactattgtggtggcctcaaaaacgtgcgggaggtcaaggggctgaccaaaggaggccccgggcatgaagaacctattccaatgtcaacttacggatggaatttagttcgccttcagagcggcgtggatgtcttcttcacaccccctgagaagtgcgacaccctgctctgtgatatcggtgaatccagtccaaaccccactattgaggcggggcgaacactaagagtgctgaatttggtagaaaactggctgaataacaatacccaattttgcatcaaggtgctcaacccgtatatgccttctgttatagagaaaatggaaacgcttcagaggaagtacggaggcgctctggtgcggaatccattgagccgcaactcaacccacgagatgtactgggtctccaatgcaacaggcaacattgtgagtagcgtcaatatgatctctagaatgctgatcaacaggttcactatgaaacacaagaaagccacctatgagcccgacgtggatctcgggtccggaacacgaaacattggtatagaatcagagatccctaatttagacattatcggcaagcggattgaaaagatcaaacaggagcatgaaactagctggcactacgaccaggatcatccatataagacctgggcttaccacgggtcgtatgagacaaaacaaaccggatctgccagttccatggttaacggcgtagtgcgtctgcttactaagccctgggacgtcgtgccgatggttacgcagatggcaatgacagataccactccttttggtcagcagagagtgttcaaagagaaggtcgacacccgcacacaagaacccaaggaggggacgaaaaagctgatgaggataaccgccgaatggctatggaaagagctcggaaagaaaaagactccacggatgtgtacaagagaggaatttacccgcaaagtgaggagcaatgctgcgctgggcgccatcttcactgatgagaacaagtggaagtcagcacgagaagctgtagaggacggccggttttgggaattggtggatagagagaggaatctgcacctcgaggggaaatgcgaaacatgtgtttacaacatgatgggaaagcgcgagaagaaacttggtgagttcggcaaagccaaagggtcccgtgcaatttggtatatgtggctgggagcccggtttttagagttcgaagctctgggctttttgaatgaggaccattggttctctagaggtaacagcctcagtggggtcgagggagaaggcctgcacaggctaggctacatccttcgcgatgtggggaagaaagagggaggtgccatgtacgcggacgataccgcaggctgggacacacgaattactctggaagacctcaagaatgaggaaatggtgaccaaccatatgaaaggggagcacaagaaactggccgaggctatctttaagttgacgtatcagaataaggtcgttcgggtgcagagacctacccccaggggaacagtaatggatattatatcccgcagagaccagcggggcagcggtcaagtggggacttacggactgaacaccttcacaaatatggaagcccagctcatcaggcagatggagggcgaaggcattttcaaatctatccaacatcttactgtcaccgaggagatcgcagtgcagaactggctggctcgtgttgggcgagaacgcttatcaagaatggccattagtggagatgactgcgtggtcaagccaatagatgaccggtttgcttccgccctgacggcattgaatgatatgggtaaagtgaggaaggacatccagcagtgggagcccagccgcggctggaacgattggacacaagtacctttctgctctcaccactttcatgaactcgttatgaaagacgggagagtgctggtcgtgccatgtcggaaccaggatgagctaattggaagggcgcgaatctcgcagggcgccggttggtcacttaaggaaaccgcttgcctgggaaagagctatgcccagatgtggactctcatgtacttccaccgtagagacctgcgcttggcagctaatgccatttgttccgcagtgccgagtcattgggtccccacatctcggaccacttggagcatccacgccaaacacgagtggatgaccacagaggatatgttagcggtttggaacagggtgtggatacaagaaaatccttggatggaggacaagacgccagtagaatcctgggaggaagtgccctatctgggaaaaagagaggaccagtggtgcggctcactcatcggccttaccagtcgcgctacttgggccaagaacattcagacagcaatcaatcaggtccggtctctgattgggaacgaggaatacaccgattatatgcctagcatgaaaaggtttcgaagagaggaagaggaagccggagtgctatggtga

SEQ ID NO: 15042 - RNA, 9876 nt, synthetic construct
  misc_feature 1..9876: note = derived and/or modified CDS sequence (opt3) from DENV-2__HQ332189__SS-prME
  source 1..9876: mol_type = other RNA
accgccggagtgatcgtcatgctgattccaactgctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagaactggatcctgcggcatcctggcttcaccataatggccgcaatcttggcctacacaattggcaccacgcactttcagcgcgctctcatcttcattctgctgactgcagtggccccatccatgacaatgagatgcatcgggatatctaatagggattttgtcgaaggagtgtcgggtggctcatgggtagacattgttctcgagcacgggagctgtgtgaccactatggctaagaacaagcccacattagatttcgaactgatcaaaaccgaggccaagcagcctgcgacgcttcggaaatattgcattgaagcaaagttgaccaatacaactaccgagagtcgctgtccaacacaaggagagccctccctgaacgaggaacaggacaaacgatttatctgcaagcattctatggtcgatagaggctggggtaatgggtgtggactattcggcaagggcgggatcgtgacttgcgccatgtttacctgcaaaaagaacatggaaggaaaagtggtccagcctgagaatctcgaatacacaattgttataaccccacacagcggtgaggagcatgctgtgggcaacgacactgggaagcacggaaaagaaatcaagattacgccgcagtcctcaatcacagaggccgaactgaccggctatggtactgtaaccatggagtgtagtcccaggacagggcttgatttcaatgaaatggtgctgttgcaaatggaggacaaagcatggctcgtccaccggcagtggtttctggatttacctctgccatggctccccggcgctgacacccagggaagcaactggatacagaaggagactcttgtgacattcaagaatcctcatgccaaaaagcaagacgttgtggtcctgggctctcaggaaggggcgatgcacacggccttgaccggagcaactgagattcagatgtcctcaggtaacctactgtttacaggccatctcaaatgccgtctgcgcatggataaacttcaactgaaagggatgagctacagtatgtgtaccggaaagttcaagatcgtgaaagaaatcgctgagacacagcacggcactattgtaatcagagttcagtatgagggtgacgggtctccatgcaagattcccttcgaaataaccgatttggagaaaaggcatgtgctcggccggctgatcacggtcaacccgattgtgatcgaaaaggactcccctgtcaatatcgaggccgaacccccatttggagatagctacgtgattataggcgttgagcctgggcagttaaaactgaactggttcaagaagggatcgtctatcggtcaaatgtttgagaccacaatgcgaggcgctaaacgcatggccattctaggggacactgcatgggatttcggatccctcggcggtgtgtttacctcaatcgggaaggccctgcaccaggtattcggcgctatttacggagcggcatttagtggcgtcagctggacaatgaaaatccttataggggtggttatcacttggattggaatgaactccagatctaccagcttgtcagtgagtctggtcctcgtgggcgtagtgacgctgtatcttggtgccatggttcaggctgactccgggtgtgtcgtgagctggaagaacaaagaactgaagtgcggatctggcatcttcattacagataatgtgcacacctggactgagcagtacaagtttcaacccgaatcaccaagtaaattggccagcgcaatccagaaggcccatgaggaaggtatatgtggcattaggtccgtcacacggctcgagaacctgatgtggaaacagatcacccccgagttaaatcacattctgtctgaaaacgaggttaagctaactatcatgaccggggacacaaaaggaataatgcaggctggcaagcgctcgctcagacctcaaccaacggaactgaaatatagctggaagacctgggggaaggccaaaatgctttccactgagtcacataatcagacattcttgatcgatggaccggaaaccgcagagtgccccaacacaaatagggcgtggaacagtctggaggtggaagactacggctttggtgtgttcactaccaatatttggctcaagctgcgtgagaaacaggacgtattttgtgattctaagttaatgagcgctgccatcaaagacaaccgggcagtccacgccgatatggggtattggattgaatccgctctgaatgacacgtggaagatggagaaggcctcattcatcgaggtgaaaagctgccactggcctaagtctcatacactttggtccaacggagttttggaaagtgagatgataattcccaagaatttcgcaggccccgtgagccagcacaattaccgacctggttatcatacccaaactgctggcccatggcacctcgggaagctggaaatggattttgacttctgtgagggaaccacagtcgtggttactgaagattgcggcaacagagggccctctctaaggaccacaacggcctccggaaaactgatcaccgagtggtgctgtcgctcatgcactctcccgcctctgcggtacagaggcgaggacggttgttggtacgggatggaaatcaggccacttaaggagaaggaagagaatttggtgaacagtctggtaacagcgggacatggccagattgataattttagcttaggtgtcctcggcatggccctgttccttgaagagatgctgcgcacccgagtggggactaaacacgctatcttgctcgtggcagtctcgtttgttacactgattaccggaaacatgtccttccgggacctaggccgtgtgatggtaatggtgggggccacgatgactgatgacataggaatgggcgtcacctatctggctctcctggccgcatttaaggtgagacccacattcgcggccggtcttttgctgaggaaattaacctctaaggagctcatgatggctactatcgggattacactgcttagccagtcaaccatccctgaaacaattctggagctaactgatgccctcgcactgggaatgatggttttgaaaatcgtgcgcaatatggaaaagtaccaactggctgtcaccataatggccatcagttgcgtgcccaacgcagttattttacggaatgcctggaaggtgtcctgtacgatcctcgctgcggtctctgtaagcccactgcttctgacatcctcacagcagaaagccgactggattcctttggcactcaccatcaagggcctgaaccccactgctatatttctaaccacactgagcagaacaagtaaaaagaggtcttggccacttaatgaggccattatggccgtgggcatggtttccatcctcgctagctcgctgttgaaaaacgacatcccgatgaccgggcctctggtggcaggaggtttactcacggtctgctatgtgctgacaggccgatcagccgatcttgaactggagcgcgcggctgacgtaaagtgggaggatcaggccgaaatttctgggagttcccccatattgagcatcaccatttctgaggacggaagcatgtccatcaaaaatgaagaggaggaacaaactctcacaattctgatccggaccggcctactggtgatatcaggtgtcttcccagttagtatccccattactgcagccgcttggtacctttgggaggtgaagaagcagagagcaggggtgctctgggatgtccctagcccaccccctgtgggaaaagccgaactggaggacggcgcgtataggatcaagcagcgtggcattttggggtactctcagatcggagctggtgtttataaagaaggcacatttcacaccatgtggcatgtaacgcgcggggccgtgttaatgcaccggggaaagagaatagagccgtcctgggcagatgtcaaaaaggacctgatttcatacggcggtgggtggaagctcgagggagaatggaaagagggcgaagaggtgcaagttctggcccttgaaccaggcaagaaccccagggctgtgcagactaaacctgggatcttcaagaccaatacaggaaccatcggtgccgtcagtctggattttagcccaggcacatccgggtctcccattgtggaccgaaaaggaaaggtagtcggcttgtacggtaacggggtggttactcggtcgggagcatatgtgagcgctatcgcccagaccgagaagtcaatagaggataaccctgaaattgaggacgatatcttccgcaaaaagagactaacgattatggacctgcatccgggcgcgggcaaaacaaagaggtacctccccgccatcgtccgggaagcaataaaacgagggctgagaactcttattttagctccaacccgcgtggttgccgctgagatggaagaggcactgaggggactccctatccgttatcagacacccgccatcaaggccgagcacaccggtcgggaaattgtggacttgatgtgtcatgctactttcaccatgagactgctctccccagtcagggtgcctaattacaacctgatcattatggatgaggcgcactttacagaccccgcaagtatagccgctcgcggctatatctctacgcgagtagaaatgggggaggccgcaggaattttcatgactgccaccccaccgggcagcagagatccttttccccaatccaatgctccaatcatggacgaggaacgggagatccccgaaaggtcatggaactctggtcacgagtgggtgacagatttcaaggggaaaaccgtttggtttgtccctagcattaaggcgggaaatgacatagccgcatgccttcgcaaaaacggcaagaaagtgatccagctgagtcgtaagactttcgattccgaatacgtgaagacaagagctaatgactgggattttgtcgtaaccacggacattagcgagatgggcgccaacttcaaagcagagcgggtgatcgatccaaggcgctgtatgaagcccgttattttgactgacggggaagaacgagtgatcctagccggacctatgccggtcacacattcttcagctgcccagagacggggtaggataggccgcaatcccaagaacgaaaatgaccaatatatctacatgggggagcccctggaaaacgatgaggactgcgcgcactggaaggaggcaaaaatgctcttagataatattaacacccctgaaggaatcattccctccatgtttgagccagaaagagagaaggtggacgccatcgatggcgaatacaggctgcggggtgaggctcgtaaaaccttcgttgaccttatgcgccgaggggatctgcctgtgtggctcgcctataaggtcgctgcagagggcataaattacgccgacagaaagtggtgttttgatggaattaaaaacaaccagatcttggaagagaatgtggaagtagagatttggactaaggagggcgaaaggaaaaagctgaaaccccggtggctcgacgctcgcatctatagtgatccactggcccttaaggagttcaaggagttcgcagcggggagaaaaagcctaacactgaacttgataaccgagatgggaaggttacctacatttatgactcagaaggcccggaatgctctggacaacctcgccgtgctgcatacggcagaagctggtggccgagcctacaatcacgcactttcggagctgccggagaccctcgaaacattgctgctactgactctccttgccaccgttacagggggaatcttcctgtttttaatgtctggcaaaggtattgggaagatgaccttgggcatgtgctgcatcattactgcttccgtcctgctctggtatgcgcagatccaaccccactggatagccgcaagcattatcctggagttctttcttatcgtgctgctcattccagaacctgagaaacagagaacgccccaggataaccagttgacctacgtggtcatcgctatactgacagttgtggccgccactatggcaaatgaaatgggattcttagagaagaccaagaaagacctaggcctggggtcaattacaacccaagagagtgaatctaacatcctcgacattgatcttcgcccagcttccgcctggactctgtatgcggtagctacaacgtttgtgacccctatgttgaggcatagcatcgaaaattcaagtgtcaacgtgagcctgactgccatagcaaatcaggccacagttctcatgggactgggtaagggctggcccctttccaaaatggacatcggggtgccgctcctggctattggatgttactctcaggtcaacccaatcaccttgaccgcagccctgttactactggtagcgcactacgctattatcggccctggtctccaggccaaggcaacacgggaagcccaaaaacgtgctgccgcagggattatgaagaatcccactgtggatggcatcacggttatagaccttgagccaattccctatgatcctaagttcgaaaaacagctgggacaggtgatgttgctgatcctctgcgtcacccaggtgctgatgatgagaacaacttgggctctttgtgaggccttaaccctggcgacaggcccgatcagcaccctctgggaggggaaccccggaaggttttggaatactacgattgccgtctccatggcaaacatattccgcggctcatacttggctggtgccgggctgctattttctatcatgaagaatacaaccaacactcggcgaggaaccggcaacattggtgaaacactgggcgagaaatggaagagtagactcaatgcacttgggaaatcggagttccaaatctataagaaaagcggcattcaggaggtggacaggactctggctaaggagggcatcaagcgcggggaaaccgatcatcacgccgtttcccggggatctgccaaattgagatggtttgtggagcgtaacatggtaacaccagaaggcaaggtggtcgacctgggttgcgggaggggaggctggtcatactattgtggtggcctcaaaaatgttcgggaggtgaaggggctgacgaaaggaggccctgggcatgaagaaccaatacctatgagcacctacggatggaacttagtccgccttcagtccggcgtggatgtattcttcactccacccgagaagtgcgacacactgctctgtgatatcggtgaaagttctcctagcccaaccattgaggcggggcgaactctaagagtgctgaatttggttgaagactggctgaacaataacacacaattttgcatcaaggtgctcaatccctatatgccgtcagtcattgagaaaatggaaacccttcagaggaagtacggaggcgctctggtgcggaaccctttgtcccgcaatagtacgcacgagatgtactgggtcagcaacgcaaccggcaatatcgtgtcttccgttaacatgatatcaagaatgctgattaataggttcacaatgaaacacaagaaagccacttatgagccagatgtagacctcgggagcggaacccgaaacatcggtatcgaatcggagattcccaacttagacataatcggcaagcggattgaaaagatcaaacaggagcatgaaacatcttggcactacgatcaggaccatacttataagacctgggcttaccacgggagttatgagacaaaacaaaccggatccgccagctcaatggtgaatggcgtcgtgcgtctgcttactaagccttgggatgttgtgccaatggtcacgcagatggcaatgacagacaccactccctttggtcagcagagagtgttcaaagagaaggtagatacccgcacacaagaaccgaaggaggggacgaaaaagctgatgaggattaccgccgaatggctatggaaagagctcggaaagaaaaagactcctcggatgtgtacaagagaggaatttacccgcaaagtgaggtccaacgctgcgctgggcgccatcttcactgacgagaataagtggaagtctgcacgagaagctgttgaggatggccggttttgggaattggtcgacagagagaggaacctgcacctcgaggggaaatgcgaaacatgtgtgtacaatatgatgggaaagcgcgagaagaaacttggtgagttcggcaaagccaaagggagccgtgcaatatggtatatgtggctgggagcccggtttttagagttcgaagctctgggctttttgaacgaggatcattggttcagtagaggtaattccctcagcggggtggagggagaaggcctgcacaggctaggctacatccttcgcgacgtcgggaagaaagagggaggtgccatgtacgcggatgacaccgcaggctgggacacacgaattactctggaagatctcaagaacgaggaaatggttaccaatcatatgaaaggggagcacaagaaactggccgaggctatctttaagttgacgtatcagaacaaggtggtacgggtgcagagacccaccccaaggggaacagtcatggacattatctctcgcagagatcagcggggctcaggtcaagtggggacttacggactgaataccttcacaaacatggaagcccagctcattaggcagatggagggcgaaggcatattcaaaagtatccaacatcttactgcaaccgaggagattgctgttcagaattggctggcccgtgtggggcgagaacgcttatccagaatggctatcagcggagacgattgcgtcgtgaagcctatcgacgatcggtttgcctctgcactgacggcgttgaacgacatgggtaaagtaaggaaggatattcagcagtgggagccctcgcgcggctggaatgactggacacaagttccattctgctcacaccactttcatgaactcgtgatgaaagatgggagagtcctggtggtgccctgtcggaaccaggacgagctaataggaagggcccgaatcagccagggcgctggttggtcccttaaggaaaccgcctgcctggggaagagttatgcacagatgtggactctcatgtacttccaccgtagagatctgcgcttggctgccaacgcaatttgttctgccgtccctagccattgggttccaacatcccggaccacttggtcaatccacgcgaaacacgagtggatgaccacagaggacatgttagctgtgtggaatagggtatggattcaagaaaacccgtggatggaggacaagacgcccgtggaaagttgggaggaagtcccttatctgggaaaaagagaggatcagtggtgcggctctctcatcggccttaccagccgcgccacttgggcaaagaatatacagacagccatcaaccaggtgcggtccctgattgggaatgaggaatacaccgactatatgccatcaatgaaaaggtttcgaagagaggaagaggaagctggagttctatggtga

SEQ ID NO: 15043 - RNA, 9876 nt, synthetic construct
  misc_feature 1..9876: note = derived and/or modified CDS sequence (opt3) from DENV-2__JN368476__SS-prME
  source 1..9876: mol_type = other RNA
agcgcaggaatgatcattatgctgatccccaccgtgatggctttccacctcaccactagaaacggggagcctcatatgatcgtcggcattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagcactggtgccccatgtcggtatggggcttgagactcgtaccgaaacatggatgagctccgagggggcgtggaaacacgctcagagaatcgagacttggatactgaggcatcctggcttcaccatcatggccgcaattttggcctacacaatcggcaccacgcactttcagcgggctctcattttcatcctgctgactgcagtggccccatctatgacaatgcgctgcatagggatttcgaacagagattttgttgaaggagtgtcaggtggcagctgggtcgacatcgtgctcgagcacgggagttgtgtaaccactatggctaagaataagcccacattagatttcgaactgattaaaaccgaggccaagcagcctgcgacgcttaggaaatattgcatcgaagcaaagttgaccaacacaactaccgagtcccggtgtccaacacaaggagagccctctctgaaagaggaacaggacaagcgctttgtttgcaagcatagcatggtggatcgaggctggggtaatgggtgtggactattcggcaaaggcgggatcgtcacttgcgccatgtttacctgcaagaaaaacatggaaggaaagattgtgcagcctgagaatctcgaatacacaatagtggtcaccccacactccggtgaggagcatgctgttggcaacgacactgggaaacacggaaaggaaatcaaagtgacgccgcagtcaagtattacagaggccgaactgaccggctatggtactgtaaccatggagtgtagccccagaacagggcttgatttcaatgaaatggtgctgttgcaaatggagtctaaggcatggctcgtccacaggcagtggtttctggacttacctctgccatggctccccggcgctgataagcagggatccaactggatccagaaagagacccttgtgactttcaagaatcctcatgccaaaaagcaagacgttgtggtcctgggctcacaggaaggggcgatgcacacagccttgacgggagcaaccgagatacagatgagcagtggtaacctactgtttactggccatctcaaatgccggctgcgtatggacaaacttcaactgaaggggatgtcttactccatgtgtacaggaaaattcaaggtggtaaaagaaattgctgagacccagcacggcacaatcgttatccgcgtgcagtatgagggtgatgggagcccatgcaagattcccttcgaaatcatggacttggagaaaagatacgtcctcggcaggctgattactgtgaatccgatagtcaccgaaaaggattcgcctgtgaacatcgaggccgaacccccatttggagactcttacattatcatcggcgttgagcctgggcagttaaagctgaactggttcaaaaagggatcctcaattggtcaaatgtttgagacgaccatgcggggcgctaaacgaatggccatactaggggatacagcatgggacttcggaagtctcggcggtgtgtttactagcatcgggaaggccctgcatcaggtattcggcgctatttatggagcggcattttccggcgtctcttggaccatgaaaatccttattggggtgatcataacatggatcggaatgaatagccgctcaacaagtttgtccgttagcctggtgctcgtcggcattgtgaccctgtaccttggtgtaatggtgcaggccgattctgggtgtgttgtctcatggaagaacaaggaactgaaatgcggaagtggcatcttcattacggacaatgtgcacacatggaccgagcagtataagtttcaacccgaaagcccatccaaattggcttctgccatccagaaggcacaggaggaaggtatatgtggcattagatcggtgactaggctcgagaacctgatgtggaaacagatcacacccgagttaaatcacattctggccgaaaacgaggtcaagctaaccatcatgactggggatataaaaggaatcatgcaagctggcaagcggagcctccgccctcagccaaccgaactgaagtactcctggaaaacatgggggaaggccaaaatgctttcaacggagagtcataatcagaccttcttgattgacggaccggaaactgcagagtgccccaacacaaatagagcgtggaactctctggaggttgaagattatggctttggtgtgttcaccacaaatatctggctcaagctgaaagagaagcaggacgctttttgtgacagcaagttaatgtccgccgcaattaaagataacagggccgtgcacgctgacatggggtactggatcgaatcagccctgaatgatacttggaagatagagaaagccagcttcattgaggtaaagaactgccattggcctaaatctcacaccctttggtccaatggagtcttggaaagtgagatgatcatcccaaagaacctcgctggccccgtgagccaacacaactatcgtcctggttaccatacgcagacagccggcccatggcacctggggaagctagaaatggacttcgatttttgtgacggaaccactgttattgtgaccgaggattgcggcaatcgggggccctctctgcgaacaactaccgcgtccggaaaactcatcacagaatggtgctgtagatcatgcacgctgccgcctcttaggtaccgcggcgaggacggttgttggtatgggatggagattcggccattgaaggaaaaagaggaaaacctggtcaatagtttagtgaccgccggacatggccaggttgataacttcagcctcggtgtgctgggcatggctctttttctggaggaaatgttgagaactagggtagggacaaagcacgcaatactcctggtcgccgtgtcgttcgtgaccctaatcactggaaatatgtcctttaaagacctgggccgcgtcgttgtgatggtagggacaaccatgacggatgacattggaatgggcgtgacttacctcgctctgcttgccgcattcaaggtccgacccacctttgcggccggtttgctgttacggaagctcacatctaaagagctgatgatgaccactatcgggattgtgcttctgagccaatcaacaatccctgagaccatactagaactcacagatgctctggccttgggaatgatggttctgaagatcgtgcgtgacatggagaaatatcagttagcagtcactattatggctatcctctgcgtgcccaacgccgttattctgcagaatgcatggaaggtgagttgtaccatccttgccgtcgtatccgtgtctccactgttgctcacgagctcccagcaaaagactgactggatacctctggctctaaccattaagggcctgaaccccactgcgatcttccttaccacactctcaagaactaataaaaagaggagctggccactgaacgaagccatcatggcagttggcatggtgagtattttggcttcttccctgttaaagaatgatataccgatgaccgggcctctcgtcgccggaggtctgcttacggtgtgctacgtactgacaggccgcagcgccgacttggagctcgaacgggctaccgatgtgaaatgggaggaccaggcagagatctcggggtcatctcccattctgagtatcactatttccgaagatggaagcatgtctatcaagaacgaggaagaggagcagacactaaccatactgatcagaactggccttctcgtcattagcggtctgtttccagtttccatccccattacagccgcggcttggtatttgtgggaagtgaaaaagcagagggccggggtgttatgggacgtcccttcaccaccccctatgggaaaagcagagctggaagatggcgcctaccgaatcaagcaaaagggcatactcgggtatagtcagattggagctggtgtgtacaaagagggcaccttccatacgatgtggcacgttactcgcggggcagtactgatgcacaagggaaaacggatcgaaccgagctgggccgacgtgaagaaagatcttatctcttacggcggtgggtggaagctggagggagagtggaaggaaggcgaggaagtccaggtgttggcgctagagccaggcaaaaatcccagagctgttcagaccaagcctgggctgtttaaaacaaacaccggaacaattggtgccgtgtccctcgacttctcaccaggcacaagtgggagccccatcatagataagaaaggaaaggtcgtgggcctgtatggtaatggggtagtcaccaggtccggagcatacgtgtctgccattgctcaaacggaaaagtcgatcgaggacaaccctgagattgaagatgacatctttcgtaaacgccggcttacaataatggacttacatccgggcgccggcaagactaaaagatatctgcccgcaattgttagggaggctatcaagcgagggctccggaccttgatcctggccccaacacgcgtggtcgcggccgaaatggaggaagcactcagaggactgcctattaggtaccagacccccgctatccgggccgagcacactggtcgagagattgtggatcttatgtgtcatgctaccttcacaatgagactgttgagcccagttcgcgtgcctaactataatctaataatcatggacgaagcacacttcacggatcccgcctcaattgccgctaggggctacatctccactcgtgtcgagatgggggaagcggcaggaatctttatgaccgccacaccaccgggcagtcgggaccctttcccccagtctaacgctccaattatagatgaggagagagaaatccccgagaggagctggaataccggtcatgaatgggtgactgactttaaagggaagacagtatggttcgtgccttccattaaggccggaaacgatatcgcagcctgcctgcgcaaaaatggcaagaaagttattcaactctcacgaaagacctttgactctgagtatgtcaaaacgagaactaacgattgggacttcgtggtgacaaccgatatcagcgaaatgggcgctaattttaaggcggagcgggtcatagacccaaggcgctgtatgaaacccgtaatcttaaccgacggggaggaacgtgtgattctggccggacctatgccggttactcacagttccgcagctcagagacggggtaggatcggccgcaacccaaagaatgagaacgatcagtacatttacatgggggaaccccttgagaatgacgaagattgcgcccactggaaggaggcaaaaatgctgctcgacaacatcaatacacctgagggaataattcccagcatgttcgaaccagagcgagaaaaggtggatgccatcgacggcgagtatagattgcggggtgaagctaggaaaacctttgtcgatctgatgcgcagaggggacctccctgtgtggctggcctacaaggttgcggcagagggcattaactatgccgataggcggtggtgtttcgacggaatcaaaaataaccagatacttgaggaaaacgtggaggtcgaaatctggacaaaggagggcgagcgtaagaaactaaagccccgctggctggatgctcgaatttactctgacccattggccttaaaagaatttaaggagttcgctgcagggagaaaatcactgactctcaatctgatcacggaaatgggaaggcttcctaccttcatgacacaaaagactcgggatgccctggacaacctcgctgtgttgcataccgccgaggcgggtggacgcgcatataatcacgccctgtccgaactaccggagacactggagaccctccttctgttaactttgctggctacggtaaccgggggaatttttctcttcctgatgagtggcagaggtatcgggaagatgacacttggcatgtgctgcataattactgccagcgtgctgctctggtacgcacagatccagccccattggatcgctgcctcgattatcttggaatttttcctgatagttttactaattccagagcctgaaaaacagaggacaccccaagacaaccagctgacatatgtcgtgatcgcaattctcaccgtggtcgccgctactatggcgaatgagatgggatttcttgaaaagactaaaaaggatctgggcttggggtctatcgccacgcagcagccagagtccaacatactggacatcgatctccggcctgcaagcgcttggaccctgtacgccgttgccactacattcgtgacccccatgcttcgacactcaattgagaatagttctgtaaacgtgtccctcaccgcaatcgctaatcaagccacagtcctgatgggattgggtaaaggctggccgctgagcaagatggacattggggtgccattactagcgatcggatgttactcacaggttaaccctattactctgacggctgccctccttctgttggtggcacactatgccatcataggccccggtctgcaggctaaggcaaccagagaagcccagaaacgcgcggctgccgggattatgaagaatccaacagtcgatggcatcactgtaatcgacctcgatcccattccttacgacccgaaatttgagaagcaactgggacaggtgatgcttttaatactgtgcgttacccaggtgctcatgatgaggacaacctgggcattgtgtgaagccctgactctagctacgggccccatcagtacactgtgggaggggaacccaggacggttctggaataccactattgccgtcagcatggcaaacatctttcgtggctcctatctcgctggtgccgggcttctgttctctattatgaaaaataccacaaacactagaaggggaaccggcaatatcggtgaaacattgggcgagaagtggaaaagccgcctgaacgcgctcgggaagtccgagtttcaaacgtacaagaaatcaggaatacaggaagtggatcggaccctggccaaggagggcatcaaacgaggggaaactgaccatcacgcagtctctagaggaagtgctaagttaaggtggttcgtggagcgcaacatggttacacctgagggcaaagtggtagatcttggttgcgggcggggaggctggtcgtattactgtggtggcctgaagaatgtgagagaagtcaaggggctcaccaaaggaggccccgggcatgaggaacctattccaatgagcacttatggatggaacctagttcgtctgcagtccggcgtggacgtctttttcataccccctgagaagtgcgatacattgctgtgtgacattggtgaatcttcaccaaatcccaccgtggaggccgggaggacgctccgggtacttaacctggtggagaattggttgaacaataacacccagttctgcatcaaagttctgaatccgtacatgcctagcgtgatagaaaagatggaggcactccaacgcaaatacggaggcgctttagtccgaaacccactgtccagaaatagtacacacgaaatgtattgggtgtctaacgccagcggcaatattgtctcatccgtgaacatgatcagtaggatgcttatcaatcggtttactatgcgccataagaaggccacctacgagcccgacgttgatctggggagcggaacaagaaacattggtatagaatctgagatccctaacctagacattatcggcaaaaggattgagaagatcaaagaggaacacgaaacttcctggcactatgatcaggaccatccatacaagacctgggcgtatcacgggtcatacgagacaaaacagaccggaagcgcttcgtctatggtaaatggcgtggtccgactcctgactaagccctgggatgtgttgccgacggttacacagatggcaatgaccgacactacccctttcggtcaacagcgggtgtttaaggaaaaagtcgatacacgtacgcaggagcccaaggaggggaccaaaaagctgatgaaaataactgccgaatggctctggaaggagcttggcaaaaagaagacaccaagaatgtgtacccgcgaagagttcactaggaaagtgcggagtaacgctgccctgggcgcaatctttacagacgagaataagtggaaatccgccagagaagctgtagaggatagccgcttctgggaattagtggacaaggagaggaacctgcatttggaaggcaaatgcgagacctgtgtttataatatgatggggaagcgagagaagaaactcggagaatttggtaaggcgaaaggctcacgggccatttggtacatgtggctgggggcaagattcctagagtttgaagctcttggattcctgaacgaggatcactggttttccagggaaaattctctcagcggcgtcgagggtgaggggctgcacaagttgggatacatcctgcgcgacgtgagtaaaaaggaaggcggcgccatgtatgcagacgatacagccgggtgggacactcgtattaccctcgaggatcttaagaacgaagagatggtgacgaatcatatggaaggagagcacaaaaagctggctgaggccatcttcaaattaacctaccagaacaaggtcgttcgggtgcaaagacctacacccaggggtactgtaatggacattatatcccgccgagatcagcggggcagcggacaggtgggaacctatggcctgaatacatttactaacatggaagcgcaattgatcagacagatggagggtgaaggggtcttcaaaaatattcagcatctcaccgtgacggaggaggcagccgttcagaactggctggctagggtgggacgcgaaagactatctcggatggccatctcaggcgacgattgcgtcgtgaagccacttgacgataggttcgcaaatgctctgacagccctcaacgacatgggcaagatccgtaaagatattcaacagtgggagcccagtaaggggtggaacgactggacccaggtacctttttgctcccaccatttccacgaactgataatgaaagatggacgagttttggtggtcccatgtcgcaatcaggacgagttaatcggtagagctcggattagccaaggcgccgggtggtctctgagggaaactgcatgcctcggaaagtcgtacgcgcagatgtggtcacttatgtattttcaccgcagagacctgcggctagccgctaacgccatctgtagcgcagtgccgtcccattgggtgcccacaagtaggaccacttggtctattcacgctaaacatgagtggatgaccacagaggatatgctgacggtctggaatcgagtttggatccgtgaaaacccttggatggaggacaagaccccagtggaaagctgggaggaaataccctacctcggcaagagagaggatcagtggtgcggttccttgatcgggctgacttcacgcgccacatgggccaaaaatattcaggccgcgatcaaccaagtacggagtcttattggaaatgaggaatataccgactacatgccttctatgaagaggttcagacgcgaggaagaggaagctggcgtgctgtggtga

SEQ ID NO: 15044 - RNA, 9876 nt, synthetic construct
  misc_feature 1..9876: note = derived and/or modified CDS sequence (opt3) from DENV-2__JF260983__SS-prME
  source 1..9876: mol_type = other RNA
accgccggcttcctgatcatggtgattcccacagtcatggcttttcacctcactacgagaaacggggagcctcatatgatagttagcaagaatgaaaaaggaaagggtcttctgttcaaaaccgagaacggcatcaatatgtgcacattgatggcaatggacttaggggaactgtgtgaggatactgtgacctacaagtgcccatttctaaaacagaacgaaccggaggacattgattgttggtgcaattccacatctacctgggtaacttatggaacatgttcaagtaccggcgagcacaggcgggaaaagcgcagcgtggccctcgtcccccatgtgggtatggggctggagacgcgaactgaaacctggatgtcctctgagggagcgtggaagcaagctcagcgtatcgagacatggattcttagacaccctggcttcactctgatggccgcagttttggcctacaccatcggcacaacccattttcagagggctctcatattcatcctgctgacggcagtggccccatcgatgactatgcggtgcattgggatctcaaaccgcgactttgtcgaaggagtgagcggtggcagttgggtagatattgttctcgagcacgggtcctgtgtgacaaccatggctaaaaataagcccactttagacttcgaactgatcaaaacagaggccaagcagcctgcgacccttagaaaattttgcatagaagcaaagttgacgaacaccacaactgagtctaggtgtccaacccaaggagagcccagcctggtcgaagagcaggataagcggttcgtgtgccgccactccatggtggaccgaggctggggtaatgggtgtggactatttggcaaaggcgggattgtcacatgcgccatgttcacttgcctcaagaaaatggaaggaaaggttgtgcagcctgagaacctggaatataccatcgtaattacaccacattcaggtgaggagcacgctgtgggcaatgataccgggaaacatggaaaggaagtcaaaatcactccgcagagtagcatctctgagacggaacttacagactacggcaccattactatggagtgttcccccagaaccggtctggattttaacgaaatggtgttgctccaaatggagtcaaaggcctggctggttcacaggcagtggttcttagacctgcctctcccatggcttcccggggcagatacacagggcagcaattggatacagaaggagatgctggtgaccttcaaaaaccctcacgctaagcggcaagacgtcgtggtattgggaagtcaggaaggcgccatgcatactgcgctaacaggggccacggagatccagatgtctctgggaaatattctctttatgggtcacctgaaatgccgtcttcgcatggacaagctgcaattgaaaggcatgtcctatagcatgtgtaccgggaagttcaaggttgtgaaagaaatcgcagagactcagcatggaacaatagtcattagagtgcagtacgagggcgatgactcgccatgcaagatcccctttgaaatcatggatctcgagaaaaagcacgtcctgggtaggttaattaccgtgaacccgatcgttacagaaaaagactctcctattaacatagaggctgaacccccattcggggattcctatatcgtgattggcgtagagcctggacagctgaagctaaattggtttaagaaaggctcaagtatcgggcaaatgttcgagactaccatgcggggagccaagcgaatggctatcctcggtgacacggcctgggattttggcagcattgggggagtcttcacctccgtgggcaaagcactgcatcaggtttttggtgccatatacggggctgcgttctctggcgtgagctggacaatgaagatccttattggagtcgtgatcacttggattggcatgaactcacgcagtacctccttgagcgtaacactggtgctcgttgggatcgtcactctgtaccttggagtgatggtgcaggcagactctggctgtgtcgtttcatggaaaaataaggaactgaagtgcggtagtgggatatttgtgaccgataacgtgcacacgtggacagagcagtataaattccaacccgacagcccatccaagttggcctctgctatccagaaagcccacgaagagggaatttgtggcatcagatcggtaaccaggctcgaaaatctgatgtggaagcagattactcccgagttaaaccatatcctgagcgagaatgaagtcaaactaacaataatgaccggtgagattaagggcatcatgcaggcagggcggcgctccctcaaacctcaaccaactgaactgagatactcatggaagacctggggaaaggccaaagtgcttagtacagagttgcagaaccagacgtttctgattgatggcccggaaaccactgagtgccccaattctaacagggcttggaatagcctcgaggttgaagactatgggttcggaatcttcacaaccaacatatggctgaagttacgtgagaaacaggacatgatctgtgattccaagctgatgtcagccgcagtgaaagacgatcgggcggtccacgctgacatgggctactggattgaaagccgacttaatgatacatggaagatggagaaggcctcttttatcgaggtgaaatcctgctattggcctagaagtcatactttgtggagcaacggtgttctcgaatctgagatgattatcccaaagaatctggcagggcccgtgtcccaacacaactacaggcctggatattacacccagacggccggcccatggcacctaggtaaactggaaatggacttcgagttttgtgaaggcacaaccgtagtcgtgactgaggattgcgggaaccgcggaccctcactccggaccacaactgctagtggcaagctgataaccgagtggtgctgtagaagctgcacacttccgcctttgaggtaccgcggggaagacggatgttggtatggcatggagattcgaccactgaaagaacgggaggaaaatttagtgaactcgctcgtcacggccggtcatgggcagatcgataatttctccctgggaatccttggcatggcactgttgctcgaggagatgctgcgtaccagagttggtactaagcacgctctactgctcgtggccatttcttttgtaacactgatcaccggcaacatgagcttcaaggaccttgggagggtgattataatggtcggagcggccatgactgatgaaatgggcatgggggtgacatacttggctctgttagcagcctttcgcgttcggcccaccttcgctgtgggactcctgcttagaaaactgacgtcaaaggagctactcatggccactatcggcgtcgtgctgttgagtcaatccaatattcctggtaccgttctggaattaacagacgcaatcgcgctcgggattatggtgctgaaaatcatgaggtctatggagaagtatcagcttgccgtcaccgtaatggctatgctgtgcatacccaacgtgatgatcttgcagcatgcctggaaagttggatgtactattctcgcagctgtgagcgtctccccactgctactgacatcaagccagcaaaagaccgattggatccctcttgccctcacaattaagggcctgaatcccactgcaatctttttgaccacgctgagtcgaccatctaaaatacgctcctggccgttaaacgaagccattatggctgtgggcatggtaagcatcctcgcgtcgtcactgcttaagaatgacatccctatgacagggcccctggtggccggaggtttgctcaccgtctgctacgttctgactggccggtctgcagacctagagctggagaaagctgccgaagtgaagtgggaggatcaggccgaaattagtgggtccagcccaatactttctatcaccattagcgaggacggatccatgtcaatcaaaaacgaggaagaggaacagacactcactattctgatcagaaccggcttgttagtgataagtggtctgttccccgtcagcatccctattacggctgcagcctggtatctctgggagacaaagaaacagagggcgggggtgctgtgggatgttccatctccccctccgatgggaaaggctgaacttgaggacggcgcctaccgtatcaagcaacgcggcatttttgggtattcccagatcggagcaggtgtatacaaagagggcaccttccacactatgtggcatgtgacacggggggccgtcctggtgcacaagggaaaaagattggaaccatcatgggctgatgttaagaaagacctaataagttacggcggtgggtggaagctggagggagaatggaaggatggcgaggaagtgcaggtcctcgcactggagcccggcaaaaatcctagggccgtgcagaccaagccagggctttttaaaactaacacaggaaccattggtgcggtaagcttagacttctcccccggcacgtctgggtcgcctatcatcgatcgaaagggaaaagtcgtgggcctgtatggtaatggggttgtgactcggagcggaacctacgtctcatccattgctcaaacagagaagagtgtggaagacaacccggagatcgaagatgacatattccgcaagaaaagactcaccattatggatttgcaccccggcgccggcaagacaaaaaggtatctgccagcaatcgttcgggaggccattcgaagagggctccgcactctgatccttgctcctaccagggtggtcgccgcagaaatggaggaggctctgcgtggattgcccatacggtaccagacgccagccattaaggcggaacatacaggtagagagatcgtggacctaatgtgtcacgccacttttaccatgaggctgctctctcctatccgcgtacccaattataacttaattatcatggacgaagcacatttcacagatccagctagcattgccgctcgaggctacatatccaccagagtggagatgggggaggcagccggaatctttatgactgccaccccgcctggctcacgggaccccttcccacagtctaacgctcccattatggatgaagagagggaaatccctgagcgcagctggaatagtggtcacgaatggatcacaaactttaaagggaagacggtttggttcgtcccatccattcgtgcgggaaatgacatagcagcctgcctgagaaagaacggcaaacgggtgatccaacttagcaggaagacttttgataccgagtatacaaaaacccgcactaatgactgggatttcgtggtcacaaccgacatttctgagatgggcgctaactttaaggccgaacgagtaatcgatcccagacggtgtatgaaacctgtgattctgacggacggggaggaaagggttgtgctcgcaggaccgatgccagtcactcattcatccgccgctcagcgcagaggtaggatcggccggaatcccaagaacgagaatgatcagtacatatacatgggggaacctttggagaacgacgaggactgcgcgcactggaaggaagccaaaatgctgctcgataatatcaacacacccgagggaattatcccaagtatgttcgaacctgagcgtgaaaaggtggacgcaattgatggcgagtatcgcctgcgaggtgaggctagaaaaacctttgttgaccttatgaagaggggggatctacccgtgtggctggcctacaaagtcgcaagcgaaggcatcaattatgccgaccggaagtggtgtttcgatggaatacgcaacaatcagattttggaggaaaacatcgaggtggaggtatggaccaaagaaggcgagagaaagaagttaaaaccaaggtggctggacgctcggacttactcggatcctctcgccctgaaggaattcaaagagtttgcggcagggcgaaagtctcttacactgtccctcattaccgaaatgggaagattgccgacattcatgactcaaaaaacgcgcgacgccctggataacctagctgtgctgcacagcgccgagatgggtggcagggcttataatcatgcactctcagagcttcccgaaaccctggagacattattgctgctcgggctgcttgccactgttaccggaggcatctttctgttcctcatgagtggtcggggggtcggcaagatgacattgggaatgtgctgcataatcaccgcttctggcctgttatggtacgcccagattcagccacactggatcgcagcgtccattatcctagaatttttcctgatagtgctccttattcctgagcccgaaaagcagcgtactccacaagacaaccagctgacgtatgtggtcatcgccatcttgaccctggttgctgccacaatggcaaatgagatggggtttctcgagaaaactaagaaagatctgggacttggtggcttcaccatgcagcagcctgaaattaacatcctcgacatagacctgagacccgctagcgcctggacattgtacgcagtggccaccacttttgtaacaccgatgctgaggcattcaattgagaatagtagcgtgaacgtctccttaacggctatcgcgaatcaagccaccgtgctaatggggctgggaaagggctggccactctctaaaatggatattggtgttcctcttctggcaatcgggtgttacagccaggtgaaccccataactttgacagctgccctgctcctgcttgtcgcccactatgcaatcattggcccaggattacaggctaaggccacccgcgaagcgcagaagcgggctgccgcaggcatcatgaaaaatcccaccgtagacgggattacagtgatcgatctggagcctattccgtacgaccccaagttcgaaaaacaactcggacaggttatgttgctggtgctatgcgtcactcaggtgctgatgatgcgaacgacctgggccctctgtgaggctcttacactggcaactggcccaatctccaccttgtgggagggtaaccctgggaagttttggaatacaaccatagccgtctcaatggcgaacattttcagaggatcttatctggctggcgccggtctcctgtttagtatcatgaggaatactacgtcggcacgccggggcacagggaccatcggagaaactttaggcgagaaatggaagagcagacttaacgccctggggcgttccgaattccaaatttacaagaaatctggaatacaggaggtggataggaccctcgctaaggagggcatcaaacggggtgaaacagaccaccatgccgtttcacgcgggagcgcaaagctacgatggttcgtggagagaaatatggtagctcccgaaggaaaagtggtcgatctgggctgcggtaggggcgggtggtcctattactgtggaggcttgaagaacgttcgggaggtgaaagggctgactaagggaggccctggtcacgaagagccaattcccatgagtacctatgggtggaatctcgtccgccttcagtctggagtggacgtatttttcacacctccagagagatgcgatacgctgttgtgtgacatcggcgaaagctcacccaacccgaccgtggaggccggcaggactctgcgagttctcaacttagtggaaaattggctggggtccaacacacagttttgcattaaggtccttaatccttacatgccaagtgtgatcgagcggatggaaaccctgcaacgtaaattcggaggtgcgctagtcagaaaccccctcagccgcaattctactcatgagatgtactgggtgtccaacgcctcaggcaatatagttagctcggtaaacatgatctctaggatgctgattaatcggtttacaatgagacacaagaaagcaacctatgagcctgatgtggacttggggagtggaacgcgcaacatcggcattgaatgtgagaccccaaatatggatatcataggtaagaggattgaaaaaatcaagcaggagcatgaagcttcctggcactacgaccaggaccacccctataagacatgggcctaccatgggagctatgagactaaacagaccggatcagcatcctctatggtcaacggcgtggttcgactgctcacaaagccgtgggatgtgatccctatggtcactcaaatggctatgaccgacacaacccccttcggccagcagcgggtgtttaaagagaaggtagatactagaacgcaggaaccaaaagaggggacaaagaagcttatgaggattaccgccgaatggctgtggggagagttaggtcgccgtaaaaagcctcggatatgcactagagccgagttctgtaataaagtgaggagcaacgcggctctgggcgcagtttttaccgacgaaaataagtggaaaagtgcccgcgaggctgtcgaagatgagcgattctgggaattggtggagaaggagcggaacctccacctggacgggaagtgcgaaacatgcgtgtacaacatgatgggaaaaagagagaagaaactaggcgaatttggtaaggccaaagggtccagggcaatctggtatatgtggcttggagcccgcttcctggagtttgaagctctcggcttcctgaatgaggatcattggttcagcagagagaactctttgtcaggcgtcgaaggggagggactgcacaagctcggttacattcttcgggacatcagtaggaaagcgggcggggccatgtacgcagatgacacggctggatgggatacccgtattacttccgaagacctgaagaatgaggaaatgatcacagaccaaatggagggccgacacaagaaattagccgaggcaatatttcgcctgacctatcagaacaaggttgtgagagtacagcggcccactccaaggggtacagtgatggatatcattagccgcagagaccaacgggggtctggacaggtcggcacctacggcttgaatacattcactaacatggaagcccagctcatcaggcagatggagggggaaggactgtttaaatcgattctacatcttaccccccaagaggagacggctgtgcacgcctggctggttcgagaaggtcgtgagagactcgcgcgcatggcaatctcaggcgatgactgtgtggtcaagcctctggatgaccggttcgccagggctttgaccgccttaaatgatatggggaaagtgagaaaggacattcagcagtgggaaccaagcaagggatggtccgattggacacaggtaccgttttgcagtcatcacttccatgagctgataatgaaagacggccgcaagctcgttgtgccctgtcggaaccaagatgaacttatcggtagggcacgaatttctcagggggctggatggagcctgagagagactgcctgcctaggcaaatcctatgctcagatgtggtcactgatgtactttcaccggagggacctccgcttggccgcaaatgcgatctgtagtgccgtcccttctcactgggtgccaaccagccgtacaacttggtccatccatgcttcacacgagtggatgaccacggaagatatgctggccgtgtggaacagagtctggattcaggacaatccctggatggaggacaagacacctgttgaaagctgggaggatataccatatcttggcaaacgagaagaccaatggtgcgggtctctgatcggactcacctccagggcaacttgggctaagaacattcagacagccatcaatcaggtgcgggcattaattggtgaggaggaatacatggattatatgcccagtatgaagcgcttcagaagcgaggaagaggaatcgggcgtactgtggtga

SEQ ID NO: 15045 - RNA, 9876 nt, synthetic construct
  misc_feature 1..9876: note = derived and/or modified CDS sequence (opt3) from DENV-2__AF119661__SS-prME
  source 1..9876: mol_type = other RNA
accgtgggcgtcatcattatgctgatacccacagccatggctttccacctcactacgagaaacggggagcctcatatgatcgttggaaggcaggaaaagggtaaaagccttctgtttaagaccgaggacggcgtgaatatgtgcacattgatggcaattgatttaggggaactgtgtgaggacactatcacctacaaatgcccactactccggcaaaacgaaccggaggatattgactgttggtgcaattccacatctacctgggtaacttatggaacatgtaccacgactggcgagcaccgccgagaaaagcgttcagtggccctggtcccccatgtgggtatggggcttgagaccagaacagaaacttggatgagtagcgagggagcgtggaaacacgctcagaggatcgagacctggatactgcggcatcctggcttcatcattatggccgcaatcttggcctacacaattggcaccacgcactttcagcgcgctctcatcttcatactgctgactgcagttgccccatccatgacaatgagatgcattggggtgtctaacagggattttgtcgaaggagtgtcgggtggctcatgggtagacatcgttctcgagcacgggagctgtgtgaccactatggctaagaataagcccacattagatttcgaactgattaaaaccgaggccaagcagcctgtcacgcttcggaaatattgcatcaaggcgaaattgaccaacacaactaccgaaagtcgctgtccaacacaaggagagccctccctgaatgaggaacaggacaagcgatttgtgtgcaagcattctatggtggatagaggctggggtaacgggtgtggactattcggcaaaggcgggatcgtcacttgcgcaacctttacatgcaagaaaaatatggagggaaagattgttcagcctgaaaacctcgagtacaccatagtgatcactccacacagcggtgaagagcatgccgtaggcaatgacacggggaaacacggaaaggagattaaaatcacaccgcagtcctcaataaccgaagctgagctgactggctatggtaccgtgacaatggaatgtagtcccaggaccgggcttgatttcaacgagatggtcctgttgcaaatggaagacaaggcctggctcgtgcaccggcagtggtttctggatttacctctgccatggctccccggcgcagacactcagggaagcaattggattcagaaggagacacttgttacgttcaaaaaccctcatgctaagaaacaagacgtggtcgtgctgggctctcaggagggggccatgcacaccgcgttgactggagccacagaaatccagatgtcctcaggtaatctactgtttaccggccatctcaagtgccgtctgcgcatggataaacttcaactgaaggggatgagctacagtatgtgtacaggaaagttcaaaatcgtaaaggagattgcagaaactcagcacggcaccatcgttattagagtgcagtatgagggtgacgggtctccatgcaaaatacccttcgagatcatggatttggaaaagaggcatgtcctcggccggctgattacggtgaacccgatcgtcaccgagaaagactcccctgtgaacatcgaagctgagcccccatttggagatagctacattataatcggcgttgaacctgggcagttaaagctgaattgggtgaagaaaggatcgtctattggtcaaatgttcgagacaactatgcgaggcgccaagcgcatggctatcctaggggacaccgcctgggattttggatccctcggcggtgtattcacatcaattgggaaagcactgcaccaggtctttggcgccatctacggagctgcgttcagtggcgtgagctggactatgaagatacttatcggggttattatcacctggattggaatgaactccagatctacgagcttgtcagtgagtctggtcctcgtgggcgtaatcacactgtatcttggtgcaatggtgcaggccgactccgggtgtgttgtcagctggaaaaataaggagctgaagtgcggatctggcatatttattaccgataacgtgcacacttggacagaacagtacaaattccaacccgagtcaccaagtaagttggctagcgccatccagaaagcacatgaagagggtatttgtggcatcaggtccgtgacccggctcgaaaatctgatgtggaagcagataactcccgagttaaaccacatcctgtctgagaatgaagtcaaactaaccattatgacaggggacatcaagggaattatgcaggccggcaaacgctcgctcagacctcaaccaacggagctgaagtatagctggaagacctgggggaaagctaagatgctttccactgaatcacataaccagacatttttgatcgatggaccggagaccgccgaatgccccaatacaaacagggcatggaatagtctggaggttgaggactacggcttcggtgtgtttactaccaacatatggctcaaactgcgtgaaaagcaggacgtgttctgtgattctaaattaatgagcgcggctattaaggacaatcgggccgtacacgcagatatggggtattggatcgagtccgccctgaacgacacgtggaagatggaaaaagcttcatttatcgaggtcaagagctgccactggcctaaatctcatacactttggtccaatggagtgttggagagtgaaatgattatcccaaagagcttcgccggccccgtttctcagcacaactaccgacctggttattacacccaaactgcaggcccatggcatctcgggaaactggagatggatttcgacttttgtgaaggaaccacagtggtcgtgactgaggattgcggcaacagagggccctccctaaggaccacaacggcttcaggaaagctgattaccgaatggtgctgtcgcagttgcactctcccgcctctgcggtacagaggcgaggacggttgttggtatgggatggagataaggccacttaaggaaaaagaggaaagcttggttgattcgctggtgacagccggacacggccagatcgacaatttctccttaggtgtactcggcatggcgctgtttcttgaggaaatgctgcgcacccgagtcgggactaagcatgccattttgctcgtggctgtgtctttcgtcacactgatcaccggaaacatgagcctacgggatctgggccgtgttatggtgatggtaggggcaacgatgactgacgatattggaatgggcgtgacctacctcgccctgcttgctgcctttaaagtcagacccacattcgcagcgggtttgctgttaaggaagctcacctcaaaagagctgatgatggccactatcgggatagctcttctgagtcagtccacaatccctgagaccattctagaactcacagacgccctggcattgggaatgatggtgctgaagatcgttcgcaatatggagaagtatcaattagctgtgactattatggccatctcttgcgtccccaacgcagtgatactccagaatgcctggaaagttagctgtaccattctggctgcggtgtccgtctcaccacttctgttgacgagcagtcagcagaaggccgactggatccctctcgcactgacaatcaaaggcctaaaccccaccgctatttttctgactacccttgcccggacatctaagaaaagatcctggccactcaatgaagccataatggctgtaggcatggtgagcatcctggcatcgtcattgctgaagaacgatattccgatgactgggcctttagttgccggaggtctcctgaccgtgtgctacgtccttacgggcaggtctgcggacctggagttggaacgagctacagatgtgaaatgggaggaccaagccgagatcagtgggtccagccccattctctctatcaccataagcgaagatggatccatgtcaatcaagaatgaggaagaggagcagactctgacaattctaatccgcaccggcctgcttgtaattagtggtctcttcccagtgagcatccccataactgcagccgcttggtatctgtgggaagtcaagaaacagcgggcaggggttttgtgggacgtgccttctccaccccctgtggagaaggccgaattagaggatggagcgtacagaattaaacagaagggcatcctgggctattcccaaatcgggacaggagtctacaaagaaggtacctttcacacgatgtggcacgtgactaggggcgctgttctcatgcatcgtgggaagcgcattgagccgtcatgggccgacgtaaagaaagatctgatcagttacggaggcggttggaagcttgagggggaatggaaagagggagaagaggtgcaggtcctggcattggaaccaggcaagaacccccgggccgtgcagaccaaacctggcctattcaagacaaataccgggacaataggagctgttagcctggacttttccccaggtacttctggctcgcccattgtggatagaaaggggaaagtcgtgggactctatggcaacggtgtagtcaccaggagcggggcctacgtgtcagcaatcgctcagacggagaagtccattgaggacaatcctgaaatcgaggatgacatattccgaaaaaagcggctgacaattatggaccttcacccgggagccggcaaaactaagcgctatttacccgcgatcgttagagaagccatcaagaggggcctgcggaccctcattttggcaccaacacgagtggtcgctgccgagatggaagaggctctgagagggctccctatccgctaccaaacccccgcaattagggccgagcatactggacgtgaaatagtggatctgatgtgtcacgccacctttacaatgcggcttctgagtccagttagagtgcctaactataatttgatcattatggacgaggctcatttcacggatcccgcgaacatcgcagccaggggttacatctctactcgcgtcgaaatgggcgaggctgccgggattttcatgaccgcaacaccaccgggaagccgagacccttttccccagtccaacgccccaataatggatgaggaaagagagatccccgaacggtcatggaattctggccacgagtgggtgaccgacttcaaaggtaagactgtatggtttgtgcctagcattaaagctgggaacgatatcgcggcctgcctaaggaagaatggaaaaaaggttattcagctgagtcgcaagacattcgactccgaatatgtcaaaacccgtacgaacgattgggactttgtggtgactacagatatcagcgagatgggcgcaaatttcaaggctgagagagtcatagacccacggaggtgtatgaaacccgtaatcctcaccgacggcgaagagcgcgtgattttagccgggcctatgccggttacccactcttcagcagcccaacgaagaggacggatcggtaggaacccaaagaatgaaaacgatcagtacatttacatgggcgagcccctggaaaatgacgaggattgcgctcattggaaagaggccaagatgcttctggacaacatcaatactcctgaagggataattccctccatgtttgagccagaacgcgagaaagtggatgcgatcgacggagaatatagactcaggggcgaggcacggaagacattcgtcgatttgatgcgtcgcggtgacctgcctgtgtggctcgcctaccgagttgctgccgaggggattaactatgctgatagaaggtggtgttttgacggcgtgaagaataaccagatcctggaagagaatgtcgaagtggagatatggaccaaagagggagaacggaagaaacttaagccccgctggctagatgcaagaatctacagtgacccactggccttgaaagagttcaaggaatttgctgccggcaggaagagcttaacactgaacctcattactgagatggggcggctgcctacgttcatgacccagaaagcacgagatgcgcttgacaacctggccgtactccacacagctgaagccggaggtagagcatataatcatgctttgtcggagctgccggagactctagaaaccctgctccttctgacattattggccaccgtgactggcgggatcttcctgtttctcatgtctggaaagggcgttggtaaaatgacgctggggatgtgctgcattatcaccgcatccatacttctgtggtacgcccaaattcagccccactggatcgctgcgagcatcattctcgagttctttttgatggtcctgttaatcccagaacctgagaagcagcgcacaccccaggacaaccaactaacttatgtggtgatagccattctgaccgtcgttgcagctacaatggccaatgaaatgggcttcctcgagaaaaccaagaaggatcttggactgggctcaatcgccactcaggagccagaaagtaacattttggacatcgatctgaggcctgcatctgcttggacactctacgccgtggcgacgacctttgtaactcccatgctgcggcactccatagagaatagctcagtgaacgtcagtcttacagctatcgccaatcaggcaaccgtgctcatggggctgggaaaaggttggccgttgagcaagatggacattggcgttccactgttagccatcgggtgttactcccaggtgaaccctattaccctaacagctgcactgctccttctggtcgcccattatgcgatcattggacccggcttgcaagctaaagccactcgtgaagcacagaagagagccgctgccggtatcatgaaaaatccaacggtagatgggataaccgtgattgacctggatcccatcccttacgacccgaagttcgagaagcagctcggccaggttatgctgcttatcttatgcgtgacacaagtcctgatgatgaggactacctgggcactctgtgaagctttgacactggccaccggacccatttctactctatgggagggcaacccagggcgcttttggaatacgacaatagcggtgagcatggccaacatcttccggggatcctatctggcaggcgctggtctcctttttttcattatgaaaaataccactaacacccgaagagggacaggaaatatcggcgagactctgggtgaaaagtggaaatcaaggttgaacgccctgggcaagtctgagtttcagatttacaaaaagagtgggatccaggaagtcgatcgcaccctcgcaaaagagggaataaagcggggcgagacagaccaccatgctgtgtcgagagggagcgccaagctgcgttggttcgttgaaaggaatatggtgacgcctgagggaaaagtagtggatttaggctgcggtcgggggggatggtcctattactgtggcggtcttaagaacgtccgcgaagttaaaggcctgaccaaggggggacccggccacgaggaacctatcccaatgtctacttatgggtggaacctcgtgcgactacaatcaggagtcgacgtgtttttcacaccccctgagaaatgcgataccctgttgtgtgacattggcgagagctccccaaatcccactatcgaagccggtagaacactgagggtactcagtcttgtggagaactggctgaataacgacacccagttctgcattaaggttttgaatccgtacatgccttctgtgatcgaaaagatggagacgctgcagcggaaatacgggggagcgctcgtccgcaacccattaagcagaaattcaacccatgaaatgtattgggtgtccaacgctacaggcaatatagtcagtagcgtgaacatgatttctaggatgctgatcaatcgatttactatgaagcacaaaaaggcaacctacgagcccgatgttgaccttggctccgggacacggaacatcggaattgagtcagaaatacctaatctggatatcattggtaaacgtatcgagaagattaagcaggaacacgagactagctggcattatgaccaagatcacccatacaaaacctgggcctatcatggctcgtacgaaacaaagcagaccgggtctgctagttccatggtaaacggagtggtcagactactcactaaaccctgggacgtggttccgatggtgacgcagatggccatgacagataccactcctttcggccagcaacgcgtctttaaggagaaagtggacaccaggacacaggagcccaaggaaggtacgaagaaactgatgaagatcaccgcagagtggttgtggaaagaactggggaagaaaaagactccacggatgtgtacaagagaggagttcacccgcaaagtaaggagcaatgccgctctcggagcgatatttactgatgaaaacaagtggaagtcagcccgagaggcagtggaagacaaccggttctgggagcttgttgataaagaaagaaatctgcacttagagggcaagtgcgagacatgtgtctataacatgatgggcaaaagggaaaagaaactgggggagtttggaaaggctaagggttcccgcgccatctggtacatgtggttgggcgcacgtttcctcgaatttgaggccctggggttcctaaatgaagaccactggttttctcgggagaacagccttagtggagtggagggcgaaggtctgcataaactcgggtacattctgagagacgtgtccaagaaagagggaggcgctatgtatgccgatgacaccgcgggctgggatacaaggatcactttggaagacctgaagaatgaggaaatggtcaccaaccacatggagggggagcataaaaagctcgcagaagccattttcaagcttacgtaccagaataaagctgttcgcgtgcagcgacctaccccccggggaacagtaatggatatcattagcagaagggaccaacgcggttctggccaggtggggacttatggactgaacacctttacaaatatggaggcccagttaataagacaaatggaaggcgagggtatcttcaagtcaattcagcacctgactgtcaccgaggaaatcgcagtgcagaactggttggctcgggttgggagggagcgtctcagtcgaatggccatctccggagatgactgcgtggtcaaaccactggatgaccgcttcgctagcgccctaacggcacttaatgatatgggcaaggtgagaaaagacattcagcaatgggaaccctctcggggctggaacgattggacacaggtacctttttgctcgcatcacttccacgagctgataatgaaggacgggagggttctcgtggtcccatgtcgcaatcaggacgaactgatcggaagagcgcggatttcacagggtgccggctggagcttgaaggagaccgcttgcttagggaaatcctacgcccaaatgtggagtctgatgtattttcataggcgagatctccgtcttgcagctaacgccatctgttctgcagtgccgagccactgggtgcccacttccagaacaacctggtcaattcatgccaagcacgagtggatgactaccgaagacatgctgacagtctggaatcgcgtttggatccaggagaacccttggatggaagataaaacgccagtggagagttgggaagaggtaccctacctaggaaagcgggaggaccagtggtgcggctctctgataggtctcaccagcagggcgacttgggctaaaaacatccagacagccattaatcaagtgagatccttgatcgggaacgaagagtataccgattacatgccttcaatgaagcgcttccggagggaagaggaagaggcaggagtcctgtggtga

SEQ ID NO: 15046 - RNA, 9876 nt, synthetic construct
  misc_feature 1..9876: note = derived and/or modified CDS sequence (opt3) from DENV-2__EU056810__SS-prME
  source 1..9876: mol_type = other RNA
acagccggaatcattataatgctgatccccacagtgatggctttccacctcactacgagaaatggggagcctcatatgattgtaagcaggcaggaaaagggaaaatcccttctgtttaagaccgaggacggtgttaatatgtgcacattgatggcaatggatttaggcgaactgtgtgaggacactatcacctacaattgcccactactccggcaaaatgaaccggaggatattgactgttggtgcaactctacatcaacctgggtgacttatgggacatgtaccgccacgggagagcaccgccgagaaaaacgtagtgttgcgctggtgccccatgtcggcatgggtcttgagactagaaccgaaacatggatgagctccgagggggcttggaagcacgcccagaggatcgagacttggatactgcggcatcctggattcaccatcatggcagccattttggcttacacaatcggcaccacgtattttcagcgcgtgctcattttcatcctgctgactgcagttgccccatctatgacaatgagatgcataggcatttcgaatagggattttgtggaaggggtctcaggaggtagctgggtggacatcgtactcgagcacggcagttgtgttaccactatggctaaaaacaagcccacattagatttcgaactgattaagaccgaggccaaacagcctgcgacgcttcggaagtactgcatcgaagcaaaattgaccaatacaactaccgcctcccgctgtccaacacaaggggagccctctctgaacgaggaacaggacaagcgatttgtgtgcaaacacagcatggtcgatagaggatggggcaatggttgtgggctattcggaaagggcggcatcgtgacttgcgctatgtttacctgcaagaaaaacatggaggggaaggtggtccagcctgaaaatctcgagtatacaattgttataaccccacattccggagaagagaacgccgtgggtaatgacactggcaaacacgggaaggagatcaaaattacgccgcagtcaagtatcacagaagcagagctgaccggatacggcactgtaaccatggaatgtagccccaggacaggtcttgatttcaacgagatggtgctgttgcaaatggaaaataaggcttggctcgtccatcggcagtggtttctggacttacctctgccatggctccccggggccgatacccagggctctaactggatacagaaagagactcttgtgacattcaagaaccctcacgcgaagaaacaagacgttgtggtcctgggatcccaggagggcgccatgcacacggcattgaccggggctactgaaattcagatgtcaagcggaaatctactgtttacaggtcatctcaagtgccgtctgcgcatggacaaacttcaactgaagggcatgagttattctatgtgtaccgggaaattcaaggtggtaaaggagatcgccgaaacacagcacggaactatcgttgtgagagtccagtacgagggcgatggttccccatgcaaaattcccttcgagatcatggacttggaaaagaggcatgtgctcgggcggctgattaccgtcaacccgatagtgacggagaaagatagccctgttaatatcgaagctgagcccccatttggcgactcgtacattatcatcggagtggaacctggccagttaaagctgaactggttcaaaaaggggtcttccattggacaaatgtttgagaccacaatgcgaggtgccaagcgcatggcaatactaggcgatactgcctgggacttcgggtcactcggaggcgtatttaccagtatcggtaaagctctgcaccaggtcttcggggcgatttatggcgcagcctttagcggagtgtcctggacaatgaagatccttattggcgttgtgatcacttggatagggatgaactctagaagcacctcattgagtgtctccctggtgctcgtaggagtggttacgctgtaccttggcgtcatggtgcaggctgatagcggttgtgtggtctcttggaaaaacaaggagctgaaatgcgggtcaggaatcttcgttacagacaatgtgcatacctggactgaacagtataagtttcaacccgagagtccaagcaagttggcctccgcaattcagaaagcccacgaagagggcatctgtggtattaggtctgtgacacggctcgaaaacctgatgtggaagcagatcacccccgagttaaatcacatactgtcggagaacgaagtaaaactaactattatgaccggcgatatcaaggggattatgcaggctggaaaacgcagcctcagacctcaaccaacagagctgaagtactcctggaaaacgtggggcaaggccaagatgctttcaaccgaattgcataatcagactttcctgatcgacgggccggagacagcagaatgccccaacaccaatagggcgtggaacagtctcgaggtcgaggattatggatttggcgtgttcacaactaatatatggctgaaattaaaggaacgtcaggacgtattttgtgactctaaactgatgagcgctgccatcaaggataaccgggcagtgcacgccgacatgggttactggattgagtccgctcttaacgatacctggaaaatcgaaaaggcctcattcattgaggtcaagagctgccattggcctaaatctcacacgttgtggtccaatggggtgctcgagagtgaaatgatcataccaaagaacttcgcaggacccgttagccagcacaattatcgacctggctaccatacacaaaccgctggtccatggcacctgggcaaactagaggtggactttaacttctgtgaagggactaccgtagtcgtgacaggagattgcggcaatagagggccctctctgaggactaccacagcctccggaaagctcattacggagtggtgctgtcgctcatgcaccctgccgcctcttcggtacagaggcgaagacggttgttggtatgggatggagatcaggccattgaaagagaaggaagagaacctggtgaatagtttagtcactgcgggacatggccagatcgataactttagcctcggtgttctgggcatggcccttttcctggaagagatgttgcgcacacgagtggggaccaagcacgctattctcctggtagcagtgtcgtttgtcactctaatcacaggaaatatgtccttccgggacctgggccgtgtgatggttatggtgggggccaccatgacggatgacattggaatgggcgtcacttacctcgctctgcttgccgcatttaaagtgagacccaccttcgcggccggtttgctgttaaggaagctcacatctaaagaactgatgatgaccactatagggatcgttcttctgagccagtcaacaattcctgagaccgtgctagagctcacagatgctctggccttgggaatgatggtcctgaagatcgtacgcaacatggaaaaatatcaattagcagtgactattatggctatcctctgcgttcccaatgccgtgatactgcagaacgcatggaaggtcagttgtaccatccttgccgtggtatccgtgtctccactgttgctcacgagctcccagcagaaggctgactggattcctctggcgctaacaatcaaaggcctgaatcccaccgccatttttcttactaccctctcacggacaagcaagaaaagaagttggccactgaacgaggcaatcatggctgtcggcatggtttctatattggcctccagcctgttaaagaatgatattccgatgactgggcctctcgtggccggaggtctgcttaccgtgtgctacgtcctgacgggcaggtcggctgacttggaactcgagcgagcagccgacgtgcgctgggaagatcaagcggagatctcagggtctagtcccatcctgtccattacaataagcgaggacggatctatgagcatcaaaaacgaagaggaagaacagaccctaactattctgatccggacaggccttctcgttatttccggtctgttcccagtatcaatccccataaccgctgccgcatggtatttgtgggaggtgaagaaacagagagccggggtcttatgggatgtgcctagtccaccccctgttggaaaggctgaactggaggacggcgcatacaggatcaagcagaaaggcattctcgggtatagccaaatcggagccggtgtgtacaaggaaggcacttttcatacaatgtggcacgtcacccgtggggcggtgctgatgcacaaaggaaagcgcattgagccgtcttgggctgatgtcaagaaggaccttatctcctacggcggtgggtggaagctggaaggagagtggaaagagggcgaagaggtccaggtgttggccctagaaccaggcaagaacccccgggcagttcagacgaaacctgggctgttcaagactaataccggaacaataggtgccgtgtcactcgattttagtccaggcaccagcgggtcccccattgtcgacaaaaagggaaaggtggttggcctgtatggtaacggggtggtcacaagatctggaacttacgtgtcggctatcgcccagaccgagaaaagcatcgaagataatcctgagattgaggacgatatcttcaggaagaaacgacttacgataatggacttacatccgggcgcaggcaagacaaaacggtatctgcccgctattgtacgcgaagccatcaagagagggctcaggactttgattctggcgccaacccgggtggttgccgcagagatggaagaggctctccgaggactgcctatcagataccaaacacccgccatacgcgctgaacacaccggtagggagattgtcgatcttatgtgtcatgcaactttcaccatgcgtctgttgtcaccagtgcgggtgcctaactataatctaatcatcatggacgaggcccactttacagaccccgcctccattgctgcgagaggctacatcagtacgagggtcgaaatgggggaggcagccggaattttcatgactgctaccccaccgggctctcgcgatccttttccccagagcaacgccccaataatggacgaggaacgagagatccccgaaagatcctggaactcaggtcatgagtgggtaacagatttcaaggggaaaaccgtgtggtttgttccttctattaaggcaggaaacgacatcgccgcttgcctgcggaaaaatggcaagaaagtgatccagctcagcaggaagactttcgatagtgaatatattaagacacgcaccaacgactgggattttgtcgtgacgactgacatatccgagatgggcgcgaatttcaaagccgaacgtgttatcgatccaagacggtgtatgaagcccgtgattttaacagacggggaggagagggtcatcctggcaggacctatgccggtgacccacagctctgctgcccaacgccgaggtagaattggccggaaccccaaaaatgaaaacgatcagtacatctacatgggggagccccttgaaaatgacgaggactgcgcacactggaaggaagccaaaatgctgctcgataacataaacacccctgagggaatcattccctcaatgtttgagccagaaagggagaaggtagacgctatcgatggcgaatatcgcttgagaggtgaggccaggaaaactttcgtggacctgatgcggcgtggggatctccctgtttggctggcgtaccgcgtcgcagccgaaggcattaattatgctgaccgaagatggtgttttgatggaatcaagaacaatcagatacttgaggagaacgtggaagtggagatttggacaaaggaaggcgagaggaaaaagctaaaaccccggtggctggacgcccgcatctactccgatccattggctttaaaggagttcaaagagttcgcagccgggagaaagagtctgaccctcaatctgattacagagatgggaaggcttcctacttttatgacgcagaaggctcggaacgccctggacaatctcgcagtcttgcataccgcggaagccggtggccgagcttataaccacgccctgagcgagctaccggaaacactggagactctccttctgttaaccttgctggcaacagttaccgggggaatcttcctctttctgatgtcgggcaaaggtatagggaagatgactcttggcatgtgctgcatcattacggcttctatcctgctctggtacgcccaaattcagccccattggatcgcagcctccataattttggagttctttctgatcgtgttactaatcccagaacctgagaaacagagaacaccacaggataatcaactgacatatgtagtgattgctatcctcactgtcgtggcggccaccatggcaaacgaaatgggattccttgagaagaccaaaaaggactttggcctggggagcatagctacccagcagccagaatcaaatattttggatatcgacctgcgccctgccagtgcctggactctctacgcagttgctacaacgttcattacccccatgctgaggcactctatcgagaactccagcgtgaatgtctcacttactgccatagcgaaccaggctacagtactcatgggactgggtaagggctggccgttgagtaaaatggacatcggggtgccactgttagccattggatgttacagccaagttaatcctatcaccctaaccgcagccctgctccttctggtggctcactatgcaattatcggccccggtttgcaggccaaggcgacacgggaggctcagaaacgtgccgcagccgggattatgaagaacccaactgtcgatggcatcacggtgatagacctggatcccattccttacgacccgaaatttgaaaagcagctcggacaagtcatgctgcttgtgttatgcgttacccaggtgctgatgatgagaacaacttgggctctctgtgaggccttgaccctggcaacaggccccatctccaccctatgggaagggaatccaggaaggttctggaacactacgatcgctgtatctatggccaacatttttcgcggcagctatctggcgggtgccgggctccttttctccataatgaagaatacagcaaacacccggcgaggaactggcaataccggtgagacactgggcgaaaaatggaagaacagattgaatgctctggggaaatcagagtttcagatctacaagaaatctggcattcaagaggtggataggactctcgccaaggaaggcatcaaacgcggggagaccgaccatcacgcagtcagtcggggatcggctaagctgagatggttcgttgaacgtaacttagtgacacctgagggcaaggtcgtggatcttggttgcgggaggggaggctggagctattactgtggtggcctgaaaaatgtacgggaggtgaaggggctcacgaaaggaggccccgggcatgaggaacctattccaatgtccacctatggatggaacctagttcgcctgcagtctggcgtggacgtcttctttactccccctgaaaagtgcgatacattgctgtgtgacatcggtgagtcaagcccaaatcccaccatagaagccgggcgaactctcagagtgcttaacctggtcgagaattggttgaacaataacacacagttctgcatcaaagtgctgaatccgtacatgccttccgttattgagaagatggaagccctccagaggaagtacggaggcgcgttagtacggaacccactgagtcgcaactctacccacgagatgtattgggtgagcaatgcttcaggcaacatcgtctccagtgtgaatatgattagcagaatgcttatcaacaggtttacgatgcgacataaaaaggcaacctacgaacccgatgttgacctggggtctggaacacggaatataggtattgagtccgaaactcctaacctagatatcatcggcaaacgtattgagaagataaaacaagagcacgaaacctcatggcactatgaccaggaccatccatacaagacatgggcctatcacgggagctacgagactaagcagaccggatcggcttctagtatggtgaatggcgtcgtgagactcctgacaaaaccctgggatgtaatcccgaccgtgactcagatggccatgacggacacaacccctttcggtcaacagcgcgtttttaaggaaaaagtcgatactaggacccaggagcccaaggaagggaccaaaaagttgatgaagattacggcagagtggctgtggaaagagctcggaaagaaaaagaccccacggatgtgtactagagaagagttcacacgcaaagtgaggtccaacgccgctcttggcgcgatctttaccgacgaaaataagtggaaaagcgcccgagaggcagtggaggattcacggttctgggaactggtcgacaaggagagaaacttacatctggaaggcaagtgcgagacttgtgtttataatatgatggggaaaagggaaaagaaattgggagagtttggtaaggctaaaggctcccgcgccatttggtacatgtggctcggggcacgtttcctggagtttgaagccctaggattccttaacgaggatcactggttttctcgggaaaatagcctgagtggcgtggagggtgaagggctccacaagctgggatacatcttgagagacgtatccaagaaagagggcggcgctatgtatgccgatgacacagcggggtgggataccaggataacactggaggacctcaagaacgaagagatggtgactaatcatatggaaggagagcacaagaaacttgcagaagccatcttcaaactgacctaccagaacaaagtcgtgcgcgttcaacgacctacgccccggggtaccgtgatggacattatcagcagaagggatcagcgcggctctgggcaggtcggaacatatggcttaaacactttcaccaatatggaggctcaactgattagacagatggagggtgaaggggtgtttaagtcaatccagcatttgacagtaactgaggaaattaccgttaaaaactggctcgcccgggtgggaagggagcgtctgagtcgaatggcaatatccggcgacgattgcgtcgtgaagccactagacgatcgcttcgctagcgcccttacggctctgaatgacatgggcaaagtgagaaaggatatccagcaatgggagccctctcgggggtggaacgactggacacaggtccctttttgctcgcaccatttccacgaactcattatgaaagatggaagggttctggtggtaccatgtcgcaatcaggacgagttgatcggtagagcccggatctcacagggcgcagggtggagcttaagggaaaccgcgtgcctgggaaagtcctacgcccaaatgtggagtctcatgtattttcaccgacgtgatcttagactggctgccaacgcaatttgttctgctgtgccgagccattgggtccccacttcccgcacaacctggtcaatacacgcccggcatgagtggatgactaccgaagacatgctaacagtgtggaatagggtttggatccaggagaacccttggatggaggataagacgccagtggaaagttgggaggaaattccctacctgggcaaaagagaggaccagtggtgcggttctctcatcgggttgaccagccgcgcaacttgggccaagaatattcagacagcgatcaaccaagtccggtccctgataggaaatgaagagtataccgactacatgccttcaatgaaaaggttccgaagagaggaagaggaagctggcgtgctttggtga

SEQ ID NO: 15047 - RNA, 9876 nt, synthetic construct
  misc_feature 1..9876: note = derived and/or modified CDS sequence (opt3) from DENV-2__EU056811__SS-prME
  source 1..9876: mol_type = other RNA
accgccggcatgatcattatgctgatacccacagtgatggctttccacctcactacgagaaacggggagcctcatatgatcgtcagcaggcaggaaaagggaaaatcccttctgtttaagaccaaagacggtacaaatatgtgcactttgatggcaatggatttaggcgagctgtgtgaagacaccattacatacaagtgcccattcctaaaacaaaacgagccggaagatatcgactgttggtgcaattctacctcaacttgggttacatatgggacctgtacgactaccggagagcaccggcgcgagaagcgaagtgtggccctcgtaccccatgtgggcatgggtctggaaacacgtactgagacctggatgagctccgaaggggcgtggaagcacgctcagagaattgagacatggatccttaggcatcctggatttaccataatggccgcaatcctggcctacacgattggcactacacacttccagcgggtcttgatctttattctcctgaccgctatcgcaccatctatgactatgcgctgcataggcatttcgaacagagatttcgtggagggggtttcaggaggtagctgggtggacatcgtcctggaacacggcagttgtgtgacaaccatggccaaaaataagcccacgctcgattttgagttaattaaaaccgaagctaagcagcctgccacactgaggaaatattgcatcgaggcgaagcttactaacaccacaactgactcccggtgtccaacccaaggggaacccacattgaatgaggagcaggataagcgcttcgtatgcaaacattctatggttgaccgaggatggggcaacggttgtgggctgtttggaaagggcggcatcgtgacctgcgcaatgttcacttgcaaaaagaatatggaagggaaaattgtccagcctgagaacctagaatacacggtggtgataacaccacacagcggagaggaacatgccgtcggtaatgataccggcaagcacgggaaagaggttaagatcactccgcagtcctcaattaccgaggctgaactcacaggatatggcaccgtgactatggagtgtagtcccagaacaggtctggactttaacgaaatggtacttctgcaaatggaggataaggcctggttggtgcacaggcagtggttcctcgacctgcctttaccatggctgcccggggcagacacgcagggcagcaattggatccagaaagaaaccctcgtcacttttaagaaccctcatgctaaaaagcaagatgtggttgtgcttggatctcaggagggcgccatgcacacagcgctgaccggggccacagagatacagatgtcctcaggaaatttgctattcactggtcatctgaaatgccggctccgtatggacaagctgcaacttaagggcatgagctacagtatgtgtaccgggaaattcaagattgtcaaagaaatcgcagagacgcagcacggaaccatcgtgattcgcgtacagtatgaaggcgatggttctccatgcaagatcccctttgagattatggacctggagaaaagacatgttttggggaggctcataacagtgaacccgatcgtcactgaaaaggattcccctgtgaacattgaggctgaacccccattcggcgacagctacatcatcattggagtcgagcctggccagctgaagttagattggtttaaaaaggggtcgtctataggacaaatgttcgaaaccacaatgcggggtgccaaacgaatggctatcctgggcgacactgcctgggattttgggtccctaggaggcgtgttcacctcaattggtaaggcactccaccaggtttttggggccatctacggcgctgcgttcagtggagtgagctggacgatgaaaattctgatcggcgtaataatcacatggattgggatgaattcccgctctaccagcctttcagtcagtttggtgctggttggaatcgtgactctctatctgggcgtcatggtgcaggcagactccggttgtgtagtgagctggaagaacaaggagcttaaatgcgggtctggaatttttgttacagataatgtccacacctggactgagcagtacaagttccaacccgaatcaccaagtaaactggccagcgctatccagaaggcccatgaggaaggcatatgtggtattagatccgtgaccaggttggagaacctcatgtggaaacagatcacatctgaactgaatcacattttatcggagaacgaggtgaagctgacgatcatgaccggcgacataaaagggatcatgcaggtcggaaagcggagcctacgcccccaacctactgaactcagatattcctggaagacatggggcaaagcaaagatgctgtcaaccgagcttcataatcagacatttttgattgacgggccagaaactgccgagtgcccgaacaccaatagggcttggaacagtctggaagttgaggattacggattcggcgtgtttacgacaaatatctggctccgtctgcgggagaaacaggacgccttctgtgattctaagttaatgagcgcagcgattaaagacaaccgagctgtgcacgccgatatgggttattggatcgaatccgcactgaatgacacctggaagatagagaaggcctcattcattgaagtaaaaagctgccactggcccaagtctcatactctttggtccaacggggtcttggagagtgagatggtgatccctaaaaatatcgctggaccagttagccagcacaacaacagacccggctaccatacccaaacagccggtccttggcacctcggcaagctggaaatggattttgacttctgtgaggggactaccgtggtcgtgacagaagagtgcggaaataggggcccatctctacgcacgaccactgcatccgggaaactgattacagaatggtgctgtcggtcatgcaccctccccccgctgagatataggggagaggatggctgttggtacggtatggagatccgccctcttaaggaaaaggaggaaaacttggttagtagcctggtgactgctgggcatggacagattgacaatttttcgttaggcatactcggtatggccctgttccttgaggaaatgctgcgaacacgggtaggcaccaaacacgcgatcttgctcgtcgccgtgtcctttctgacgctaattactgggaacatgtctttccgtgatctgggaagagtgatggtcatggttggcgctaccatgacagacgatatcgggatgggagtgacctacctcgcactgcttgccgcttttaaggtaaggccaactttcgccgcaggcttgctgttacgcaaactcacaagcaaggagctgatgatgaccacaattggtatcgtgcttctgtcacagagttccatacccgagactatcctagaactcaccgacgcgctggccttggggatgatggtcctgaaaatggtgcggaatatggagaagtatcaattagctgttacgattatggccatcctctgcgtgcctaacgcagtcattctgcagaatgcttggaaggtgtcttgtacaacccttgccgttgtgagcgtctcccccctgttgctcacttcaagccagcagaaagcagactggatcccactggccctaaccataaagggactgaaccctacagctatttttcttactaccctcacgagaacaagtaaaaagaggtcttggcccctgaatgaagcgatcatggccgtaggcatggtgtccatcttggcaagctcgctgttaaaaaacgatattccaatgaccggcccgctcgttgctgggggactgcttactgtgtgctacgtcctgacaggtcgatcagccgacttggagctcgaacgcgccaccgatgtgaagtgggacgatcaagctgagatatctggcagttcccctatcctgagcattactatctctgaggacgggagcatgtccattaaaaatgaagaggaagagcagacactaaccatcctgatacggacgggacttctcgtaatctcaggcctgttccccgtgagtattccaatcactgcagccgcgtggtatttgtgggaggtcaagaagcagagagctggtgttttatgggatgtgcccagccctccacccgtggggagggccgaactggaggacggagcataccgtattaaacagaagggcatcctcggctattctcaaataggggccggagtctacaaagaaggtacctttcacacaatgtggcatgtgacccgcggcgctgttctgatgcacaaggggaaacggattgagccttcctgggcagatgtaaagaaggaccttatctcatatggaggcggttggaaactggaaggggagtggaaggagggagaagaggtgcaggtcttggccctagaaccgggcaaaaacccaagagcggtgcagacaaagcccggcctgttcaggactaataccgggacgatcggagctgttagtctcgattttagccctggtacatccggctctccaattgtggacaaaaaggggaaggtcgtgggactgtacggcaacggtgtagtcactcgagggggagcctacgtgtcggcaatcgcccagaccgagaaaggcatagaagataatcccgagattgaggacgacatcttccggaagcgcagacttacaattatggatttacatcctggcgctgggaaaaccaagaggtatctgccggccatcgttcgggaagcaataaaacgaggactcagaactttgattctggctcccacccgcgtggtcgccgcggagatggaagaggccctcaggggtctgccaatccgttaccaaacacctgcaatccgggctgaacacacgggcagagagattgtggaccttatgtgtcatgccactttcaccatgaggctgttgagccccatccgcgttccaaactataacctaattataatggatgaggctcactttacagaccctgcatcaatcgccgcccgagggtacatttccaccagagtggaaatgggagaggctgcgggcatcttcatgactgcaacacccccaggtagtcgggatccgtttcctcagtctaatgcccccatcatggacgaagagagggagattccagaacgcagctggaactccgggcacgagtgggtcaccgatttcaagggaaagacggtgtggtttgtaccctcaataaaaactggcaatgacatcgctgcctgcctgcgtaagaacggcaaaagagtgattcagctctctcggaagacattcgatagcgaatatgttaaaaccaggaccaatgactgggattttgtcgtgactacagacatcagtgagatgggggcaaacttcaaggccgaacgcgtgattgaccctcgaagatgtatgaagccagtcatcttaaccgatggagaggagcgggtaatactggctggtcccatgcctgtgacacattccagcgcggcccaaaggcgcggcagaatcgggaggaatccgcggaacgaaaatgaccagtacatttatatgggagagccacttgaaaacgatgaggactgcgcacactggaaagaagctaagatgctgctcgataatatcaacactcccgagggcattatcccttctatgtttgagcccgaacgtgagaaagttgacgccatagatggtgaataccgcttgcgaggggaggcaagaaagacgttcgtggacctgatgaggcggggcgatctcccagtctggctggcctacaaagtggctgccgaaggaattaattatgcggaccgcagatggtgttttgatggcaccaggaacaatcagatccttgaggagaacgttgaagtggagatttggacaaaggaaggggagcggaaaaagctaaagcctcgatggctggacgcaagaatctactcagatcccttggccttaaaagagttcaaggaattcgctgccggacgcaaatccctgactctcaacctgataaccgagatgggtaggcttccaacatttatgacccagaaggctcgggacgcactggacaatctcgccgtcttgcatactgctgaagccggcgggaaagcatataaccacgcgctgagtgagctacctgaaacgctggagaccctccttctgttaacattgctggccactgtgaccggaggcatcttcctctttctgatgagcggtcgtgggattggcaagatgacacttggaatgtgctgcatcattaccgcttcgatcctgctctggtacgcccaaatacagccgcactggattgcagcttctatcatcttggagttctttctgattgtattactaatccccgaaccagagaagcagagaactcctcaggataatcaactgacatatgtgataattgccatcctcacggttgtcgcagccaccatggctaacgaaatgggcttccttgagaaaactaagaaagacctggggttgggacatattgcgacacagcagcccgaatccaatatcctggatatagacctcaggccagccagcgcatggaccctgtacgctgtggccaccacatttatcactcctatgcttcgccactcaattgagaacagttctgtgaatgtctccctcacggccatcgcaaaccaggctaccgttctgatgggtttgggcaaggggtggcccctgagcaaaatggatattggagtgccgttactagccatcggctgttattcacaagtaaatccaattacactgactgcggctctccttatgctggtggcccattacgcaatcataggtcctgggttgcaggccaaggctacccgggaggcacagaagcgagccgcggctggcattatgaaaaaccccacagtcgacggaatcaccgtgatcgatctggacccaattccctacgatcctaagttcgaaaaacagctcggccaagttatgctgcttgtgttatgcgtcactcaggtactgatgatgagaacgacatgggccctctgtgaggcattgaccctggccactgggccggtgagtaccctatgggaaggaaatcccggcaggttttggaacacaactatagctgttagcatggccaatatcttccgcggttcctatctggcaggggctggactccttttttctattatgaagaacaccacaagcacgcggagaggcaccggtaatatgggcgagactctgggggaaaaatggaagaaccgtttgaatgccctgggaaagtccgagttccagatctacaaaaagtcaggcattcaagaggtggacaggacactcgcgaaagaagggatcaagcggggagagaccgatcaccatgccgtctctcgcggcagtgcaaaactgcgatggtttgtggaaagaaacttagtcactccagagggtaaggtggttgaccttgggtgcggaaggggcggttggtcgtattactgtggcgggctgaaaaacgtgcgggaggtaaagggactcacaaagggcgggcctggacacgaagagcccatacctatgagcacctatggctggaatctagtgcgcctgcagtccggtgtcgatgttttcttcgtgccacccgaaaaatgcgacacgttgctgtgtgacatcggggagtcttcacctaacccaaccgtcgaagctggaagaacactcagggtgcttaatctggtagagaactggttgaataacaatactcagttttgcgtgaaggttctgaacccctacatgccgagcgtgattgagcgaatggaaaccctccagcggaaatatggcggcgccttagtccgtaatcctctgtccagaaacagtacacacgagatgtactgggtgtctaatgcaagcgggaacatcgtctcatccgtgaatatgattagtcgcatgcttatcaacaggttcactatgcggcataagaaagctacctacgaaccagatgttgacctgggaagcggtacaagaaatataggcattgagtctgaaacccccaacctagatatcatcgggaagcgcattgagaagataaaacaagagcacgaaacttcctggcattatgaccaggatcacccttacaagacgtgggcctatcacggatcatacgagacaaaacagaccggcagcgcctcgtctatggtaaacggtgtggtcaggctcctgactaagccatgggacgtgatccccatggttacccagatggcgatgacagatacgaccccgtttgggcaacagcgagtgttcaaagaaaaggtcgacactcggacacaggagcctaaggaaggaaccaaaaagttgatgaaaattactgctgagtggctgtggaaggagctcggcaaaaagaagacacccagaatgtgtaccagggaagagtttacaaaaaaggtgcgcagtaatgcagcccttggcgctatcttcactgatgaaaacaaatggaagtccgcccgtgaggcagtagaggacaatcggttttgggaactggtggataaagagagaaacttacatctggaagggaagtgcgagacctgtgtttataatatgatgggaaaaagggaaaagaagttgggtgagttcggcaaagccaaggggagccgcgctatttggtacatgtggctcggagcgcgatttctggagttcgaagccctaggctttcttaacgaggaccactggttctcacgggaaaattccctgtctggtgtcgagggggaaggactccataaactgggctatatcttgagagaggtgagcaagaaagagggcggggcaatgtacgctgacgatacggccggatgggacaccaggataacaatcgaagatctgaagaacgaggaaatgattactaatcacatggcaggtgagcataagaaactcgccgaagctatctttaagcttacctaccagaacaaagtggtccgcgttcaaagaccaacacctcggggcactgtgatggacattatcagtaggcgtgatcagcgagggtccggacaggtagtgacctatggcctgaatacgttcacaaacatggaggcccaattaattcgccagatggagggtgaaggggtcttcaagagcatacagcacctgaccgcgtctgaggaaatcgcagtgcaggactggttggttagagtgggacgggagaggctctcacgcatggccattagtggcgatgactgcgtcgtgaaacccctggatgacagatttgctaaggccctaactgcacttaatgatatgggcaaggtacggaaagacatccaacagtgggagccatccagggggtggaacgattggacacaggttcccttctgcagccaccattttcacgaactgatcatgaaggacggacgaaccctcgtggtcccttgtcgtaatcaggacgagctgattggtagagctcgcatatctcaaggcgccgggtggtcgttgcgggaaactgcttgcttaggaaaatcatacgcccagatgtggagcctgatgtatttccataggagagatctccgccttgcagcgaacgccatctgttccgctgtgccaagtcactgggtgccgacctctcggacaacgtggagcattcacgcctcccatgagtggatgaccactgaagacatgctgacagtctggaacagggtttggatcctagagaatccctggatggaggataagacccctgtggaatcatgggaggaaattccatacctgggcaaacgagaggaccagtggtgcggtagtctcatcgggttgacttctagagcaacatgggctaagaacatacagaccgccatcaatcaagtacggagcctgattggaaacgaagagtatacggattacatgccctccatgaagaggtttcgccgtgaggaagaggaagcaggcgtgctttggtga

SEQ ID NO: 15048 - RNA, 9876 nt, synthetic construct
  misc_feature 1..9876: note = derived and/or modified CDS sequence (opt3) from DENV-2__DQ645545__SS-prME
  source 1..9876: mol_type = other RNA
accgcaggcgtgatcattatgatgatacccaccgtagttgctttccacctgactacgcggaatggggagcctcatatgatcgtgagcaggcaggaaaagggaaagtccctcctttttaagaccgagaatggtgtaaatatgtgcacactgatggcaatggacttgggcgaattatgtgaggatactattacctacaattgcccactgctgcggcaaaacgaaccggaggacatcgattgttggtgcaattctacatcaacctgggtgacttatgggacatgtaccgccacgggagagcaccgccgagaaaaacgtagtgtcgcgctcgtgccccatgttggcatgggtctggagactagaaccgaaacatggatgagctcccagggggcttggaagcacgcccagaggattgagacttgggtgcttcggcatcctggattcaccatcatggcagccatactggcttacacaatcggcaccacgtattttcagcgcgtcttgattttcatcctcctgactgcagtggccccatctatgacaatgagatgcattggcatctcgaacagggactttgtagagggggtttcaggaggtagctgggtggatatagtcctggaacacggcagttgtgtgaccactatggctaaaaataagcccacactcgacttcgagttaattaagaccgaagccaaacaccctgcgacgctgcggaagtactgcatcgaggcaaaacttaccaacacaactaccgcctcccgctgtccaacacaaggggaaccctctttgaatgaggagcaggataagcgatttgtgtgcaaacatagcatggtcgacagaggatggggcaacggttgtgggctgttcggaaagggcggcattgttacttgcgctatgtttacctgcaagaaaaatatggaagggaaggtggtacagcctgagaacctagaatatacaatcgtgatcaccccacactccggagaggaaaatgccgtcggtaacgatactggcaaacatgggaaggagattaaagtgacgccgcagtcaagtataacagaggcagaactcaccggatacggcactgttaccatggagtgtagccccaggacaggtctggacttcaatgaaatggtgcttctgcaaatggaggataaggcttggttggtccaccggcagtggtttctcgacctgcctttaccatggctgcccggggccgatacccagggctctaactggatccagaaagaaactctcgtgacattcaagaaccctcacgcgaagaaacaagacgtagttgtgcttggatcccaggagggcgccatgcatacggcactgaccggggctactgagattcagatgtcaagcggaaatttgctatttacaggtcacctgaagtgccgtctccgcatggacaaactgcaacttaagggcatgagttattctatgtgtaccgggaaattcaaggtcgtgaaggaaatcgccgagacacagcatggaactatagtcattagagtgcagtacgaaggcgatggttccccatgcaaaatccccttcgagatcatggacctggagaagaggcacgttttggggcggctcattaccgtgaacccgatcgtaacgggcaaagatagccctgtcaatattgaagctgagcccccatttggagactcgtacataatcattggcgtggaacctgggcagctgaagttatcttggttcaaaaagggatcctcaatcggtcaaatgtttgagaccacaatgcgaggcgccaagcgcatggcaatcctgggggatactgcctgggacttcggaagtctaggcggtgtttttaccagcattgggaaagctctccatcaggtgttcggcgcgatatatggagcagccttttccggcgtctcttggacaatgaagatcctgattggggtggtaatcacttggattggaatgaacagcagatcaaccagtctttccgtgagcttggttctggtcggcgtggtgacgctctacctgggtgtcatggttcaggctgattctgggtgtgtggtgtcatggaaaaataaggaacttaaatgcggaagtggcatcttcataacagacaacgtacacacctggactgagcagtataagtttcaacccgagagcccatccaagctggcctctgcaatccagaaagcccacgaagagggtatttgtggcatcaggtcggtcacacggttggaaaatctcatgtggaagcagattacccccgagctgaaccatatcttaagcgaaaatgaggtgaaactgactataatgaccggggatattaagggaatcatgcaggctggcaaacgctccctaagacctcaaccaacagagctcaagtactcatggaaagcctgggggaaggcaaagatgctgagtacggaacttcacaaccataccttcttgattgacggaccggagactgcggaatgccccaatacaaacagggcttggaactctctggaggttgaagattatggctttggtgtgttcaccacaaacatctggctcaaactgaaggagcgtcaggacgtcttttgtgacagcaaattaatgtccgccgcaataaaggataatcgggccgtgcacgctgacatggggtactggatcgagtcagccctgaacgatacttggaaaattgaaaaggccagcttcatcgaggttaagtcttgccactggcctaaatcccataccctttggagtaacggagtgttggaaagcgagatgattatcccaaagaatttcgctggccccgtatctcagcacaactatcgacctggttaccatacgcagacagccggcccatggcacctcgggaaactggagatggactttgatttctgtgaaggaaccactgtcgtggtgaccgaggactgcggcaatagagggccctccctaaggacaactaccgcgtcaggaaagctgataacagaatggtgctgtcgcagttgcacgctcccgcctctgcggtacagaggcgaggatggttgttggtatgggatggaaattaggccacttaaagagaaggaggaaaacttggtcaatagcctggttaccgccggacatggccaaatcgacaacttttcgttaggtgtgctcggcatggctctgttccttgaggaaatgctgcgcactcgagtagggacaaagcacgcaatcttgctcgtggccgtctcctttgtgaccctgattactggaaatatgtctttccgggatctaggccgtgttatggtgatggtcggggctacaatgaccgacgatatcggaatgggcgtgacgtacctggccctcctggcagcgtttaaagttagacccactttcgccgctggtcttttgctgaggaagttaaccagcaaagagctcatgatgacaaccattgggatagtgctgctttcacagagtactatccctgaaacaattctggagctaaccgacgccctcgcactgggaatgatggtcttgaagatcgtacgcaacatggagaaatatcagctggctgtgacaattatggccatcttatgcgttcccaatgcagtgatactccaaaacgcctggaaggtctcctgtactatcctggctgtggtatctgtgagcccacttctgttgacctcctcacagcagaaggcggattggattcctctcgccctgacgatcaaaggcctaaatcccacagcaatttttctgaccactcttagccggaccagtaagaaaagatcttggccactcaacgaagctatcatggccgtcggcatggtttccatactggccagctcgttgctgaagaatgacattccgatgacagggcctttagtggctggaggtctcctgactgtgtgctacgtccttaccggcaggtcagcagacctggagttggaacgagccgcggatgtgcgctgggaggaacaggctgagatctctgggagttcccccatcctcagcattacgatatctgaggacggaagcatgtccatcaaaaacgaagaggaggaacaaacactgaccattctaatccggactggcctgcttgttatttcaggtctcttcccagtaagtatccccataacagccgcagcctggtatctgtgggaggtgaagaaacagagagctggggtcttgtgggatgtgcctagcccaccccctgttggaaaggcagaattagaggacggcgcctacaggatcaagcagaaaggcattctggggtattctcagatcggagcgggtgtgtacaaggaaggcacctttcacactatgtggcatgtcacacgtggggctgtgctcatgcacaaaggaaagcgcattgagccgtcctgggccgatgtcaagaaggacctgatctcatacggcggtgggtggaaacttgaaggagagtggaaagagggcgaagaggtccaagtgctggcattggaaccaggcaagaatccccgggccgttcagaccaaacctgggctattcaagacgaacactggaaccataggtgctgtgagtctggattttagcccaggcacatccgggtctcccattgtcgacaaaaagggaaaggtggttggcctctatggtaacggggtggtcaccagatcgggaacatacgtgagcgccatcgcacagactgagaaatcaatcgaagataatcctgagattgaggacgatatcttcaggaagaaacgactgaccataatggaccttcatccgggcgctggcaagacgaaacggtatttacccgccattgtacgcgaagcgatcaagagagggctgaggacactcattttggccccaactcgggtggttgcagctgagatggaagaggccctgcgaggactccctatcagataccagacccccgctatacgcgcagaacacacaggtagggagattgtcgatctgatgtgtcatgccaccttcactatgcgtcttctgtccccaatccgggtgcctaactataatttgatcattatggacgaggcccactttaccgaccccgctagtatcgcggcaagaggctacatttctacaagggtggaaatgggggaggccgctggaatattcatgacggccactccaccgggcagccgcgatccttttccccaatccaacgcaccaatcatggacgaagaacgagagattcccgaaagatcatggaactctggtcacgagtgggtcaccgatttcaaggggaaaacagtatggtttgtgcctagcatcaaggccggaaacgacatcgctgcgtgcctacggaaaaatggcaagaaagttattcagctgagtaggaagaccttcgattccgaatatgtgaagactcgcacaaacgactgggattttgtcgtgaccacggacataagcgagatgggcgccaatttcaaagcagaacgtgttatcgatccaagacggtgtatgaagcccgtgattctcactgacggggaggagagggtcatcttagctggacctatgccggtgacacattcttcagccgcacagcgccgaggtagagtaggccggaaccccaagaatgaaaacgatcaatacatttacatgggggagcccctggaaaatgacgaggactgcgcccactggaaggaagctaaaatgcttctggataacatcaatacccctgagggaataatcccctccatgtttgagccagaaagggagaaggtggacgccattgatggcgaatatcgcctcagaggtgaggcgaggaaaaccttcgttgacttgatgcggcgtggggatctgcctgtctggctcgcataccgcgtggccgctgaaggcatcaactatgccgaccgaagatggtgttttgatggagtgaagaacaatcagattctggaggagaacgtcgaagttgagatctggactaaggaaggcgagaggaagaaacttaaaccccggtggctagacgctcgcatatacagtgatccactggcattgaaagagttcaaagagttcgccgctgggagaaagagcttaacactgaatctcattaccgagatgggaaggctgcctacatttatgactcagaaggcccggaacgcacttgacaatctggcggtgctccatacggccgaagctggtggccgagcctataaccacgcattgtcggagctgccggaaaccctagagacactgctccttctgactttattggctaccgtaacagggggaatcttcctgtttctcatgtctggcaaaggtattgggaagatgaccctgggcatgtgctgcatcataactgcctccgtgcttctgtggtacgcacagatccaaccccactggattgccgctagcatcattctcgagttctttttgatcgtcctgttaataccagaacctgagaaacagagaacgccccaggataatcagctaacctatgtggttattgcgatcctgacagtggtcgccgcaactatggctaacgaaatgggattcctcgagaagaccaaaaaggactttggccttgggggaatcgccacacaacagccagaatcaaatattctggatatcgacttgcgccctgccagtgcatggaccctgtacgctgtagccactacattcataacgcccatgctcaggcattctattgagaactccagcgtgaatgtttcactgaccgcgatcgctaaccaggccactgtgcttatgggtctcggcaaggggtggccgctgagtaaaatggacattggagtcccattgctggcaatcggctgttacagccaggtgaatcctataacattaaccgccgctctactgctccttgtcgcacactatgccatcattggtcccgggctgcaagcgaaggctacccgggaggcccagaaacgtgcagccgctggcatcatgaagaacccaacagtggatggaattactgttatcgacttggatcccattccttacgacccgaaatttgaaaagcagctgggccaggtgatgctcctggtactttgcgtgacgcaagtcttaatgatgagaaccacatgggccctgtgtgaggcactcactttggctaccgggcccatctccacactgtgggaaggaaatccaggcaggttctggaacaccactatagccgtttctatggcgaatatttttcgcggtagctatctagccggggcaggactactcttctccatcatgaagaacacggctaacacacggcgaggcaccggtaatactggcgagacccttggggaaaaatggaagaacagactgaatgccttgggaaaatcagagtttcagatctacaagaaatctggcattcaggaggtggataggacactggcaaaggaagggataaaacgcggagagactgaccatcacgctgtcagtcggggctcggccaagctcagatggttcgtggaacgtaacctggtaacccctgagggtaaggtgatggatttagggtgcggaaggggcggttggagctattactgtggcgggcttaaaaatgttaaggaggtgaaaggactgacaaagggcgggcccggacatgaggaacctatcccaatgtccacgtatggctggaacctcgtccggctacaatctggtgtggacgtcttctttacaccacctgaaaaatgcgatactctgttgtgtgacattggggagtcaagcccaaatcccacagtggaagccggacgcaccctgcgagttctcaaccttgtagagaattggctgaacaataacactcagttctgcatcaaggtgttgaatccgtacatgccttccgtcattgagaagatggaagcgctgcagagaaaatacggcggcgctctcgtgaggaacccattaagtagaaattctacacacgagatgtattgggttagcaacgcatcagggaacatcgtgtccagtgtcaatatgataagccgcatgctgatcaacagatttaccatgaggcacaagaaagccacgtacgaacccgatgtggaccttggatctggtacccgaaatattggcatcgagtccgaaacacctaacctggatattatcgggaagcggatagagaaaattaagcaggagcatgaaacttcatggcactatgaccaagaccatccatacaagacctgggcttatcacggaagctacgagacaaaacagactggctcggcctctagtatggtaaatggtgtggttcgtctactcaccaagccctgggatgtcatcccgatggtgacacagatggcaatgaccgacactacgcctttcgggcagcaaagagtgtttaaagaaaaggtcgatacacgcacccaggagcccaaagaaggaactaagaagctgatgaaaatcaccgccgagtggttgtggaaggagctgggcaaaaagaaaacaccaaggatgtgtacgcgggaagagttcaccagaaaggttcgctccaacgctgcgctcggcgccatttttactgacgaaaataaatggaaaagcgcaagggaggctgtggaggattcagggttctgggaacttgtagacaaggagcgaaacctgcacttagaaggaaaatgcgagacatgtgtgtataatatgatgggtaagcgggagaagaagctgggcgagtttgggaaagccaagggatccagagcaatatggtacatgtggttgggcgccaggttcctcgagtttgaagctctgggtttcctaaacgaggatcattggttttctcgcgaaaatagccttagtggggtcgagggagaaggcctgcacaagctcggctacatcctgcgtgacgtgtccaaaaaggaagggggagccatgtatgcggatgacaccgcaggttgggatactcggattacattggaggacctgaaaaacgaagagatggttaccaatcatatggaaggcgagcacaagaaactcgccgaagctatcttcaaacttacataccagaacaaggtggtcagagtgcagaggcctactccccgcgggaccgtaatggacattatcagccgacgggatcaaagaggatctggccaggttgtgacgtatggtctgaataccttcacaaacatggaggcccagttaataaggcaaatggagggggaaggagtctttaaatcaatccagcagctgactgcaaccgaggaaattgctgtgaagaactggttggcccgcgtgggcagagagcggctcagtaggatggctatctccggcgacgattgcgtcgttaaaccactggacgatcgtttcgccagcgcactaacagcgcttaatgacatggggaaggtgcgaaaagatattcagcaatgggagccctctcgcggatggaacgactggactcaggtacctttttgctcgcatcacttccacgaactgatcatgaaggatggtagagtgctcgtcgtgccatgtcggaatcaggacgagctgattggcagggcccgcatatcacagggggctggatggagcttgagagaaaccgcctgcttaggcaagtcctacgcacaaatgtggagtctgatgtattttcatcggagggatctccgacttgctgccaacgcaatctgttctgccgttccgagccactgggtgcccacgtcccgtacaacctggtcaattcatgcgactcacgagtggatgacaaccgaagacatgctgactgtctggaatagagtgtggatccaggagaacccttggatcgaggataaaaccccagtagaaagttgggaggaaattccctacctaggtaagcgcgaggaccagtggtgcgggtctctgataggactcacaagccgggctacgtgggccaaaaatatccagaccgcaattaaccaagttaggtccttgatcggcaatgaagagtatactgactacatgccttcaatgaagagattccgccgggaggaagaggaagccggcgtgctgtggtga

SEQ ID NO: 15049 - RNA, 9876 nt, synthetic construct
  misc_feature 1..9876: note = derived and/or modified CDS sequence (opt3) from DENV-2__DQ645546__SS-prME
  source 1..9876: mol_type = other RNA
accgcaggagtgatcattatgatgatacccaccgtagttgctttccacctgactacgcggaatggggagcctcatatgatcgtgagcaggcaggaaaagggaaagtccctcctttttaagaccgagaatggtgtaaatatgtgcacactgatggcaatggacttgggagaattatgtgaggatactattacctacaattgcccactgctgcggcaaaacgaaccggaggacatcgattgttggtgcaattctacatcaacctgggtgacttatgggacatgtaccgccacgggagagcaccgccgagaaaaacgtagtgtcgcgctcgtgccccatgttggcatgggtctggagactagaaccgaaacatggatgagctccgagggggcttggaagcacgcccagaggattgagacttgggtgcttcggcatcctggattcaccatcatggcagccatactggcttacacaatcggcaccacgtattttcagcgcgtcttgattttcatcctcctgactgcagtggccccatctatgacaatgagatgcattggcatctcgaacagggactttgtagaaggggtttcaggaggtagctgggtggatatagtcctggagcacggcagttgtgtgaccactatggctaaaaataagcccacactcgacttcgaattaattaagaccgaggccaaacaccctgcgacgctgcggaagtactgcatcgaagcaaaacttaccaacacaactaccgcctcccgctgtccaacacagggggagccctctttgaatgaggaacaagataagcgatttgtgtgcaaacatagcatggtcgacagaggatggggcaacggttgtgggctgttcggaaagggcggcattgttacttgcgctatgtttacctgcaagaaaaatatggaggggaaggtggtacagcctgaaaacctagagtatacaatcgtgatcaccccacactccggagaagagaatgccgtcggtaacgatactggcaaacatgggaaggagattaaagtgacgccgcagtcaagtataacagaagcagagctcaccggatacggcactgttaccatggaatgtagccccaggacaggtctggacttcaatgagatggtgcttctgcagatggaagataaggcttggttggtccaccggcaatggtttctcgacctgcctttaccatggctgcccggggccgatacccagggctctaactggatccagaaagagactctcgtgacattcaagaaccctcacgcgaagaaacaggacgtagttgtgcttggatcccaagagggcgccatgcatacggcactgaccggggctactgaaattcagatgtcaagcggaaatttgctatttacaggtcacctgaagtgccgtctccgcatggacaaactgcagcttaagggcatgagttattctatgtgtaccgggaaattcaaggtcgtgaaggagatcgccgaaacacaacatggaactatagtcattagagtgcagtacgagggcgatggttccccatgcaaaatccccttcgagatcatggacctggaaaagaggcacgttttggggcggctcattaccgtgaacccgatcgtaacggagaaagatagccctgtcaatattgaagctgagcccccatttggcgactcgtacataatcattggagtggaacctggccagctgaagttatcttggttcaaaaaggggtcctcaatcggacagatgtttgagaccacaatgcgaggtgccaagcgcatggcaatcctgggcgatactgcctgggacttcgggagtctaggaggcgtttttaccagcattggtaaagctctccatcaagtgttcggggcgatatatggcgcagccttttccggagtctcttggacaatgaagatcctgattggcgtggtaatcacttggattgggatgaacagcagatcaaccagtctttccgtgagcttggttctggtcggagtggtgacgctctacctgggcgtcatggttcaggctgattctggttgtgtggtgtcatggaaaaataaggagcttaaatgcgggagtggaatcttcataacagacaacgtacacacctggactgaacagtataagtttcagcccgagagcccatccaagctggcctctgcaatccaaaaagcccacgaagagggcatttgtggtatcaggtcggtcacacggttggaaaatctcatgtggaagcagattacccccgagctgaaccatatcttaagcgagaatgaagtgaaactgactataatgaccggcgatattaaggggatcatgcaggctggaaaacgctccctaagacctcagccaacagagctcaagtactcatggaaagcctggggcaaggcaaagatgctgagtacggaacttcacaaccataccttcttgattgacgggccggagactgcggaatgccccaatacaaacagggcttggaactctctggaggttgaggattatggatttggcgtgttcaccacaaacatctggctcaaactgaaggaacgtcaagacgtcttttgtgacagcaaattaatgtccgccgcaataaaggataatcgggccgtgcacgctgacatgggttactggatcgagtcagccctgaacgatacttggaaaattgaaaaggccagcttcatcgaggttaagtcttgccactggcctaaatcccataccctttggagtaacggggtgttggagagcgaaatgattatcccaaagaatttcgctggacccgtatctcagcacaactatcgacctggctaccatacgcagacagccggtccatggcacctcggcaaactggagatggactttgatttctgtgaagggaccactgtcgtggtgaccgaggactgcggaaatagaggcccctccctaaggacaactaccgcgtcagggaagctgataacagaatggtgctgtcgcagttgcacgctcccgcctctgcggtacagaggagaggatggctgttggtatggtatggagattaggccacttaaagaaaaggaggaaaacttggtcaatagcctggttaccgccgggcatggacagatcgacaacttttcgttaggcgtgctcggtatggctctgttccttgaggaaatgctgcgcactcgagtaggcacaaagcacgcaatcttgctcgtggccgtctcctttgtgaccctgattactgggaatatgtctttccgggatctaggacgtgttatggtgatggtcggcgctacaatgaccgacgatatcgggatgggagtgacgtacctggccctcctggcagcgtttaaagttagacccactttcgccgctggccttttgctgaggaagttaaccagcaaagagctcatgatgacaaccattggtatagtgctgctttcacaaagtactatccctgagacaattctggaactaaccgacgccctcgcactggggatgatggtcttgaagatcgtacgcaacatggagaaatatcagctggctgtgacaattatggccatcttatgcgttcccaatgcagtgatactccagaacgcctggaaggtctcctgtactatcctggctgtggtatctgtgagcccacttctgttgacctcctcacaacagaaggcggattggattcctctcgccctgacgatcaaaggactaaatcccacagcaatttttctgaccactcttagccggaccagtaagaaaagatcttggccactcaacgaagctatcatggccgtcggcatggtttccatactggccagctcgttgctgaagaatgacattccgatgacaggccctttagtggctgggggactcctgactgtgtgctacgtccttaccggtaggtcagcagacctggagttggaacgagccgcggatgtgcgctgggaggagcaggctgaaatctctggcagttcccccatcctcagcattacgatatctgaggacgggagcatgtccatcaaaaacgaagaggaggaacagacactgaccattctaatccggactggactgcttgttatttcaggcctcttcccagtaagtatccccataacagccgcagcctggtatctgtgggaggtgaagaaacaaagagctggtgtcttgtgggatgtgcctagcccaccccctgttgggaaggcagaattagaggacggagcctacaggatcaagcagaaaggcattctgggctattctcagatcggggcgggagtgtacaaggaaggtacctttcacactatgtggcatgtcacacgtggcgctgtgctcatgcacaaagggaagcgcattgagccgtcctgggccgatgtcaagaaggacctgatctcatacggaggcggttggaaacttgagggggaatggaaagagggagaagaggtccaggtgctggcattggaaccaggcaagaatccccgggccgttcaaaccaaacctggcctattcaagacgaacactgggaccataggagctgtgagtctggattttagcccaggtacatccggctctcccattgtcgacaaaaaggggaaggtggttggactctatggcaacggtgtggtcaccagatcggggacatacgtgagcgccatcgcacagactgagaaatcaatcgaggataatcctgaaattgaggacgatatcttcaggaagaaacgactgaccataatggaccttcatccgggagctggcaagacgaaacggtatttacccgccattgtacgcgaagcgatcaagagaggcctgaggacactcattttggccccaactcgggtggttgcagctgagatggaagaggccctgcgagggctccctatcagataccagacccccgctatacgcgcagagcacacaggaagggaaattgtcgatctgatgtgtcatgccaccttcactatgcgtcttctgtccccaatccgggtgcctaactataatttgatcattatggacgaggcccactttaccgaccccgctagtatcgcggcaagaggttacatttctacaagggtggaaatgggcgaggccgctgggatattcatgacggccactccaccgggaagccgcgatccttttccccagtccaacgcaccaatcatggacgaggaacgagagattcccgaaagatcatggaactctggccacgagtgggtcaccgatttcaagggtaaaacagtatggtttgtgcctagcatcaaggccgggaacgacatcgctgcgtgcctacggaaaaatggaaagaaagttattcaactgagtaggaagaccttcgattccgaatatgtgaagactcgcacaaacgactgggattttgtcgtgaccacggacataagcgagatgggcgccaatttcaaagcagagcgtgttatcgatccaagacggtgtatgaagcccgtgattctcactgacggcgaagagagggtcatcttagctgggcctatgccggtgacacattcttcagccgcacagcgccgaggaagagtaggtcggaaccccaagaatgaaaacgatcagtacatttacatgggcgagcccctggaaaatgacgaggactgcgcccactggaaggaggctaaaatgcttctggataacatcaatacccctgaagggataatcccctccatgtttgagccagaaagggagaaggtggacgccattgatggagaatatcgcctcagaggcgaggcgaggaaaaccttcgttgacttgatgcggcgtggtgatctgcctgtctggctcgcataccgcgtggccgctgaggggatcaactatgccgaccgaagatggtgttttgatggcgtgaagaacaatcaaattctggaagagaacgtcgaagttgagatctggactaaggagggagaaaggaagaaacttaaaccccggtggctagacgctcgcatatacagtgatccactggcattgaaagagttcaaagagttcgccgctggcagaaagagcttaacactgaatctcattaccgagatggggaggctgcctacatttatgactcagaaggcccggaacgcacttgacaatctggcggtgctccatacggccgaagctggaggtcgagcctataaccacgcattgtcggagctgccggagaccctagaaacactgctccttctgactttattggctaccgtaacaggcgggatcttcctgtttctcatgtctggaaaaggcattggtaagatgaccctggggatgtgctgcatcataactgcctccgtgcttctgtggtacgcacagatccagccccactggattgccgctagcatcattctcgagttctttttgatcgtcctgttaataccagaacctgagaaacaaagaacgccccaggataatcagctaacctatgtggttattgcgatcctgacagtggtcgccgcaactatggctaacgaaatgggcttcctcgagaagaccaaaaaggactttggacttggcgggatcgccacacagcaaccagagtcaaatattctggatatcgacttgcgccctgccagtgcatggaccctgtacgctgtagccactacattcataacgcccatgctcaggcattctattgaaaactccagcgtgaatgtttcactgaccgcgatcgctaaccaggccactgtgcttatgggactcggtaagggctggccgctgagtaaaatggacattggggtcccattgctggcaatcggatgttacagccaggtgaatcctataacattaaccgccgctctactgctccttgtcgcacactatgccatcattggccccggtctgcaggcgaaggctacccgggaggcccaaaaacgtgcagccgctgggatcatgaagaacccaacagtggatggcattactgttatcgacttggatcccattccttacgacccgaaatttgaaaagcagctgggacaggtgatgctcctggtactttgcgtgacgcaggtcttaatgatgagaaccacatgggccctgtgtgaggcactcactttggctaccggccccatctccacactgtgggaagggaatccaggaaggttctggaacaccactatagccgtttctatggcgaatatttttcgcggcagctatctagccggtgcagggctactcttctccatcatgaagaacacggctaacacacggcgaggaaccggcaatactggtgagacccttggcgagaaatggaagaacagactgaatgccttggggaaatcagaatttcaaatctacaagaaatctggcattcaggaggtggataggacactggcaaaggaaggcataaaacgcggggagactgaccatcacgctgtcagtcggggatcggccaagctcagatggttcgtggagcgtaacctggtaacccctgaaggcaaggtgatggatttaggttgcgggaggggaggctggagctattactgtggtggccttaaaaatgttaaggaggtgaaagggctgacaaagggaggccccgggcatgaagaacctatcccaatgtccacgtatggatggaacctcgtccggctacagtctggcgtggacgtcttctttacaccacctgaaaaatgcgatactctgttgtgtgacattggtgagtcaagcccaaatcccacagtggaggccgggcgcaccctgcgagttctcaaccttgtagaaaattggctgaacaataacactcaattctgcatcaaggtgttgaatccgtacatgccttccgtcattgagaagatggaagcgctgcagagaaaatacggaggcgctctcgtgaggaacccattaagtagaaattctacacacgagatgtattgggttagcaacgcatcaggcaacatcgtgtccagtgtcaatatgataagccgcatgctgatcaacagatttaccatgaggcacaagaaagccacgtacgaacccgatgtggaccttgggtctggaacccgaaatattggtatcgagtccgagacacctaacctggatattatcggcaagcggatagagaaaattaagcaggaacatgaaacttcatggcactatgaccaggaccatccatacaagacctgggcttatcacgggagctacgagacaaaacaaactggatcggcctctagtatggtaaatggcgtggttcgtctactcaccaagccctgggatgtcatcccgatggtgacacagatggcaatgaccgacactacgcctttcggtcagcagagagtgtttaaagaaaaggtcgatacacgcacccaagagcccaaagaggggactaagaagctgatgaaaatcaccgccgaatggttgtggaaggagctgggcaagaagaaaacaccaaggatgtgtacgcgggaagagttcaccagaaaggttcgctccaacgctgcgctcggcgccatttttactgacgagaataaatggaaaagcgcaagggaagctgtggaggattcaggcttctgggaacttgtagacaaggagcgaaacctgcacttagaagggaaatgcgagacatgtgtgtataatatgatgggaaagcgggagaaaaagctgggtgaatttggcaaagccaaggggtccagagcaatatggtacatgtggttgggagccaggttcctcgagtttgaagctctgggcttcctaaacgaggatcattggttttctcgcgaaaatagccttagtggtgtcgagggggagggactgcacaagctcggctacatcctgcgtgacgtgtccaaaaaggaaggcggggccatgtatgcggatgacaccgcaggatgggatactcggattacattggaggacctgaaaaacgaagagatggttaccaatcatatggaaggtgagcacaagaaactcgccgaggctatcttcaaacttacataccagaacaaggtggtcagagtgcagaggcctactccccgcggcaccgtaatggacattatcagccgacgggatcagagagggtctggacaagttgtgacgtatggcctgaataccttcacaaacatggaagcccagttaataaggcagatggagggtgaaggggtctttaaatcaatccaacagctgactgcaaccgaggagattgctgtgaagaactggttggcccgcgtgggaagagaacggctcagtaggatggctatctccggcgacgattgcgtcgttaaaccactggacgatcgtttcgccagcgcactaacagcgcttaatgacatgggcaaggtgcgaaaagatattcagcagtgggagccctctcgcgggtggaacgactggactcaagtacctttttgctcgcatcacttccacgaactgatcatgaaggatggaagagtgctcgtcgtgccatgtcggaatcaggacgagctgattggtagggcccgcatatcacagggcgctgggtggagcttgagagaaaccgcctgcttaggaaagtcctacgcacagatgtggagtctgatgtattttcatcggagggatctccgacttgctgccaacgcaatctgttctgccgttccgagccactgggtgcccacgtcccgtacaacctggtcaattcatgcgactcacgagtggatgacaaccgaggacatgctgactgtctggaatagagtgtggatccaagaaaacccttggatcgaggataaaaccccagtagaaagttgggaggaaattccctacctaggcaagcgcgaggaccagtggtgcggttctctgatagggctcacaagccgggctacgtgggccaaaaatatccagaccgcaattaaccaggttaggtccttgatcggaaatgaggaatatactgactacatgccttcaatgaagagattccgccgggaggaagaggaagccggcgtgctgtggtga

SEQ ID NO: 15050 - RNA, 9876 nt, synthetic construct
  misc_feature 1..9876: note = derived and/or modified CDS sequence (opt3) from DENV-2__DQ645547__SS-prME
  source 1..9876: mol_type = other RNA
accgcaggagtgatcattatgatgatacccaccgtagttgctttccacctgactacgcggaatggggagcctcatatgatcgtgagcaggcaggaaaagggaaagtccctcctttttaagaccgagaatggtgtaaatatgtgcacactgatggcaatggacttgggagaattatgtgaggatactattacctacaattgcccactgctgcggcaaaacgaaccggaggacatcgattgttggtgcaattctacatcaacctgggtgacttatgggacatgtaccgccacgggagagcaccgccgagaaaaacgtagtgtcgcgctcgtgccccatgttggcatgggtctggagactagaaccgaaacatggatgagctccgagggggcttggaagcacgcccagaggattgagacttgggtgcttcggcatcctggattcaccatcatggcagccatactggcttacacaatcggcaccacgtattttcagcgcgtcttgattttcatcctcctgactgcagtggccccatctatgacaatgagatgcattggcatctcgaacagggactttgtagaaggggtttcaggaggtagctgggtggatatagtcctggagcacggcagttgtgtgaccactatggctaaaaataagcccacactcgacttcgaattaattaagaccgaggccaaacaccctgcgacgctgcggaagtactgcatcgaagcaaaacttaccaacacaactaccgcctcccgctgtccaacacagggggagccctctttgaatgaggaacaagataagcgatttgtgtgcaaacatagcatggtcgacagaggatggggcaacggttgtgggctgttcggaaagggcggcattgttacttgcgctatgtttacctgcaagaaaaatatggaggggaaggtggtacagcctgaaaacctagagtatacaatcgtgatcaccccacactccggagaagagaatgccgtcggtaacgatactggcaaacatgggaaggagattaaagtgacgccgcagtcaagtataacagaagcagagctcaccggatacggcactgttaccatggaatgtagccccaggacaggtctggacttcaatgagatggtgcttctgcagatggaagataaggcttggttggtccaccggcaatggtttctcgacctgcctttaccatggctgcccggggccgatacccagggctctaactggatccagaaagagactctcgtgacattcaagaaccctcacgcgaagaaacaggacgtagttgtgcttggatcccaagagggcgccatgcatacggcactgaccggggctactgaaattcagatgtcaagcggaaatttgctatttacaggtcacctgaagtgccgtctccgcatggacaaactgcagcttaagggcatgagttattctatgtgtaccgggaaattcaaggtcgtgaaggagatcgccgaaacacaacatggaactatagtcattagagtgcagtacgagggcgatggttccccatgcaaaatccccttcgagatcatggacctggaaaagaggcacgttttggggcggctcattaccgtgaacccgatcgtaacggagaaagatagccctgtcaatattgaagctgagcccccatttggcgactcgtacataatcattggagtggaacctggccagctgaagttatcttggttcaaaaaggggtcctcaatcggacagatgtttgagaccacaatgcgaggtgccaagcgcatggcaatcctgggcgatactgcctgggacttcgggagtctaggaggcgtttttaccagcattggtaaagctctccatcaagtgttcggggcgatatatggcgcagccttttccggagtctcttggacaatgaagatcctgattggcgtggtaatcacttggattgggatgaacagcagatcaaccagtctttccgtgagcttggttctggtcggagtggtgacgctctacctgggcgtcatggttcaggctgattctggttgtgtggtgtcatggaaaaataaggagcttaaatgcgggagtggaatcttcataacagacaacgtacacacctggactgaacagtataagtttcagcccgagagcccatccaagctggcctctgcaatccaaaaagcccacgaagagggcatttgtggtatcaggtcggtcacacggttggaaaatctcatgtggaagcagattacccccgagctgaaccatatcttaagcgagaatgaagtgaaactgactataatgaccggcgatattaaggggatcatgcaggctggaaaacgctccctaagacctcagccaacagagctcaagtactcatggaaagcctggggcaaggcaaagatgctgagtacggaacttcacaaccataccttcttgattgacgggccggagactgcggaatgccccaatacaaacagggcttggaactctctggaggttgaggattatggatttggcgtgttcaccacaaacatctggctcaaactgaaggaacgtcaagacgtcttttgtgacagcaaattaatgtccgccgcaataaaggataatcgggccgtgcacgctgacatgggttactggatcgagtcagccctgaacgatacttggaaaattgaaaaggccagcttcatcgaggttaagtcttgccactggcctaaatcccataccctttggagtaacggggtgttggagagcgaaatgattatcccaaagaatttcgctggacccgtatctcagcacaactatcgacctggctaccatacgcagacagccggtccatggcacctcggcaaactggagatggactttgatttctgtgaagggaccactgtcgtggtgaccgaggactgcggaaatagaggcccctccctaaggacaactaccgcgtcagggaagctgataacagaatggtgctgtcgcagttgcacgctcccgcctctgcggtacagaggagaggatggctgttggtatggtatggagattaggccacttaaagaaaaggaggaaaacttggtcaatagcctggttaccgccgggcatggacagatcgacaacttttcgttaggcgtgctcggtatggctctgttccttgaggaaatgctgcgcactcgagtaggcacaaagtacgcaatcttgctcgtggccgtctcctttgtgaccctgattactgggaatatgtctttccgggatctaggacgtgttatggtgatggtcggcgctacaatgaccgacgatatcgggatgggagtgacgtatctggccctcctggcagcgtttaaagttagacccactttcgccgctggccttttgctgaggaagttaaccagcaaagagctcatgatgacaaccattggtatagtgctgctttcacaaagtactatccctgagacaattctggaactaaccgacgccctcgcactggggatgatggtcttgaagatcgtacgcaacatggagaaataccagctggctgtgacaattatggccatcttatgcgttcccaatgcagtgatactccagaacgcctggaaggtctcctgtactatcctggctgtggtatctgtgagcccacttctgttgacctcctcacaacagaaggcggattggattcctctcgccctgacgatcaaaggactaaatcccacagcaatttttctgaccactcttagccggaccagtaagaaaagatcttggccactcaacgaagctatcatggccgtcggcatggtttccatactggccagctcgttgctgaagaatgacattccgatgacaggccctttagtggctgggggactcctgactgtgtgctatgtccttaccggtaggtcagcagacctggagttggaacgagccgcggatgtgcgctgggaggagcaggctgaaatctctggcagttcccccatcctcagcattacgatatctgaggacgggagcatgtccatcaaaaacgaagaggaggaacagacactgaccattctaatccggactggactgcttgttatttcaggcctcttcccagtaagtatccccataacagccgcagcctggtacctgtgggaggtgaagaaacaaagagctggtgtcttgtgggatgtgcctagcccaccccctgttgggaaggcagaattagaggacggagcctataggatcaagcagaaaggcattctgggctactctcagatcggggcgggagtgtacaaggaaggtacctttcacactatgtggcacgtcacacgtggcgctgtgctcatgcataaagggaagcgcattgagccgtcctgggccgatgtcaagaaggacctgatctcatatggaggcggttggaaacttgagggggaatggaaagagggagaagaggtccaggtgctggcattggaaccaggcaagaatccccgggccgttcaaaccaaacctggcctattcaagacgaacactgggaccataggagctgtgagtctggattttagcccaggtacatccggctctcccattgtcgacaaaaaggggaaggtggttggactctacggcaacggtgtggtcaccagatcggggacatatgtgagcgccatcgcacagactgagaaatcaatcgaggataatcctgaaattgaggacgatatcttcaggaagaaacgactgaccataatggaccttcacccgggagctggcaagacgaaacggtacttacccgccattgtacgcgaagcgatcaagagaggcctgaggacactcattttggccccaactcgggtggttgcagctgagatggaagaggccctgcgagggctccctatcagatatcagacccccgctatacgcgcagagcatacaggaagggaaattgtcgatctgatgtgtcacgccaccttcactatgcgtcttctgtccccaatccgggtgcctaactacaatttgatcattatggacgaggcccattttaccgaccccgctagtatcgcggcaagaggttatatttctacaagggtggaaatgggcgaggccgctgggatattcatgacggccactccaccgggaagccgcgatccttttccccagtccaacgcaccaatcatggacgaggaacgagagattcccgaaagatcatggaactctggccacgagtgggtcaccgatttcaagggtaaaacagtatggtttgtgcctagcatcaaggccgggaacgacatcgctgcgtgcctacggaaaaatggaaagaaagttattcaactgagtaggaagaccttcgattccgaatacgtgaagactcgcacaaacgactgggattttgtcgtgaccacggacataagcgagatgggcgccaatttcaaagcagagcgtgttatcgatccaagacggtgtatgaagcccgtgattctcactgacggcgaagagagggtcatcttagctgggcctatgccggtgacacactcttcagccgcacagcgccgaggaagagtaggtcggaaccccaagaatgaaaacgatcagtacatttatatgggcgagcccctggaaaatgacgaggactgcgcccattggaaggaggctaaaatgcttctggataacatcaatacccctgaagggataatcccctccatgtttgagccagaaagggagaaggtggacgccattgatggagaataccgcctcagaggcgaggcgaggaaaaccttcgttgacttgatgcggcgtggtgatctgcctgtctggctcgcatatcgcgtggccgctgaggggatcaactacgccgaccgaagatggtgttttgatggcgtgaagaacaatcaaattctggaagagaacgtcgaagttgagatctggactaaggagggagaaaggaagaaacttaaaccccggtggctagacgctcgcatatatagtgatccactggcattgaaagagttcaaagagttcgccgctggcagaaagagcttaacactgaatctcattaccgagatggggaggctgcctacatttatgactcagaaggcccggaacgcacttgacaatctggcggtgctccacacggccgaagctggaggtcgagcctacaaccatgcattgtcggagctgccggagaccctagaaacactgctccttctgactttattggctaccgtaacaggcgggatcttcctgtttctcatgtctggaaaaggcattggtaagatgaccctggggatgtgctgcatcataactgcctccgtgcttctgtggtatgcacagatccagccccactggattgccgctagcatcattctcgagttctttttgatcgtcctgttaataccagaacctgagaaacaaagaacgccccaggataatcagctaacctacgtggttattgcgatcctgacagtggtcgccgcaactatggctaacgaaatgggcttcctcgagaagaccaaaaaggactttggacttggcgggatcgccacacagcaaccagagtcaaatattctggatatcgacttgcgccctgccagtgcatggaccctgtacgctgtagccactacattcataacgcccatgctcaggcactctattgaaaactccagcgtgaatgtttcactgaccgcgatcgctaaccaggccactgtgcttatgggactcggtaagggctggccgctgagtaaaatggacattggggtcccattgctggcaatcggatgttatagccaggtgaatcctataacattaaccgccgctctactgctccttgtcgcacattacgccatcattggccccggtctgcaggcgaaggctacccgggaggcccaaaaacgtgcagccgctgggatcatgaagaacccaacagtggatggcattactgttatcgacttggatcccattccttatgacccgaaatttgaaaagcagctgggacaggtgatgctcctggtactttgcgtgacgcaggtcttaatgatgagaaccacatgggccctgtgtgaggcactcactttggctaccggccccatctccacactgtgggaagggaatccaggaaggttctggaacaccactatagccgtttctatggcgaatatttttcgcggcagctacctagccggtgcagggctactcttctccatcatgaagaacacggctaacacacggcgaggaaccggcaatactggtgagacccttggcgagaaatggaagaacagactgaatgccttggggaaatcagaatttcaaatctataagaaatctggcattcaggaggtggataggacactggcaaaggaaggcataaaacgcggggagactgaccaccatgctgtcagtcggggatcggccaagctcagatggttcgtggagcgtaacctggtaacccctgaaggcaaggtgatggatttaggttgcgggaggggaggctggagctactattgtggtggccttaaaaatgttaaggaggtgaaagggctgacaaagggaggccccgggcacgaagaacctatcccaatgtccacgtacggatggaacctcgtccggctacagtctggcgtggacgtcttctttacaccacctgaaaaatgcgatactctgttgtgtgacattggtgagtcaagcccaaatcccacagtggaggccgggcgcaccctgcgagttctcaaccttgtagaaaattggctgaacaataacactcaattctgcatcaaggtgttgaatccgtacatgccttccgtcattgagaagatggaagcgctgcagagaaaatatggaggcgctctcgtgaggaacccattaagtagaaattctacacatgagatgtactgggttagcaacgcatcaggcaacatcgtgtccagtgtcaatatgataagccgcatgctgatcaacagatttaccatgaggcacaagaaagccacgtatgaacccgatgtggaccttgggtctggaacccgaaatattggtatcgagtccgagacacctaacctggatattatcggcaagcggatagagaaaattaagcaggaacacgaaacttcatggcattacgaccaggaccacccatataagacctgggcttaccatgggagctatgagacaaaacaaactggatcggcctctagtatggtaaatggcgtggttcgtctactcaccaagccctgggatgtcatcccgatggtgacacagatggcaatgaccgacactacgcctttcggtcagcagagagtgtttaaagaaaaggtcgatacacgcacccaagagcccaaagaggggactaagaagctgatgaaaatcaccgccgaatggttgtggaaggagctgggcaagaagaaaacaccaaggatgtgtacgcgggaagagttcaccagaaaggttcgctccaacgctgcgctcggcgccatttttactgacgagaataaatggaaaagcgcaagggaagctgtggaggattcaggcttctgggaacttgtagacaaggagcgaaacctgcacttagaagggaaatgcgagacatgtgtgtacaatatgatgggaaagcgggagaaaaagctgggtgaatttggcaaagccaaggggtccagagcaatatggtacatgtggttgggagccaggttcctcgagtttgaagctctgggcttcctaaacgaggatcactggttttctcgcgaaaatagccttagtggtgtcgagggggagggactgcataagctcggctatatcctgcgtgacgtgtccaaaaaggaaggcggggccatgtacgcggatgacaccgcaggatgggatactcggattacattggaggacctgaaaaacgaagagatggttaccaatcacatggaaggtgagcataagaaactcgccgaggctatcttcaaacttacatatcagaacaaggtggtcagagtgcagaggcctactccccgcggcaccgtaatggacattatcagccgacgggatcagagagggtctggacaagttgtgacgtacggcctgaataccttcacaaacatggaagcccagttaataaggcagatggagggtgaaggggtctttaaatcaatccaacagctgactgcaaccgaggagattgctgtgaagaactggttggcccgcgtgggaagagaacggctcagtaggatggctatctccggcgacgattgcgtcgttaaaccactggacgatcgtttcgccagcgcactaacagcgcttaatgacatgggcaaggtgcgaaaagatattcagcagtgggagccctctcgcgggtggaacgactggactcaagtacctttttgctcgcaccatttccacgaactgatcatgaaggatggaagagtgctcgtcgtgccatgtcggaatcaggacgagctgattggtagggcccgcatatcacagggcgctgggtggagcttgagagaaaccgcctgcttaggaaagtcctatgcacagatgtggagtctgatgtactttcaccggagggatctccgacttgctgccaacgcaatctgttctgccgttccgagccattgggtgcccacgtcccgtacaacctggtcaattcacgcgactcatgagtggatgacaaccgaggacatgctgactgtctggaatagagtgtggatccaagaaaacccttggatcgaggataaaaccccagtagaaagttgggaggaaattccctatctaggcaagcgcgaggaccagtggtgcggttctctgatagggctcacaagccgggctacgtgggccaaaaatatccagaccgcaattaaccaggttaggtccttgatcggaaatgaggaatacactgactacatgccttcaatgaagagattccgccgggaggaagaggaagccggcgtgctgtggtga

SEQ ID NO: 15051 - RNA, 9876 nt, synthetic construct
  misc_feature 1..9876: note = derived and/or modified CDS sequence (opt3) from DENV-2__DQ645549__SS-prME
  source 1..9876: mol_type = other RNA
accgcaggagtgatcattatgatgatacccaccgtagttgctttccacctgactacgcggaatggggaacctcatatgatcgtgagcaggcaggaaaagggaaagtccctcctttttaagaccgagaatggtgtaaatatgtgcacactgatggcaatggacttgggagaattatgtgaggatactattacctacaattgcccactgctgcggcaaaacgaaccggaggacatcgattgttggtgcaattctacatcaacctgggtgacttatgggacatgtaccgccacgggagagcaccgccgagaaaaacgtagtgtcgcgctcgtgccccatgttggcatgggtctggagactagaaccgaaacatggatgagctccgagggggcttggaagcacgcccagaggattgagacttgggtgcttcggcatcctggattcaccatcatggcagccatactggcttacacaatcggcaccacgtattttcagcgcgtcttgattttcatcctcctgactgcagtggccccatctatgacaatgagatgcattggcatctcgaacagggactttgtagaaggggtttcaggaggtagctgggtggatatagtcctggagcacggcagttgtgtgaccactatggctaaaaataagcccacactcgacttcgaattaattaagaccgaggccaaacaccctgcgacgctgcggaagtactgcatcgaagcaaaacttaccaacacaactaccgcctcccgctgtccaacacagggggagccctctttgaatgaggaacaagataagcgatttgtgtgcaaacatagcatggtcgacagaggatggggcaacggttgtgggctgttcggaaagggcggcattgttacttgcgctatgtttacctgcaagaaaaatatggaggggaaggtggtacagcctgaaaacctagagtatacaatcgtgatcaccccacactccggagaagagaatgccgtcggtaacgatactggcaaacatgggaaggagattaaagtgacgccgcagtcaagtataacagaagcagagctcaccggatacggcactgttaccatggaatgtagccccaggacaggtctggacttcaatgagatggtgcttctgcagatggaagataaggcttggttggtccaccggcaatggtttctcgacctgcctttaccatggctgcccggggccgatacccagggctctaactggatccagaaagagactctcgtgacattcaagaaccctcacgcgaagaaacaggacgtagttgtgcttggatcccaagagggcgccatgcatacggcactgaccggggctactgaaattcagatgtcaagcggaaatttgctatttacaggtcacctgaagtgccgtctccgcatggacaaactgcagcttaagggcatgagttattctatgtgtaccgggaaattcaaggtcgtgaaggagatcgccgaaacacaacatggaactatagtcattagagtgcagtacgagggcgatggttccccatgcaaaatccccttcgagatcatggacctggaaaagaggcacgttttggggcggctcattaccgtgaacccgatcgtaacggagaaagatagccctgtcaatattgaagctgagcccccatttggcgactcgtacataatcattggagtggaacctggccagctgaagttatcttggttcaaaaaggggtcctcaatcggacagatgtttgagaccacaatgcgaggtgccaagcgcatggcaatcctgggcgatactgcctgggacttcgggagtctaggaggcgtttttaccagcattggtaaagctctccatcaagtgttcggggcgatatatggcgcagccttttccggagtctcttggacaatgaagatcctgattggcgtggtaatcacttggattgggatgaacagcagatcaaccagtctttccgtgagcttggttctggtcggagtggtgacgctctacctgggcgtcatggttcaggctgattctggttgtgtggtgtcatggaaaaataaggagcttaaatgcgggagtggaatcttcataacagacaacgtacacacctggactgaacagtataagtttcagcccgagagcccatccaagctggcctctgcaatccaaaaagcccacgaagagggcatttgtggtatcaggtcggtcacacggttggaaaatctcatgtggaagcagattacccccgagctgaaccatatcttaagcgagaatgaagtgaaactgactataatgaccggcgatattaaggggatcatgcaggctggaaaacgctccctaagacctcagccaacagagctcaagtactcatggaaagcctggggcaaggcaaagatgctgagtacggaacttcacaaccataccttcttgattgacgggccggagactgcggaatgccccaatacaaacagggcttggaactctctggaggttgaggattatggatttggcgtgttcaccacaaacatctggctcaaactgaaggaacgtcaagacgtcttttgtgacagcaaattaatgtccgccgcaataaaggataatcgggccgtgcacgctgacatgggttactggatcgagtcagccctgaacgatacttggaaaattgaaaaggccagcttcatcgaggttaagtcttgccactggcctaaatcccataccctttggagtaacggggtgttggagagcgaaatgattatcccaaagaatttcgctggacccgtatctcagcacaactatcgacctggctaccatacgcagacagccggtccatggcacctcggcaaactggagatggactttgatttctgtgaagggaccactgtcgtggtgaccgaggactgcggaaatagaggcccctccctaaggacaactaccgcgtcagggaagctgataacagaatggtgctgtcgcagttgcacgctcccgcctctgcggtacagaggagaggatggctgttggtatggtatggagattaggccacttaaagaaaaggaggaaaacttggtcaatagcctggttaccgccgggcatggacagatcgacaacttttcgttaggcgtgctcggtatggctctgttccttgaggaaatgctgcgcactcgagtaggcacaaagcacgcaatcttgctcgtggccgtctcctttgtgaccctgattactgggaatatgtctttccgggatctaggacgtgttatggtgatggtcggcgctacaatgaccgacgatatcgggatgggagtgacgtacctggccctcctggcagcgtttaaagttagacccactttcgccgctggccttttgctgaggaagttaaccagcaaagagctcatgatgacaaccattggtatagtgctgctttcacaaagtactatccctgagacaattctggaactaaccgacgccctcgcactggggatgatggtcttgaagatcgtacgcaacatggagaaatatcagctggctgtgacaattatggccatcttatgcgttcccaatgcagtgatactccagaacgcctggaaggtctcctgtactatcctggctgtggtatctgtgagcccacttctgttgacctcctcacaacagaaggcggattggattcctctcgccctgacgatcaaaggactaaatcccacagcaatttttctgaccactcttagccggaccagtaagaaaagatcttggccactcaacgaagctatcatggccgtcggcatggtttccatactggccagctcgttgctgaagaatgacattccgatgacaggccctttagtggctgggggactcctgactgtgtgctacgtccttaccggtaggtcagcagacctggagttggaacgagccgcggatgtgcgctgggaggagcaggctgaaatctctggcagttcccccatcctcagcattacgatatctgaggacgggagcatgtccatcaaaaacgaagaggaggaacagacactgaccattctaatccggactggactgcttgttatttcaggcctcttcccagtaagtatccccataacagccgcagcctggtatctgtgggaggtgaagaaacaaagagctggtgtcttgtgggatgtgcctagcccaccccctgttgggaaggcagaattagaggacggagcctacaggatcaagcagaaaggcattctgggctattctcagatcggggcgggagtgtacaaggaaggtacctttcacactatgtggcatgtcacacgtggcgctgtgctcatgcacaaagggaagcgcattgagccgtcctgggccgatgtcaagaaggacctgatctcatacggaggcggttggaaacttgagggggaatggaaagagggagaagaggtccaggtgctggcattggaaccaggcaagaatccccgggccgttcaaaccaaacctggcctattcaagacgaacactgggaccataggagctgtgagtctggattttagcccaggtacatccggctctcccattgtcgacaaaaaggggaaggtggttggactctatggcaacggtgtggtcaccagatcggggacatacgtgagcgccatcgcacagactgagaaatcaatcgaggataatcctgaaattgaggacgatatcttcaggaagaaacgactgaccataatggaccttcatccgggagctggcaagacgaaacggtatttacccgccattgtacgcgaagcgatcaagagaggcctgaggacactcattttggccccaactcgggtggttgcagctgagatggaagaggccctgcgagggctccctatcagataccagacccccgctatacgcgcagagcacacaggaagggaaattgtcgatctgatgtgtcatgccaccttcactatgcgtcttctgtccccaatccgggtgcctaactataatttgatcattatggacgaggcccactttaccgaccccgctagtatcgcggcaagaggttacatttctacaagggtggaaatgggcgaggccgctgggatattcatgacggccactccaccgggaagccgcgatccttttccccagtccaacgcaccaatcatggacgaggaacgagagattcccgaaagatcatggaactctggccacgagtgggtcaccgatttcaagggtaaaacagtatggtttgtgcctagcatcaaggccgggaacgacatcgctgcgtgcctacggaaaaatggaaagaaagttattcaactgagtaggaagaccttcgattccgaatatgtgaagactcgcacaaacgactgggattttgtcgtgaccacggacataagcgagatgggcgccaatttcaaagcagagcgtgttatcgatccaagacggtgtatgaagcccgtgattctcactgacggcgaagagagggtcatcttagctgggcctatgccggtgacacattcttcagccgcacagcgccgaggaagagtaggtcggaaccccaagaatgaaaacgatcagtacatttacatgggcgagcccctggaaaatgacgaggactgcgcccactggaaggaggctaaaatgcttctggataacatcaatacccctgaagggataatcccctccatgtttgagccagaaagggagaaggtggacgccattgatggagaatatcgcctcagaggcgaggcgaggaaaaccttcgttgacttgatgcggcgtggtgatctgcctgtctggctcgcataccgcgtggccgctgaggggatcaactatgccgaccgaagatggtgttttgatggcgtgaagaacaatcaaattctggaagagaacgtcgaagttgagatctggactaaggagggagaaaggaagaaacttaaaccccggtggctagacgctcgcatatacagtgatccactggcattgaaagagttcaaagagttcgccgctggcagaaagagcttaacactgaatctcattaccgagatggggaggctgcctacatttatgactcagaaggcccggaacgcacttgacaatctggcggtgctccatacggccgaagctggaggtcgagcctataaccacgcattgtcggagctgccggagaccctagaaacactgctccttctgactttattggctaccgtaacaggcgggatcttcctgtttctcatgtctggaaaaggcattggtaagatgaccctggggatgtgctgcatcataactgcctccgtgcttctgtggtacgcacagatccagccccactggattgccgctagcatcattctcgagttctttttgatcgtcctgttaataccagaacctgagaaacaaagaacgccccaggataatcagctaacctatgtggttattgcgatcctgacagtggtcgccgcaactatggctaacgaaatgggcttcctcgagaagaccaaaaaggactttggacttggcgggatcgccacacagcaaccagagtcaaatattctggatatcgacttgcgccctgccagtgcatggaccctgtacgctgtagccactacattcataacgcccatgctcaggcattctattgaaaactccagcgtgaatgtttcactgaccgcgatcgctaaccaggccactgtgcttatgggactcggtaagggctggccgctgagtaaaatggacattggggtcccattgctggcaatcggatgttacagccaggtgaatcctataacattaaccgccgctctactgctccttgtcgcacactatgccatcattggccccggtctgcaggcgaaggctacccgggaggcccaaaaacgtgcagccgctgggatcatgaagaacccaacagtggatggcattactgttatcgacttggatcccattccttacgacccgaaatttgaaaagcagctgggacaggtgatgctcctggtactttgcgtgacgcaggtcttaatgatgagaaccacatgggccctgtgtgaggcactcactttggctaccggccccatctccacactgtgggaagggaatccaggaaggttctggaacaccactatagccgtttctatggcgaatatttttcgcggcagctatctagccggtgcagggctactcttctccatcatgaagaacacggctaacacacggcgaggaaccggcaatactggtgagacccttggcgagaaatggaagaacagactgaatgccttggggaaatcagaatttcaaatctacaagaaatctggcattcaggaggtggataggacactggcaaaggaaggcataaaacgcggggagactgaccatcacgctgtcagtcggggatcggccaagctcagatggttcgtggagcgtaacctggtaacccctgaaggcaaggtgatggatttaggttgcgggaggggaggctggagctattactgtggtggccttaaaaatgttaaggaggtgaaagggctgacaaagggaggccccgggcatgaagaacctatcccaatgtccacgtatggatggaacctcgtccggctacagtctggcgtggacgtcttctttacaccacctgaaaaatgcgatactctgttgtgtgacattggtgagtcaagcccaaatcccacagtggaggccgggcgcaccctgcgagttctcaaccttgtagaaaattggctgaacaataacactcaattctgcatcaaggtgttgaatccgtacatgccttccgtcattgagaagatggaagcgctgcagagaaaatacggaggcgctctcgtgaggaacccattaagtagaaattctacacacgagatgtattgggttagcaacgcatcaggcaacatcgtgtccagtgtcaatatgataagccgcatgctgatcaacagatttaccatgaggcacaagaaagccacgtacgaacccgatgtggaccttgggtctggaacccgaaatattggtatcgagtccgagacacctaacctggatattatcggcaagcggatagagaaaattaagcaggaacatgaaacttcatggcactatgaccaggaccatccatacaagacctgggcttatcacgggagctacgagacaaaacaaactggatcggcctctagtatggtaaatggcgtggttcgtctactcaccaagccctgggatgtcatcccgatggtgacacagatggcaatgaccgacactacgcctttcggtcagcagagagtgtttaaagtcaaggttgatacacgcacccaagaacccaaagaggggactaagaagctgatgaaaatcaccgccgagtggttgtggaaggaactgggcaagaagaaaacaccaaggatgtgtacgcgggaggagttcaccagaaaggtgcgctccaacgctgcgctcggcgccatttttactgacgagaataaatggaaaagcgcaagggaggctgtagaagattcaggcttctgggagcttgtggacaaggaacgaaacctgcacttagaggggaaatgcgaaacatgtgtctataatatgatgggaaagcgggagaaaaagctgggtgagtttggcaaagccaaggggtccagagcaatatggtacatgtggttgggagccaggttcctcgaatttgaggctctgggcttcctaaacgaagatcattggttttctcgcgagaatagccttagtggtgtggaaggggagggactgcacaagctcggctacatcctgcgtgacgtttccaaaaaggagggcggggccatgtatgcggatgacaccgcaggatgggatactcggattacattggaagacctgaaaaacgaggaaatggtgaccaatcatatggagggtgaacacaagaaactcgccgaggctatcttcaaacttacataccagaacaaggtcgtgagagtacagaggcctactccccgcggcaccgttatggacattatcagccgacgggatcagagagggtctggacaagtggtcacgtatggcctgaataccttcacaaacatggaggcccagttaataaggcagatggaaggtgagggggtgtttaaatcaatccaacagctgactgcaaccgaagagattgctgtgaagaactggttggcccgcgtcggaagagagcggctcagtaggatggctatctccggcgacgattgcgttgtgaaaccactggacgatcgtttcgccagcgcactaacagcgcttaatgacatgggcaaggtacgaaaagatattcagcagtgggaaccctctcgcgggtggaacgactggactcaagtgcctttttgctcgcatcacttccacgagctgatcatgaaggatggaagagtcctcgtggttccatgtcggaatcaggacgaactgattggtagggcccgcatatcacagggcgctgggtggagcttgagagagaccgcctgcttaggaaagtcctacgcacagatgtggagtctgatgtattttcatcggagggatctccgacttgctgccaacgcaatctgttctgccgtgccgagccactgggtccccacgtcccgtacaacctggtcaattcatgcgactcacgaatggatgacaaccgaggacatgctgactgtgtggaatagagtatggatccaagagaacccttggatcgaagataaaaccccagttgagagttgggaagagattccctacctaggcaagcgcgaagaccagtggtgcggttctctgatagggctcacaagccgggctacgtgggccaaaaatatccagaccgcaattaaccaggtgaggtccttgatcggaaatgaggagtatactgactacatgccttcaatgaagagattccgccgggaagaggaagaggccggcgtcctgtggtga

SEQ ID NO: 15052 - RNA, 9876 nt, synthetic construct
  misc_feature 1..9876: note = derived and/or modified CDS sequence (opt3) from DENV-2__DQ645550__SS-prME
  source 1..9876: mol_type = other RNA
accgcaggagtgatcattatgatgatacccaccgtagttgctttccacctgactacgcggaatggggaacctcatatgatcgtgagcaggcaggaaaagggaaaatccctcctttttaagaccgaaaatggtgtaaatatgtgcacactgatggcaatggacttgggagaattatgtgaggatactattacctacaattgcccactgcttcggcaaaacgaaccggaggacatcgattgttggtgcaattctacatcaacctgggtgacttatgggacatgtaccgccacgggagagcaccgccgagaaaaacgtagtgtcgcgctcgtgccccatgttggcatgggtctggagactagaaccgaaacatggatgagctccgagggggcttggaagcacgcccagaggattgagacttgggtgcttcggcatcctggattcaccatcatggcagccatactggcttacacaatcggcaccacgtattttcagcgcgtcttgattttcatcctcctgactgcagtggccccatctatgacaatgagatgcattggcatctcgaacagggactttgtagaaggggtttcaggaggtagctgggtggatatagtcctggagcacggcagttgtgtgaccactatggctaaaaataagcccacactcgacttcgaattaattaagaccgaggccaaacaccctgcgacgctgcggaagtactgcatcgaagcaaaacttaccaacacaactaccgcctcccgctgtccaacacagggggagccctctttgaatgaggaacaagataagcgatttgtgtgcaaacatagcatggtcgacagaggatggggcaacggttgtgggctgttcggaaagggcggcattgttacttgcgctatgtttacctgcaagaaaaatatggaggggaaggtggtacagcctgaaaacctagagtatacaatcgtgatcaccccacactccggagaagagaatgccgtcggtaacgatactggcaaacatgggaaggagattaaagtgacgccgcagtcaagtataacagaagcagagctcaccggatacggcactgttaccatggaatgtagccccaggacaggtctggacttcaatgagatggtgcttctgcagatggaagataaggcttggttggtccaccggcaatggtttctcgacctgcctttaccatggctgcccggggccgatacccagggctctaactggatccagaaagagactctcgtgacattcaagaaccctcacgcgaagaaacaggacgtagttgtgcttggatcccaagagggcgccatgcatacggcactgaccggggctactgaaattcagatgtcaagcggaaatttgctatttacaggtcacctgaagtgccgtctccgcatggacaaactgcagcttaagggcatgagttattctatgtgtaccgggaaattcaaggtcgtgaaggagatcgccgaaacacaacatggaactatagtcattagagtgcagtacgagggcgatggttccccatgcaaaatccccttcgagatcatggacctggaaaagaggcacgttttggggcggctcattaccgtgaacccgatcgtaacggagaaagatagccctgtcaatattgaagctgagcccccatttggcgactcgtacataatcattggagtggaacctggccagctgaagttatcttggttcaaaaaggggtcctcaatcggacagatgtttgagaccacaatgcgaggtgccaagcgcatggcaatcctgggcgatactgcctgggacttcgggagtctaggaggcgtttttaccagcattggtaaagctctccatcaagtgttcggggcgatatatggcgcagccttttccggagtctcttggacaatgaagatcctgattggcgtggtaatcacttggattgggatgaacagcagatcaaccagtctttccgtgagcttggttctggtcggagtggtgacgctctacctgggcgtcatggttcaggctgattctggttgtgtggtgtcatggaaaaataaggagcttaaatgcgggagtggaatcttcataacagacaacgtacacacctggactgaacagtataagtttcagcccgagagcccatccaagctggcctctgcaatccaaaaagcccacgaagagggcatttgtggtatcaggtcggtcacacggttggaaaatctcatgtggaagcagattacccccgagctgaaccatatcttaagcgagaatgaagtgaaactgactataatgaccggcgatattaaggggatcatgcaggctggaaaacgctccctaagacctcagccaacagagctcaagtactcatggaaagcctggggcaaggcaaagatgctgagtacggaacttcacaaccataccttcttgattgacgggccggagactgcggaatgccccaatacaaacagggcttggaactctctggaggttgaggattatggatttggcgtgttcaccacaaacatctggctcaaactgaaggaacgtcaagacgtcttttgtgacagcaaattaatgtccgccgcaataaaggataatcgggccgtgcacgctgacatgggttactggatcgagtcagccctgaacgatacttggaaaattgaaaaggccagcttcatcgaggttaagtcttgccactggcctaaatcccataccctttggagtaacggggtgttggagagcgaaatgattatcccaaagaatttcgctggacccgtatctcagcacaactatcgacctggctaccatacgcagacagccggtccatggcacctcggcaaactggagatggactttgatttctgtgaagggaccactgtcgtggtgaccgaggactgcggaaatagaggcccctccctaaggacaactaccgcgtcagggaagctgataacagaatggtgctgtcgcagttgcacgctcccgcctctgcggtacagaggagaggatggctgttggtatggtatggagattaggccacttaaagaaaaggaggaaaacttggtcaatagcctggttaccgccgggcatggacagatcgacaacttttcgttaggcgtgctcggtatggctctgttccttgaggaaatgctgcgcactcgagtaggcacaaagcacgcaatcttgctcgtggccgtctcctttgtgaccctgattactgggaatatgtctttccgggatctaggacgtgttatggtgatggtcggcgctacaatgaccgacgatatcgggatgggagtgacgtacctggccctcctggcagcgtttaaagttagacccactttcgccgctggccttttgctgaggaagttaaccagcaaagagctcatgatgacaaccattggtatagtgctgctttcacaaagtactatccctgagacaattctggaactaaccgacgccctcgcactggggatgatggtcttgaagatcgtacgcaacatggagaaatatcagctggctgtgacaattatggccatcttatgcgttcccaatgcagtgatactccagaacgcctggaaggtctcctgtactatcctggctgtggtatctgtgagcccacttctgttgacctcctcacaacagaaggcggattggattcctctcgccctgacgatcaaaggactaaatcccacagcaatttttctgaccactcttagccggaccagtaagaaaagatcttggccactcaacgaagctatcatggccgtcggcatggtttccatactggccagctcgttgctgaagaatgacattccgatgacaggccctttagtggctgggggactcctgactgtgtgctacgtccttaccggtaggtcagcagacctggagttggaacgagccgcggatgtgcgctgggaggagcaggctgaaatctctggcagttcccccatcctcagcattacgatatctgaggacgggagcatgtccatcaaaaacgaagaggaggaacagacactgaccattctaatccggactggactgcttgttatttcaggcctcttcccagtaagtatccccataacagccgcagcctggtatctgtgggaggtgaagaaacaaagagctggtgtcttgtgggatgtgcctagcccaccccctgttgggaaggcagaattagaggacggagcctacaggatcaagcagaaaggcattctgggctattctcagatcggggcgggagtgtacaaggaaggtacctttcacactatgtggcatgtcacacgtggcgctgtgctcatgcacaaagggaagcgcattgagccgtcctgggccgatgtcaagaaggacctgatctcatacggaggcggttggaaacttgagggggaatggaaagagggagaagaggtccaggtgctggcattggaaccaggcaagaatccccgggccgttcaaaccaaacctggcctattcaagacgaacactgggaccataggagctgtgagtctggattttagcccaggtacatccggctctcccattgtcgacaaaaaggggaaggtggttggactctatggcaacggtgtggtcaccagatcggggacatacgtgagcgccatcgcacagactgagaaatcaatcgaggataatcctgaaattgaggacgatatcttcaggaagaaacgactgaccataatggaccttcatccgggagctggcaagacgaaacggtatttacccgccattgtacgcgaagcgatcaagagaggcctgaggacactcattttggccccaactcgggtggttgcagctgagatggaagaggccctgcgagggctccctatcagataccagacccccgctatacgcgcagagcacacaggaagggaaattgtcgatctgatgtgtcatgccaccttcactatgcgtcttctgtccccaatccgggtgcctaactataatttgatcattatggacgaggcccactttaccgaccccgctagtatcgcggcaagaggttacatttctacaagggtggaaatgggcgaggccgctgggatattcatgacggccactccaccgggaagccgcgatccttttccccagtccaacgcaccaatcatggacgaggaacgagagattcccgaaagatcatggaactctggccacgagtgggtcaccgatttcaagggtaaaacagtatggtttgtgcctagcatcaaggccgggaacgacatcgctgcgtgcctacggaaaaatggaaagaaagttattcaactgagtaggaagaccttcgattccgaatatgtgaagactcgcacaaacgactgggattttgtcgtgaccacggacataagcgagatgggcgccaatttcaaagcagagcgtgttatcgatccaagacggtgtatgaagcccgtgattctcactgacggcgaagagagggtcatcttagctgggcctatgccggtgacacattcttcagccgcacagcgccgaggaagagtaggtcggaaccccaagaatgaaaacgatcagtacatttacatgggcgagcccctggaaaatgacgaggactgcgcccactggaaggaggctaaaatgcttctggataacatcaatacccctgaagggataatcccctccatgtttgagccagaaagggagaaggtggacgccattgatggagaatatcgcctcagaggcgaggcgaggaaaaccttcgttgacttgatgcggcgtggtgatctgcctgtctggctcgcataccgcgtggccgctgaggggatcaactatgccgaccgaagatggtgttttgatggcgtgaagaacaatcaaattctggaagagaacgtcgaagttgagatctggactaaggagggagaaaggaagaaacttaaaccccggtggctagacgctcgcatatacagtgatccactggcattgaaagagttcaaagagttcgccgctggcagaaagagcttaacactgaatctcattaccgagatggggaggctgcctacatttatgactcagaaggcccggaacgcacttgacaatctggcggtgctccatacggccgaagctggaggtcgagcctataaccacgcattgtcggagctgccggagaccctagaaacactgctccttctgactttattggctaccgtaacaggcgggatcttcctgtttctcatgtctggaaaaggcattggtaagatgaccctggggatgtgctgcatcataactgcctccgtgcttctgtggtacgcacagatccagccccactggattgccgctagcatcattctcgagttctttttgatcgtcctgttaataccagaacctgagaaacaaagaacgccccaggataatcagctaacctatgtggttattgcgatcctgacagtggtcgccgcaactatggctaacgaaatgggcttcctcgagaagaccaaaaaggactttggacttggcgggatcgccacacagcaaccagagtcaaatattctggatatcgacttgcgccctgccagtgcatggaccctgtacgctgtagccactacattcataacgcccatgctcaggcattctattgaaaactccagcgtgaatgtttcactgaccgcgatcgctaaccaggccactgtgcttatgggactcggtaagggctggccgctgagtaaaatggacattggggtcccattgctggcaatcggatgttacagccaggtgaatcctataacattaaccgccgctctactgctccttgtcgcacactatgccatcattggccccggtctgcaggcgaaggctacccgggaggcccaaaaacgtgcagccgctgggatcatgaagaacccaacagtggatggcattactgttatcgacttggatcccattccttacgacccgaaatttgaaaagcagctgggacaggtgatgctcctggtactttgcgtgacgcaggtcttaatgatgagaaccacatgggccctgtgtgaggcactcactttggctaccggccccatctccacactgtgggaagggaatccaggaaggctatggaacaccactatagccgtttctatggcgaatattttccgcggcagctatctggccggtgcagggctcctattttccatcatgaagaacacggctaacacacggcgaggaaccggcaatactggtgagaccctgggcgagaaatggaagaacagattgaatgccctggggaaatcagagttccaaatctacaagaaatctggcattcaggaggtggataggacactcgcaaaggaaggcataaaacgcggggagactgaccatcacgctgtcagtcggggatcggccaagctgagatggtttgtggagcgtaacttagtaacccctgaaggcaaggtgatggatcttggttgcgggaggggaggctggagctattactgtggtggcctgaaaaatgttaaggaggtgaaagggctcacaaagggaggccccgggcatgaagaacctatcccaatgtccacgtatggatggaacctagtccggctgcagtctggcgtggacgtcttcttcacaccacctgaaaaatgcgatactttgctgtgtgacattggtgagtcaagcccaaatcccacagtggaggccgggcgcaccctccgagttcttaacctggtagaaaattggttgaacaataacactcaattttgcatcaaggtgctgaatccgtacatgccttccgtcattgagaagatggaagcgctccagagaaaatacggaggcgctttagtgaggaacccactgagtagaaattctacacacgagatgtattgggttagcaacgcatcaggcaacatcgtgtccagtgtcaatatgataagccgcatgcttatcaacagattcaccatgaggcacaagaaagccacgtacgaacccgatgtggacctggggtctggaacccgaaatattggtatcgagtccgagacacctaacctagatattatcggcaagcggatagagaaaattaagcaggaacatgaaacttcatggcactatgaccaggaccatccatacaagacctgggcttatcacgggagctacgagacaaaacaaactggatcggcctctagtatggtaaatggcgtggttcgtctcctgaccaagccctgggatgtcatcccgatggtgacacagatggcaatgaccgacactacgccttttggtcagcagagagtgttcaaagtcaaggttgatacacgcacccaagaacccaaagaggggactaagaagttgatgaaaatcaccgccgagtggctgtggaaggaactcggcaagaagaaaacaccaaggatgtgtacgcgggaggaatttaccagaaaggtgcgctccaacgctgcgcttggcgccattttcactgacgagaataaatggaaaagcgcaagggaggctgtagaagattcaggcttttgggagctggtggacaaggaacgaaacttacacctggaggggaaatgcgaaacatgtgtctataatatgatgggaaagcgggagaaaaagttgggtgagttcggcaaagccaaggggtccagagcaatatggtacatgtggctcggagccaggtttctggagttcgaggctctaggctttcttaacgaagatcattggttctctcgcgagaatagcctgagtggtgtggaaggggagggactccacaagctgggctacatcttgcgtgacgtttccaaaaaggagggcggggccatgtatgcggatgacaccgcaggatgggatactcggattacactggaagacctcaaaaacgaggaaatggtgaccaatcatatggagggtgaacacaagaaacttgccgaggctatctttaagctgacataccagaacaaggtcgtgagagtacagaggcctactccccgcggcaccgttatggacattatcagccgacgggatcagagagggtctggacaagtggtcacgtatggcttaaataccttcacaaacatggaggcccagctgataaggcagatggaaggtgagggggtgttcaaatcaatccaacagttgactgcaaccgaagagattgctgtgaagaactggctcgcccgcgtcggaagagagcggctgagtaggatggctatctccggcgacgattgcgttgtgaaaccactagacgatcgttttgccagcgcacttacagcgctgaatgacatgggcaaggtacgaaaagatattcagcagtgggaaccctctcgcgggtggaacgactggactcaagtgcctttctgctcgcatcactttcacgagctcatcatgaaggatggaagagtcctggtggttccatgtcggaatcaggacgaattgattggtagggcccgcatatcacagggcgctgggtggagcttaagagagaccgcctgcctgggaaagtcctacgcacagatgtggagtctcatgtatttccatcggagggatcttcgactggctgccaacgcaatctgttctgccgtgccgagccactgggtccccacgtcccgtacaacctggtcaattcatgcgactcacgaatggatgacaaccgaggacatgctaactgtgtggaatagagtatggatccaagagaacccttggatcgaagataaaaccccagttgagagttgggaagagattccctacctgggcaagcgcgaagaccagtggtgcggttctctcatagggttgacaagccgggctacgtgggccaaaaatatccagaccgcaattaaccaggtgaggtccctgatcggaaatgaggagtatactgactacatgccttcaatgaagagatttcgccgggaagaggaagaggccggcgtcctttggtga
